United States Patent 7,767,387 (THERAPEUTIC TARGETS IN CANCER) - sequence listing, part 2

SEQ ID NO: 69 - DNA, 181413 bp, Mus musculus
  misc_feature (1)...(181413): n = A,T,C or G
gcaactggggagctgttgtgccaaggcactggctgtgtagagctctctagcctgcaccaaatgtgcatgtttctactgcaaacagcaagatccctattagcatgtccatctgcagaaggcatgaacagggatcatggatgccagcccccatttgcactgctgttgaccttgttttccctctgcagttccatgaaggaggtgggtggtgggaggctgtacacggtgtacacccgtgtgtgctgaggccagaggtcgtcttttccctctattgatctcaactttattttttgagctgttggcctttgtcactgaacctgagactggctattccagttaggatggcttgtcaacaattccaggaatccaccattcttacccctccgtcagcattggggtgcaaacctcatacttctgtaccctggtttttgttctgtttgggttcgtttttaaatgggtgctgctagacatacaaattccattctcatgattacaaagcaagtactttaatcaacaatccatctccctagcccaagagctgttctttcggggggaacagtatgatcttcaaagtccataattagaaatctcagggaaatgtcattgacactaaattgtgcctctgggagccccaaagttcttttaagaagcgcagtgatttattttctttccactcttcatgtgaccatgaagactaatagagagagagagagagacctaatgagctagactccagtgcaaggttctcttattctagctgtgtataccaaattgtttagaggagttaccgtccagcctgatgactgagttcatggtgtagccacatggtgggaggagaggaccaactcctacaagttgtcctctgacaactaaatgtacactgagctatacatgcaggtatttttgttatacacacaacacacagtggggagagtgagtgaatgaatgcaataaacaagataacaagtacaggtagtgttagtttcatgagatcagagtttggaatatgtccatctccacccacttcaaactcagtgattttagaacaccacttattacaactttaagttgtactaaaatagctagcatctccgaatgtgcccatattttactttatgaattaaacagtagtcatatgatcttcttctcttcctgaagcccattgttgcttaccttgctttctgggaggcccttcttggcccaatggctgcttttctggggccttgaagcaaccatagtggggtgcttattataatgcagctagaggaatgcctttgagtattttatgctgcatgatttaattattttaataattccaactctcatttgttacctcctgtaacaaagatcacagagcaaaaagcttttttgttcattcttctagatgggaactagactatctaaatgggaacaggacacttcaccaaccaagggtattgtgggcttggggtttgttttgttgttgtttgcaagcaatataggagcaagtgttagaatttctgcagatctttccatttaagctttggggaaaaacaactctatttttccatcaattgtaaatatatatagcaaatataattttttcagacttgtttatttcaatctacaggagtcttacctttgcagccctatctccatctgaaatgccattttgagactagcttccagaaatcacctcccaagtataattattttaagcaaatgaaacttccttttctatctttcttcacattagtatatattgtatttatcaccgagccattgaattaattgacctgtaataagatatttaaacaagtgatgaaatatagtgtttgcctctgtctgactatagcaggaatagtttgaatttgtcatccttaagcatgatattaatcttgggacaattttatagatagtctttatcaaactgagggaacccttttcttactcttggtttgctgagagttttcatcgtaagtggatgcagggttagtcagtgctctgtctgcatctgttgctatggccatattgctttactttttagcctctccactcctccccatcactttgcctctgcctcccccccccccaacctttctgtctccagtctcctcctgtcactttcatatcacattttctattgccatcccacaaaggacaatagaatagttccagttttctaccgcttacccacattcactctctcttaatcacacacatgcattagaactttgtgtcatagttacttttctgctgctttaataaaacactttgacaaaagtaactaagggaaaagagtttgttttgatccagaatttgataacttcaaggtactttccatcatgtcagggaagtcaaggagaagagcttaaagcagccacagtcaggaagcagtggtgaatattccaagttcatcccattttctcctttttaggcaacccaggaccccagcccagagaatggggctgccctcaatgaatagatcttcccactctttttaagctggtcaagataaacttccagaggatagccaaacctgcacaatacttcacctgtgtgttcagagactttcctccaaggtaattttagataatgccaagttgacaatgccaactatcacagacaggattcatacttggaaggaacacatggtgtttgttttcttaagcctgagttacctcacttattttcccagtagctaatgatgctgaacacttttaaagacttttgttgaccatttgattttgtcatttgggaattctctgttcagttcatctatccatttatttattgccaatttttattttcaatagttacagttcttcatgtagtcctcatgttaactccttatttaaagaatagctgccaaacattttctctcattttgcaagttctcctattgctccaccactgagagcttctatcactgtgcaaatctttttgacttcctgcaatcctgtttgtcaattctggaaacattattggtgttctactcagaaataattgcctgttcttttattccgaattgtgttctcttagaagttttaggtttttaattaagatccttaagtcattttgaattgacttttgttcaggatgaaagatgtgaatatggtttcattcttttgcagatggctatctacatttgttgaaaaggctgttttggttttagaggttttttgtttgttttgttttatttttctagtgcaagtttttaatgactttgtcaaagattatgtgtccatagctgtatgattttatctctagatcctctagtatattatgttagtctgtgtgtctctttgtgccagtattgatctgtctttgtcactatggatatgtagtatatattgaagtcaggtaacatattaccactggctgtttccttaaagctcagagttcctttgactatccatgaccttttgttgccacaagcctttaaggttgtttttttctccctacttctatggaaaatttcattgcaatttttacgggatccgcatttaatctatagattgttttggataaaatagacatcttcacaatctgtcaacatcataaataatgtttctagcatctagtgttcttcaatttctttttgtcagtgtcttaattttttcctggtaaaggtctctcacctactttgttggagatataattcttatcctttaaaaagatggcgtctttctaactcttctataggtaaggttgctctacagaatggggtcatgacttgaacttgatgacttgaacttgtgaagattagacagagcaaacctatggtaaagttgttggtgtggcttggtatttatcctactgggtatttttgaatctttctagatttgtggtttggtggcagacattcatgtgaagaatatcactcaccattactttaagtatcagttatgtttctttctctttccttatgtctacatcacacaatgcaccctgtgtagatgccacatagttcctcgatgtttctctgtcttttcccccaactccccaggattcttatttttccttttcattttttaacactatttattgacttatcctcagctttatagcttacttcttcagacattaccagtccactaaggccattgatgacattggttcacctacaagtttttttctttaatctctagcatttctctttgaaacattcatgttttgttctgtctgtttacatcgctcattttctcttctgtgttgtctacattttcccactaaaagtaaagctatagctcatttatcatggttatgttttttaatttgtttacttttaaaactccagtttggtcactgcaacattcttgctatgttctttcaaaaggttgttaggtctgtagttgcccagactgttactgaatttctgtcttcaacctctcctttctcagattcccaagtcactgagagactgagaaaacatcacacctggctttctcatgctagtcccaactctagcttcagtttttgtttaatgtcttcaaatttatgtcttgacttttaggatgttggggagattcaaatgagaatgacctgcacaggctcacagatttcaatacttgtttaccagggagtgacactatttgaaagggtcaggaggtgaggcctttttggagaaagtatgtcactgggagtgtgggctttgaggtttcaaaagctcattgcaaacccagagtctgggtcgcccaatggctccgtgaattaggatgtagctcccaactactgttccaacactgagtacttactgccacgctctcgccatgatgatcatagactaagccccagaaactgtaagcaagcctttagttaaatacattctttctaagtagtgccttggccatggtacttcacagcaatagaacactggctaacaaggacacactgtaagcttttgatgaagggtgcacatgatgtacttagacaggaggaactataggaatgaggcctttagtagttgccagtacaatgtggggagatgtgaaggatcccacagtcctttgcatattaccgtaggcctttagtaagctggtgtctctggactgtgaacttcatacatgtttcttagactctcaccttcacccaagatacctagaggaagttagagttgtttatttctttagtccagctatgctaaactctgttaaaggttttcctaagctgtgcttctgataaccttccccaggcagaaagactatatgattatccccaggacttctctgtgagcatctggttagtcttctagatgtagaacttgctggcatcttccccatagtgggtccctgtggtgtttgtaactcacaggcatctcctcactaagacaagcatgtgtcagttccattcagggcttcctagccagacattagttcccctgtgtccacctctcagtgctagatttgtgaagagaaatatgtttttctaacccacttctctagtggatggtctaagacacattgactctttactttgttcagcagcttgccttattacgcttcatgaaattacccccccgccccccccccccgatcttagctacaaaacagttttgtgtcagcattttccctcatgggatggtcactcagtcaggtgacccaacaataatgaacacaaggcccagaaaagcagcagagcctgctatcctaaggctaaatgtcagcagggatcatctgtgggtaatgacccttgggttcacaggacaaaattctaagtgtgtaaagggacaaacaatgaaaaaataactctccctctaaccctcaacacccagcagctcccttgatgcaaattgtcaccagattcttgggtatccttaaaacacatccataaaaatattatatgcttatatatacttttaaatgaaaactttagaagagcacatcttttcataattttagaatttgactcataatttcccttagcatttactgttcctatgaggaaaaaaaaccaaaaaccctcctgagaaatacattatactctggagtcagcccactccattcttagcgaggtccagaatttgctttttaagatgtctgcaaactttgagatctgttcttctgctttgtttttcctccctcagattcacttgaagacacaacttgtctttcttcccatgacatccgagaattctggaaaatcaatttcatgtcactcttagagaagagtaaactcctattcaacataccacactcaaaagcctctaatgtagccatttgtcagaaaaattgcttgttagtgtatgtggcagagaataaacatcttgttgtgtaatgatggacacactgtaggtaaattaattaattaattaataaaaatttaaaatgtggtcttggtaggctggcagaaatgacttcttttggaaagaacagaggagccttgcatagccagagctttgcacacaggccctgtggagagtaattgaaggaactacttggtacttcctacactcggtatgggtaacccagatgaaatactctgtgttactacaccattctggaggggcagcagcactccagactctgctgaactccggtgagatgtcagtatatctgatgatccgtgtgccaacttatttgtttctatcttattatggacaggtgacgttgttgtttagagaggataaagaactctctgagtccttgctgaatgttggcacacatttcatctgggttacccataccaagtgtaggaagtaccaagtagttccttcaattaatttccacagggcctgtgtgcaaagctctggctatgcaaggctcctctgttctttccaaaagaagtcatttctgccagcctaccaagaccacattttaaaatttttattaattaattaatttatttatttatttattttggtttttcaagacagggtttctctgtatagccctggctgtcctggaactcactctgtagaccaggctggcctcaaactcagggatcctcctgcctctgcctcccaagtgctgggattaaaggcgtgagccaccacgcctggctcaagatcacttttatttaacataagcatcaataactctagtacttgccaatgagtacaaattcatcctgacgttactcttcacagttaaagcccagaagattacacagtgcatgcagaagatcctcatgtaggtgaccaaaagggaagcatatttcatagaacctctcctagttttgtgctctgtaacttcagtgtcactgatctcttggtgatgatcttgaggaggctttgtttctaggaggcggattgtagttgggtcacactgaaggatgttctatcatggggccatattgagggatgttctagtaactgccagaaggtcacaccaagggttattctaaccatcagcgtatgagtgctgttgcttcttaacatagagagaatcttgactattcttaaaaatcagttgtagctatcattatcatttctactttactatgtgttcattatgacttgtgccactgaccatatcccttgatagaaaatacattttaagccagagttccagtcctggaaacatgaacatgggaatcatcactgtctacagacttttaaaaactcatctccaggctggtgagatggctcagtgggtaagagcacccgactgctcttccgaaggtccggagttcaaatcccagcaaccacatggtggctcacaaccatccgtaatgagatctgactccctcttctggagtgtctgaagacggctacagtgtactttcatataataagtaaataaatcttaaaaaaaaattaaaaaaaaactcatctccatcttcattttgtgttctactgttatatttcttgcttggctttttctaatcaccccttattattgtattactttaaaaactgccctaagttcctatttggaacatacagcagaaaactgacacctaagctcccctcccacatatgtccctgggaagtaggtacaaaaatctcggaaacagtaaaatttttctgaatgtgcaataataaaagtttaatccagaaattctaaacacactaaggtgtttctggcagagcttcacagtgctgcattgcacttcacagtggtcttgcttctatacacacattattcactctttgctctgtgcatgctgttacaccgtggagtaccaagaagtgctgcatcgaaactcagttcagatgcaagactaccatatggtatggctgcaaaagttttacttatcacatacaattgtcttctcttatagaataataatgtcataatacagagaacaagacatttttaatattctcctaccatcattccttagcataggagcttcaaatgagtatgtttggttatgtttggattatattgtgtttgaatgtttaatatttaaaatcaatgtcttaagtctctttataaaaaggtaacagaattttaacataggattaggatgaaatttccaagatgaccctaaatatattttttctgtttcatgctttgagaattgtaaatcaaaatattaattaactctgaacaatattacagatgttctacattccacagcttcaagtactcattcaaaacctaattttttgtaacaataaacaaatcaatctcattggtatgcaaatttgccttaatctttagtaagtggtaaagtcatatatatgccaaaaattatcttaacattgcattaggatctaccattagtcgatgtctgatttgaacacctattttatataaaatcccaagattacataaaaagcatctatgaaaagaggttgcccgtgggaaaagtttaagaaaccccgctctacttctcagtgaaggtctcaggttgtgatgagggtccctgcacaggctgggtgacgtgttcccattcaagacgccacctacaaaacttgggcagcagccctgactttgcagggtgcggacgaaaagtccggaatgcctcctttctggctgcatggaaaaagctggactgagcctcactggttagccatgacttctgctaacaaggacacccacagcaaaggggcctaaattaggggaccaagtgattttgtgaaaaactcagagactttggattgaatggaagcaggggacattcctctgatagctaagaagtagggacattggttggtctttgctgaaggaatttagttgtgggtcctgaagttcagggacacatttctactggtcaaattctaagtgaacttacttggcaatttgcctcctgatgtgcggcagggctagctgaggtcactagaggatgctaactgctctaaagatttgttcactgctgttatgtcaagtctctgcttttgtggaggaatttgcctcatgtgtacgttgctttgcttttcaagcactccagactggctccaggtgtagaaaatgccatgttcttcaacatgcatgctttcatccagcaaatatactgaggcccttctaagtgtcaggagttggctgcccttctttcagaagacatggagggttcttgatgggatctgaaggacccttggacttcttagtgccacttcagacttgaggcacccgcctctgcctgtgctgttggaaactgctgccaagtcagcctgacccttctgagatcctggagaagttatggagaatacgtgaacagcgtccccacctgtgttattctccaacctgtgctctgtggttggacagtttgtaaccgaggtggtccagagttgtttggttaattgaaagaaaggaaggaagaaggtgggagacagagggaaggaaggaggggaccctggcatagattggctggacttcctaggtcctgaaatgcagcggagcggagtcccctcagaaattaactccaaaggccacccactgacccgctgcacacagccagaactcgcccccagagccttgtctagtggtggccaaggccatccaccaccaccttccggtcactgcctgctttcgatcctcgcggagagcgcttcctctctcctgacattctcctcctcttcgctcctctggatccctcctccttctttagtccctcctcctcccgcccagcctcccccagtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaaggtaagggcgtgtcccaccggcccgcgccccctgcgagctagctcgcccagtcccaacctccgctcgggactctaagtccccagccgcccgctcctcctcttctggctcccaaaggcggccgggaccataggaggaactggacggagtctggaatgggcgagactggggccgccgaaggaagggagactgggctaggagcagaggggctgccagggcagcgtgggagccgcggctgtgcgctccggggctcttgactgctgccaacttagttgcctcactttcctgcgctcagtaggcgttcggagcagaaacgtggtgcgggacagcgcgggacgccgggcattggcgcacgtgcgcccagtactgtcagggagagcggagggaccccggatcctcaagcgggtcgggtgtgtcccacccgctcagtgtgagagttgagggactggagtgcgaaccaacgcgcccctggtcaaggtcggaacctctgagacgcgcggtttcctgagcgcggtttccctcaactcctctcttctccagcagggtactctcaggacctggtagcctgagtcccaatgtagcttgcagatttctggcttgccctttcgcgggtgtgtagttgcagcaatgacctggaagtgtggagatctctctgtcactaaccacctaggacttctgggaagagatggtgttagtggtcatttgcttcttcactaggaaaaaaaaaaggagggcgtgggggtggcgggtggggtgggtcgattccgcctcttaggcatagagcatgccagagacttgccaggctaggtgcactggttggggaccaaggctccatgccagattggagctagcgttgcggggtggctacttcccctgggatccctgaatttgccctttcccagaagcttgggctgctgcagcatcacttgcctttgcaatggatggctgacctccttgtgacagctgggcccttgggtgtagtgcacccttggtgtttcaaaatgaggccggtagcaaactttcttacttgttagctgagacgttccctcttgggtttctttttcttttctttccttccacacccctccccccccccaggtgattgatatttggccaactaaaatataacccctaattaaaaagaaacattgatgtccatggatcacacatgccaactgtccagacggaacatgaacaagtctggcttcatgactatccgaccataaacccacttgacacgagaaacatgcctcggaaggtttaattgcacaatttcaaaatccagccgctcgggttccaggagtcaggtctgcacttgctgttgatgtcatccgcatccaagttggacttgggggttggtgctccgtgcacttttgttggagggggtgtaaggctcagtttcccaaacttaactacacaatgaaatcatttgggtttaaaaatcaacaagcaaaacaaactacacccctcctccgttgtttagctaccactccatacactcagatttcgcgggtcgatcttgagaattagaatttttcaaaactcttgtagcatttgatttgagactcgctagcataaatgaaaaattgataacatctaaaggaagactaccacgacggttctaacgagcaggagtctgggaaatcttgcagtacaggaaatagcagggataaagtcggtaaacgagggcttgcttttttcacagatgggatggagcactgtggagcttttctcctaccttccttagctgaagggctccaggccccatcggtcagttgcctggcatctgtgcctacccataggactccctcccctagttttcagtttcccttagagcccctgtagaacaccagttgtctcagcttaactctgtgtttcttcgctgttaggtgttactgttatgaacactgttagtggttggagatttgttttcggttaaataaaaatgccacttcatctgtctgtttgtatgatattcacttaaagccaaatgcttctgggtgtagcaggaaaggtagcaagcaaatatttatctgtcaaagtaacgtaaaaaggctaagttctaaaggacagattattgaaaacgtgagacaccctttctgcaacaggctgataaaagatttgtttgtttaattggtcagttttgttccagactggctcccttagttgaggtagggtgtttatccttccctccaaatctatggtaccatatgtaaatgtcatcaaagcagaagacagttagactctgttttcagtgcattgtcagtcctcacattgcatgtagtgagaggtgattctcatcatctgtttggggaacctatgcacagagaagtgtagtgattttcccccatagctgttaaaaagtgatgccaaaattgattcaagttccttccacctccaaactacactaccttattgtaggaggaccaggctaggttaggtgtgtaaatgactcagttctgatgctagaaggataaggaccaggaaacaggcatttgaaaaatcagtccccatctgaagcttgcttgtttagtggcctactttcctgttcatggatgctgtggtctcctgggttgcctttgatgggggcaatgttgtcactaaaacaaaatatgggcaaggtattagcttggacttgctgagcaagttccacctgtaccatgatggcaggagaaggcgcttctttggaaaagatcctgtgcagagcaaatgaggagagaagggaccctcagcctgaataaggcagtggagtttggaggtggaaccaacttgaaggggattccaaaggcttctcaagactgtctgtctgtctgtctgtctgtctgtctgtctgtctctcagaagactgggtcttgggaagcccagtactggctttctatccaagaagcttatgttttcattccaggtctagattagatggaaagtcccactggaactccaggcttctgaagtctcctttctagattcagtaaatgtttattgcttgtctaagatgtggcagacattatgagtttaaagggggatcttaatgattatattattgcttccaaacatatgtagttcttgaaaccactagttaaacattggtaatctgcttttcaaatatgtaaaacagactagtactccgactgactttcttacggtgcacattcccagtggtaggacatgatgttatctgaagtcaggtggtgacaccaatagactcaacagcttccgttggctttatttacttagcctcataagtcataacttttctaaaaggaaaaaaaggtgctggatttgatatcttaatctctgaaggctctatcactaccaaaatgtctggtccttttgacgggctatctgtgaaacgtgtatgctaagaatggctttcaatcttagcagttcaagcagcttgctttaaaagctatatgggaattatcacagggggcccttctttcatgtttacacttctgggtgatttctttccaacagacctagattccaagtacccttttctaactctgttcaacttttcatcaacaaaaggctaaacttaaagttttggaacattttttttttatccctaaatatctctgcaatttcattgttactgaggagtccccacacataagctgctttatataattatgtaagttaatcactattgtttgccttttgaatataaggccaggcattgaactatttttttatccttttctttgtatttgagccatgatgcataatttgtgccatgctgtctatgttttgagatatgagaatgagttggtcttgatacctcccttgaagtgtctaaaagttatttattagaagacctagtgaaagatcataagacagagtcatagaagaaatggaagatctgcatgggaaagggatactttataagacagagttttgcttttaattctacctgaggaagagacaaagaaaatccccaaatggaaaaatcatttgggaaaaagagactactggttacagaagtggcatcgagagtcaagatctggaaagcacactaatgccctactaaggtcaagtcaataggaagagagagaatgttctatacagttccagatgaactccattaatcacagcacaattttggatcttctacatgaaaagacttattggagaacttaaagaactgccaggaagtggctgctggttactatctccaggaaacctgaagcctggattgttgggtatcagtggaaatagggagatggatgaccgttacaggtgacatgaagcgagattaaggaggatgcaggacaagggactggcagactgatctggaggcatatctgacaaggatgccttgtagggaacaagtagggaaagctacgaatgccagctcaagacagaaacttccaacctgaaagtcttggtagacactgagtccatgtgcagggctggaaagttggaaaataacagagaacagaagctgagtatgaactcaatgtttagatgcattgagtgtcaagtattgagacaggaacatttatgggacagcagactttaaaacaacaaggcctaccatcactttcttagatatttctatttctgttaatgtcattggctatagaagcattatccccatgacaacctcccgtcagatgctcactctcacaccagtgttaaacctgtcaggaccatggatttactccttctttatatactaacagagacgtatttctagttatcgatctttttagttgtagttcaggaactcatgtgtaatagttaggcatgttgcaaaccataatgcttataattgctgcacagcctccaaggcagatccccacttcttaagtcatcatcaaaccggtactctgtacagtaaaaatcaaatgaaaagccttctaagcggttcccaagcaaggcagaatatgaaaacagccatctctacaagcccatctcttggtgtggacacagcagaggaatgagagaatggtacttgctccctctcagaggacttaaacgtattggctgagctgggggagccatgtgtgcacaacaccctgcagggcatggttaacagcagatgtgatttgagatttctattaaagcacacaaaggagaagacctaattctccccacatgataggggcagtttctcaaaaagagatagttgcactgagtctccacaagatgttggctggtctcaaacaaaacaaaaagaatgtggaaactctgggcagcaccacccagcaatgtgcctttcctggccatctgtaaccctgaagtcctttgtagtgaatgcaaacaatttattctgtcttgcatggtttacttaaagcactttaaagaaaattattacttcaaaaataaagtgcattgactgtgaagtgacacgatttgaatataagtgttattatttaaaaagtaacgagaaaatatgaagaattaactagaatctctaaactgtaattgggagattttaaagtgtcccacacaataacattctccctctaaaccttgctatgggtgagtaaaatgataattttgcatgctttatgaatctcccactactgaaatcaaaggattcgatgtctccttaatcgtagccacattaaatatgtattgaatcatcatgagccccccacacatctcccacattgagccattgccactgtgaattgtaagatgcatttggtgtacatattcacctgtgtgtttgcgtagatcatggaacaaacaggtagattcataaagaataaggaaagcatggctactggctactgcctgggcacctatgcctgtgtgtgacttagggatctctgcaggtgacctgggagagtttgaaaatcgactttattttggaagtagaaatatgataccagacaattttaccgttaacatgagtgtgtgtgcattgactggctgacatcatgactgcgttagcagctgtgctcctggtgtagtgttgttaagactactgccaatgctctgtccccgtcgtccactttgagataaaacggatgcgttgtgaagatctctgagaacgaagataaatgagatttctactgaatggtgtggttctctgccttttgccataacttttcactattttagtgtcatgaatataggactctatgtatacacacacgtgcatgcaataccaattaattaaaaaaaaatagaggccctgactctgaaaaagagaggggaaaggtaagtgtgcaggcttggagaaaagaagggaagggagcaatgttgcaattattgtataagcctagcaataaaaaaaaactgaaataaaataatttgttgaatttgtgtaaatccttaaggccaggagtctctgaatatttgatgtcactgaaagatttcaaaagtttttttttttcttaaacatttcagatgtcacaacctggttctatttatttaaaggaaaatagaaaatgcttaaaagctgtggggaaatttaacttacgatcacacttaactttccctacttacacatgcgttgcctgatttagtcccacaccatattacccactgaatatgctgaaaattcagctgagcacactcatttacacaaaccaccactttaagtgtggtctggtagtaacttgtaaagcctaatgactgagctatatttttctttctaaagtgtattttagtgtagcattagagagacaagcaatgattctcttacatactttcctggagcgcatgtgtgcgtgcgtgtctgagtgtgtctgccgctgctgccttagtgtggagatcagaagacaatgtgtgggaatcggttttctccttccactgtatggatcctgaagatcaaactcagtatttcaggcttaatagttatcactgttatcctctgagccatcttgctggcccaaattttacttgagaaattagaagcttgattaatttttttttaacacgttaggtcatagcttctgtcagcttgacaggatcaaaaatacttgcaagaaaaataggggccaaagtaccctggttcagctgttgggacagtcattgatgtccatggcaacacgtggccactcagcagctgggtctatggcggtcattgggtcacttctaaaatttaaaggaaagcacacagttaaactcagtagaaattgaaatagctattctcaaacaagacaacaaattgtatacacacacacacacacacacacacacacacacacacacaccagggatggcttgttctctatataatatccagtatttaaactattccatctggagtgagacttaagacccttgactttttaaatttttaaaaatatatttttctttattcacttttcatgccctctcctgatcaccccctccaacagtccttctctcatctccctccccttcttctctgagagggtgggaccccactcgcaccaacccccagtgtctgcctaccctggcacttcaagtctctataaggctagacatgagcatggacttttaaggagaaattgttatatacaacaaattattcactcagaggaactttgttggttgaatgaatggaatgtggaatgtgacctgagtagctcactcttggatggtgaggtacctttcccttaagaaatgtctaagcgcaatgttattttccttcactgagaaggaagtaacactttgtcactgccgagtcttcacagcggaaacttttcagggctcgggctgaaattcctgcaaagcaagttcatgtatcctgactctcatgtgaaatagaggaaagtcccggatgtcagtggagcaatagatctgtggttattgtcctacattgtcagtttcaacgatgacactgagaaggcagatgactgatttttcaaccaaaggagatgatgaacattgccataaaccaaagcgttcaatgagcagcctgttaggttgttggttgcagggtagctttagtaattagaccttgaaggtgttgcaagttacctgtccaaatgtgtgctgagttttcttgagtcaacagaagtttgcagagcaaggccagaacagaaggccgagcaacttggagaagaagaatcagcggtcagtgagagttatttgggggtttgcctcaattttaccctttcgaagacaaacctagtgatatacctggcttgggtgagaggtggttgagagagaaaagtcccaggtggctgatcatctgagctcagcctttcctcgtggcataatattgttcttaagcctattgcttttgaaaaagccaattttagttttgttgggtaaaaggtatggcaaaagcctccaaatattcgtatggttgctcagctgcagaaatataagactgtgtaaggagggcagtattgtttaaactcacacattcaacacctggtgcatgctaaagcaagcagtgacagtggggtacaaggaaaggtgacctgctaattgcatgctctttctcttgcaaattttggagttttgtgtatgttttttgtttgtttgtttgtttcttgaaaacatatgtgagtgctgatctcatggcacttacatatcacactcacaggaagttctactcatccagagaaggcccccagatcagttaagagtaccctcaaacagaacagataatatttaattaacacccagacgtttggacaaaagacgtcaagcatgccaccttagtggcgtcattcttagcagacagggagaacaattaaatcattaagtcagtgtctgcctgaggaagcaggttggcatagctgtgtacagatgcaatgggtctctaaggtttcttccactgagtttcatctgcacagacttctgggctgtcttgtataattagcagagtcttgacatgctcctgattgcgtctaacaagtggaacaaataggaatcatgacacaaatatacaacacacactgcaatccaggctaagtggccatttgtgcacatgacagacaaagctggctttgcacttttgtgcagactctagctatctaatgctctgttactataattactattattactttacagcaaatgtgtctgatcatctgctggttacagatgcccgctggggtccccagaactgtttttctcacagaacctgtatctgtttctatatgctcggattctaaaatagaacgtttttttgtcatttactgatgagggaaaaaaacagccaggtgtttctttgtagaataggggtactggacacacatattcagccaggaatgtactacaatttgtgggataaagggactcaccatgtcagaggtcaaaagaaaccacttgtgcagagttcagacttcttagacagatgcttgaaaacttccattgattctaaatttgtttcgaaatgaccatgtctataaatatttttttttcaaaattgcaatagtctagggaatacattaggcaagccatcctaagagtggtcctactagccttgatgggtattttctttttattccagaaaaaaacaaagataccttactatctcaagcacctatggaatgataaatctttgtaagcatgaatagcgaaatgcacacatggaagtaaactatgaatatccctatacaatgcttgtaccaaaatatgctgtctatgatttggcttttggggggcagaaacctcttaataagaatcacttgttatgaactaaccagtacccccagagctccttgaaactaacccaccaatcaaggaaaacacatggtggaacttgtggctctacctgtatatgtagtagaggatggcctagttggtcatcaatgggaggagaagccctaggtcctgtgaaggttctatgccccagaataggggaatgccaggactgggaatgggagtgggtgagttggggagcaggggtagaggggaagggatagaggagtttcggtggggaaactaggaaaggggataaaatttgaaatgtaaataaagaaaatatctaataaaaatattttttaaaaattgaaaaataaaagaatcatttgttaatcttcattttccagatggacagaaaagtttcttagagtaacaggtgggagtgactctggtgccacagtagagtctccatgtgcaggaagatcttggcccaggtgataagcatgcatgggtctccacatactcagcttgtataatacaatactcacaagagaatggatgaatgttttgttcttggaaaaagcacttttcatgtgttctttactcttactgtatgaagtcctggactaattctaggaccctcaggcttcattttggctattttgtgatcctgcacagtgtcactgtcctgacccaaagctacccaactgggaaaggcagccctagattgctcagcagctctgtgctctgtcccagatgactgccctatggttaaatccacagagtaaccctcagtgtgagacctgaacaggagacaggttcaactccactcccttcagccctgtggtttacagcctttggttcttcatggatccctcaaccatctcagcctcacacagagggaagccaacaagtgttgcctgagtgcttggcatatacagcaccaatctactttcctcaagagacccaagaaaagacttcgattcctctctccagcactatgtaatctagtcttacatggtggctcaggtcatgcttagtgtatttatggccactttggtctattttccatcagtatagctgatagctgaggtaattagcttctaaggagaaaagatttgtttggacagaaagtgtggaggttccagcatataatcagttatctctgttgctttgatctcctggtgagacagcgcatcccggtgtgaagcacaggagcgagcaaagctgctgctcatctccagacaaagaagcagaaagccaaaggaagacactgggaccttaccgtctcctttgaaattccatttccagttacctaaaaactggtccgctaggctccacctcttaaaagatcctccatctcccaacagttgcacttctgaagatggtaaccaagaacacacacacctttgaggccattcagcactgaagatggagggtttggagtcactccctactcatccccacagaaagccgcttatatctgtggctactcacaaacttaactaggtttcctgtctcgttaactcattcacaacgaaaaaggttgtaaatgttacatacacccacatagcatatagatttagggtgatagagatgaggcagaggttaagagcactgattgctttcataacaggactaggagtcaattctcagctctcacaaggaggtgtgaacactcatatcctatgtaagtccagaaccagggaatctgatgcccacttccggcctcagtgggcaccagacacacatgtggtatacagactagggctggattaaggtatggcagaggcttcttttctaccagcaccatataatgttacttttaaaggttacttttaacagctcacgcactttgctggtggtgcagctgctgtacactgtgtaaggctttgttagatatgtggtttacagatccaaggacgggtagtttaacctttatactggttgttctccactgtctgtgagtgtggaaaggggaggttaaacctttgaaggctttattagattgggagatgtctataccacaaaggggagtgcaattaagctttgcatgctggtttgaaaccttttcccagtgttaaattcatggtaaacattttacttttgaagttttagaaagggaaaagaaaggtatgattaggaagggggaacttggtggtaacaaacccactctcggtcaggtttgtaagctttaagttgatcacttcccagtcacattttgcttgaatttaatatttgatcttattttctagattagtatttttatttgttttaaggtttatttgtttttattttatgtgtattggtgttttgcctgaatgtatgtatttgcaccacatgagtgcagtgttgagagaggccaggcaagggtgttggatctcctaggactagagttaacagagttgtaagcctccatgtggatactgggaatcaaacctatcttctctggaaaagctgttattactcttaagcttggaatcatcccaaaagtgcccttgaattttttattttaatggagaaattaagacttcagctgttgttggttttagaaattgttctgaaaacaataaagatgaatttatatgactatgaatcatagtttgttgtgataacaatacttctgctggctgttttatttggcttgtttgaaatagggtaccattattatgtccaactggtcttgaacttgcgagttcctgcctcagtttcctgaatgttgaaattctagacattttgtttttaaggaatgacagatttctaggagcttgtaaaagctcttccaggagattcaatactgtcttctgtactcctcctcctgccccccatggcgcactatcttagcagaaaatttatgcatctttatgtccatgtctctgcctgttgctaacccaggccaggagtttgctgttttaattggctggagatgtaatggcacagagacctcgtctttcacaatactatatggaaattttgtaaggaaaagtttctggtctgcaatatttcaaagccatggagtcttgacaagaggtgtggagaggaattagggcaggcagacagagagatggtggtggtggggggctggtgaactaaacaaaccctgtagtctctgtgttgacttacatgtgctgagtttatgttctcttcaagtcacaagggaaccatctacgcctcctgcacaaggcacatggggacctcgtgccagtctactcctcctgtgcttcttgattggtttgtgtccttacttcaggtataagtgtgctacacgaggttcattggaaagctggggatgtcgtgtgtcttgatgtaggtgctgtatacacagatatatgaatttactgaaacattcccgaaaacatttctaaaacacactttgatgtgggttcatttttatatggacattacactgtaaacaaattttaagactgtctatgatgcccctatagacacaatcacctgatgcacaagacagacacagggcagacagtgtgatgattcaacatggaaagctagctattttgcaagcctagaaacctgagttcaacaacttgaaccgtgcaaaggtagaagagaaccagctatacaaagttgtccttagacctccacacacatgtcatgacacacgtaccctacactatacataaaaaagaaaggttattgggcaagtcaaatgttgtcagaaagcccataatctcatataaagtattggacatcagagacaaagcaatgcccctgctctttctttaaggataaagatgtacaagacctctttaactccttgcattgttactgtaatttacacttagctcatttcaaattacacacagctagaacacgaagtagcagcaaaataacagcctgtgtgtaaattccaccaccggaagctttgtattttcacagacacacagcaactacagaaactctgcaaagcaagtatcctcttgtaaggacccacagctccactccttgccagttcccatccaacctcagcccccatatgcagagaaaccatatacagatagatatgtggatatgagcttgaacatcagcactgtgaggcaagaaagcacacaagtcacagagtaaagccacagcacactgtcgatcctgggtagcttcctgagcctctgtgccagcccagcctcctaagccctgattcccacacccattgcagcgtgcaaccatacagtatgttgctttactcgcagggatactttacagtaataaattttggaagaaccttttatgtacatttcatttttcaggatagttgactgaactagtatgcatcaaattcttcctgcatactgctatacttttaactatggattgcataagaagtataatctctgttcttaaataccctaaaatccagacttcattcattacattccatttctgaaagtgaaacttaaatccattgaggtttgagaatgcctcggcacagaggatagggagagctgtaaaaggcctggctgcatttgcgtaatgtgtgcacaaatgttgcccatacctccgctctgtctgcgctctacagagcagctcagagttctcacacaacacggcctgtgccacactttgtcttatttgaataatcatgagagcacagccttatttccctctgtgattgcttgataaaggcaacacagtaggcaagcttcaagtttctatgtttggatagaaccaaatcagtgcgaaaaatctgtgtgctctgttgacatcaacattgtttactgtaagcttaatagttgcaaggtctacaatttcaattacagttgagtgtcctttatctgaattgctaagaaggaaagcattttgattttggagcttttcagaggtgagattttttttttctttttttctgagactttaccagtcgaacaagtggaaaacaaaaacaaaaacaaaacaaaagtcccaattctaaaataccttgaaatctaaaaccttaggaacagcatgttagaactcaaaactttttggatcattttcaacttgggatggatattcaagcatcttattgttactataatttacatttacagtaaagctggtctttattgtcaaagcagctcatctcagatttttatcacagcaggggaaaagagaaaatagagagaagaaaacctgtgtggtctttcctgggaggttgtgtccactttgagtgctaattttaaggtggggtaattgtacatagtgatgggccgatgacacatggaggcaacagagagccagtatgacaccttgtatttccccggctctctgaaccctcaacacttcctatatggatacagttcattgctcaacactacgagctctttctctgtgtaactcttagaaggtttgattccagaagtctggaaaaaggttggagactagggaggtataagttgattttgaaagcaagcgactgtggacaaaaatgtgggaaggaaaatctagaaccaagcccattatcagggggtacccacaggaaatctttaaatcattggctgatttgggaggaaagaaaacggtacccttcttgtttgtgtgtgtgtgtgtgtgtgtgtgtgtgtgtgtttgtttgtttgtttgtatgtacccctggacataaagtgagagactttccttttaagacatactctccatccttgttgtctttctatctatctgtctgagatcatggggcaaggtgtgtaaaaccctgagccaaaataagcctttctcttagtaagatgatcatctttgatattcgttatagcagtaaaagctgacggacacatccataaactatgatcggaaattgtttctaagctattggagaaaaagtatcagtcgggagagaaatggggtcttcttggagcatcctctgggccctcatacttctccttgttgaaagaactgaataagctgtgctcctgcccctcgcacactcttgtcttcactcctacatgatggtgaagtataaattccgagttccctacactctcagtactgtgtacattataccctcttcaaggaaggagcattgcacattggcatgttttgtgcagggttctctgggtttactacaggaagcatagaggtcagataacttcctcctcccacttccaggaaatgtaaaaagtgggttatgcctctgtgtgctaaactgcttacagattctcaaagaatgagggtacacatgtgctatgcttcttcaaagcagtactgagccttccacccacagcaccagttcagagataattaataagaaaaaggtggagttgcaaggcatgcaactgtgtaattcctctgaagtttattttttccccatgaaaaataaatttcagcaaatatgaagcaggtgcatcagatctttgcatgttgcttctttctttactaccattttaaatctggtctcaaatattacaatgtactctacagcctcccttcttactttggatcagtggtttactgaaaaacaaaaatactgtttgtttttcagcatcaacttaaattttctggggtgaagtactctgttttaacggcagcatgtattttcacagaaaaatctcttatcatgaaatagggtcttgtgtacggggctcgaggaagttttaacctttgtgtagactttatattgttaaggaagtatgaggttttattggaacatttagaatttagaattctactctaaatttcaaaaatgtttctcgtgtgaacacatttacattacacatttatcatgaacggtaagagtcaggaatgtggtgttcgctcagcaatgacaatggcaggtgctattttctttccatctggttggcgtatctttaatatctctttcaactgaaatggtccctttctttcacagttaccacatccaatgtcttaccgccacatgaggactaaaaatgtaatgaaggacttgattggtgaatcaggaatagaacactttaggaatatggaggcctggttcagtacttaccagctaggtacattctctttcccatccccaccctggaagatatttagtaatatctgaagaaagtatttgaagtcacactgagccctgtaactagcatctgtatcacagaggccaaggatgctgatgaacattctttaatgggttggggaagcatccctgccaggaatggctggagcttgaaatgtcagtcttggggatgtttacctactcattgctaagccaggcatacccaacagctcatgcttacccaccttctgtaacttaatgatcgagtaggactttgtgctccatgcctgctgctccgaagctcatcattgccttgctgggttctgcatgggtccagaagtccccagtcagcccatagcttggcattcctgttcagctgcactccggccaacattccacctccacctgcaccggcttgttccacctgaaagcttaccaagtgaaagcaggagccatgtgaggacaccttaattatacccacccagaaacttgcttacagagagccagtagggctccaatgttagagattagctcttgcactgctgaaatgaaaagaaaaaaaaacccacaaattaagtgtaaaacatgtgcttttcttcttcctgttatttgccccctcctttctgtctattcaagggcactactgggtaacaaaatcttccagagtaccaatctctcagagctggaggagggtagggtggagtggggaggggtaaaccagctggattgaggccagcttttccacacacacagagggcagctgctctgttctgaaattggtagccgcctgcccaagagtgaaagtagatttggtgttacacaagtgaacagtgccttgcctctgtctgcttcacagcactttaaaacaatgttgtttatgtgcatggcctagaaaaagaaaggaaagttttctaccaggcaaacgtcactccagacatgggtgggggcaggctgacccaacggctttctggacagtcaccctgcctttggctgtgtgtggagaggttaccagagtcctggaagacagctgcatacctcttaggtgttctcttagtgtttgagcagaacaggtgaccaaaggtcctggttgaatcagaagccaccttgaacaaacaaatctgactctgagcatgacttcagcaacacttgcccctgcactccactgctcacatgcatcatgaagcactacaatttcctgacatcaggctgtatatgctgataacagtggctggtgagcagtaggtgcccaggaaatatttgtgggatgagtgggtaagttcataaaaagatgagattcttatccagctttctcatttaatggtggtccatggagggtttggaactgctgaagagaaaaggctggccactgatttacttggcaccataagctgtgcacctcatacagacgtgctgaccatctagaaggagcatacagacatactcaccatccagaaggagcatacagacattcttaccatctaaaaggaatatatatattctgaccatctacaaggaccatacagacatactcacatctagaaagagcatacagacattctgaccatctagaaagaacatgcagatgagctgcacagctggcatggcattctgtgtagttctgtagccagcttaaaaaacactgtgtgtattgtatgtctgtgtacacgaatgtgtgtgttggagagtacatacttaaatgcttctggaagatcagggtctcactgaacccataactcaatgattgatgtaagttccaggcatttgctttttcttgccttcttatctccagaaagaattatagcccctaaaatgtgtaccctaggctgccctcaaactcacaatctttctgcgtctgcctcgtcagcttttcctatcagctctcactaccacaatcagctgtggccagtttctttagagcccttccaggattgcttatgttttaagtatcacaaaaattacatcatccccaggctggaaaatggcaactatcagtaagtcacggcgttagagttcccaacagaaatgctagtttgaaaaatcaggggcttgagaaatagctctgccaggaaagttcttgccacacaagcatgaggacctgagttcattccagagcattcatgtaaaaagccaaaagtagctcctgctggaatcccactgctgagatggcaaaattggacaggtccctggggctcgctgatcagcacgccttgtctatgtggtggtttccaaggctcagagagaaactatctcaaaaaacaagctgggcttttcttgcagaataacatcccaaactgacctctgatctccacatgcacatatgtgtatgcacactaacacatccatgcttacacatgtacatagagcatacatacaacaaaataaagactttacaatgtttgacatcacaaagactatttgcttgccatgtttattagtattgctctaactatatatttaattgactgttcctctaaatgcattaataagtcttagccaccaaactaaaaatattcttaattaggtacattttaaccagtttcaatatgactgtctcactaaatatctgactagacttctcttgagcttgtacatgcttttctcaagaccttggttttattacctgtaaagagaattatgttcacctgtgataactgtgtgccttccacctctaatgatagataggtgatagtgggctaaaaggaagttgttagattttgttgacagctggttcatggaatctcagtgtgcagcacagtttaatggttgtgtcttctgtcagggacacttagacgttcttgtgccacagtttcacctgtcaaatcccagtataaccatagttcaggcctaggggattcctgaaggttctacagagagggccagtcatgcaggaagtacttataaacattagctgtttattgttgctgctatgtggtttctgggtcattgaagcctaagatggcaaaggccatgagccatatgtgctggctttggggcatttgaatgtggttagctcaaattaatttgtgctataagctaaggactgtccgtagttctttctataccagaactcctggcaagcatttgtgaaatgctgctgagttaccggcctagaatagaagtgtaatttttttttttgagacaatgtttcaatacgtagccttggttagcctggaactcactatattcatcaggctagcttcaaattcagagaaactcttgtacactttctgaatgctaggattaaaaaggtgtggccttgtgcctggcaagaacaatttttgaatttcttacactctctagatgaaaattgtgatgaatatttgggttaataccacaaaataaaatttagcgccatctgcttctttcctacatatttactgttgtggctactaggaagtttcaagctctacacatcatttcccttacatttacattggaacgtaaaatgccaactgcactatagggatatttgtcttgagggttccagaaatacgttgtgtttgtcagacactccatgtcctgtctcctgtgctctcagctcttggtctttaggtctgaatcttttacatgttaagctttatttctatgacagattggcattaatggagggaaaggaatacgtgtataggtcaatacaattttcctttgctttctgacaatctgctcttagcctggggatgtaatagttaatcataattaactgctcaaaatgaactgacctatccttttgacctatgccttttgacactaggattcattctctaggacagcatttggcttgctgcatcttagccagtgattcccagttccgtttcttatgcacaggatgctgttgacagatgttcttgaaaaggaagcagctggcagcctggcgcttgcaaagcacaccactgatatgattagcacacagctcatttctgattccagactccgaaacgggctcaggggaaaggtactcacctactataagccaagccctgggttccatttctagtactaggggatcaaaagattccacatggagcaataaagcagcctatccattgttctttcttcccagcgttacacagaaaggtttttaaacatacccagtagatattcctatctttaccaggacatcatttcagaatctctcaaaagtggatccattcacctgaccagtcttacaggggcaaggcagttaaaatattcctcctgaaatgcttggatgagaatttgtcagttgccgttgttggaagagagtgttcataaccatgcttctttaaagaccttgcagggtttcaggggcagaaaggagagtgtgactgtgaagtcagacttagatgatcagggttgaggcctcaggagctttccccttccttgttaacatatctattggttttgtccttgttcaacctaagacaaagaactacaggtaactaagaaatgctgagagtgggagaaatagtctttcccaaagaagaacacaccaagtttattatccaataccaaaaaatcagcccagaaaacatacatattcaagtaacatccagattgaaaggccatccagagactgccccacctgggaatccatcccatttacagtcaccaaacccagacactattgtgaatgccaatgaagtgcttgctgacaagagctgtcttcatatagctgtctcctaagaggctctgccagagcctgacaagtacagaggtggatgatcgcagccaaccattggactgagcatggggtacccaatgaaggagttagagaaaggactgaaggatctgaaggggtctgcagccccataagaagaacaatatcaaccaatcagacacccccagagctcccagggaccaaactaccaaccagagagtacacatggagggacccatggatccagctgcatatgttgcagaggatggtcttgttgggcatcaatgggaggagaggccctaggtcctgtgaaggctcaatgcccctgtggaggggaatgccagggcggggagacaggagtaggtaggtgagtgggaaaaacccctcataaaagcagggggaggggaggtgggatagggggtttcttgggggtggggaaaacaggaaagggaataacatttgaaatgtaaataaagaaaatatccaataaaaatgagaaggttgtatttatgtatttagaaatatttatataatgtatgtatactatatatatgtatataatatatgtatattacatatacatatataaaatactgacaattcctaaacacataatacataaatacatatgtgtatttataatattaaattgcatagatagaatataaaaaacaatttatatccctaaatacatatatacaaccttttcaattaaaatacatgcatgtatgtgtatgaaaggtcttggagggagaaaagggaagggaaaatgatgtaattatattataatcttaaatactgaaagaaataactttcaaaatatcaaaagctgaggatatggcttatcattaaagaatttccctagcatgcattggatcctgtatttgatcaacaacatagcatagtcatccataaaaatataagggcaaaagaatgtagatgatatgtgtgtgtgtgtgtgtatgtgtgtgtgtgtatttggggggggttgtttttgtttttgtttttgttgttttgattttttcaagacagggtttctctgtatagccctggctttcctggaactcactttgtagaccaggctggcctcaaactcagaaatccgcctgcctctgcctcctgagtgctgggattaaaggtgtgcgccaccacacccagcaggtagatgctatatttttaataaagctgcacttacttttagtatattcagtgatattagagaaacactcaaaaccttgctgtggtttctgcattttcctgcataataggatacagctggcccttcctaggcatgtaccaaaaacatgtgaataacacacataaacacacatgcacatagatgcatacacatatacatgcacacacacatacatgaacacatacatgcacatatgcatgcatattcatacacacatacatgcatacaaatgcatacatatgcacatacatacatataaacacacaaacatgtacatgtgcacacacatgcatacacatgtacacatccagttatacagacacatgcatgcatacacaaatgcatacacacatgcatatgcacacacacacacacacacacacacacatatatatatggatacacccaatatacatacacatatgcatacatatatacatacgcgcacatgcattcacacatgaataacacacatgcatatgcatgtaaacacatatatacacacacggatacacctaccatgcatacacacaggcatgtacacatacatgcataaacacatatacacacattcatacatgcaaatatacatgtgcatacatacatgcataacacaaaaaataaaattttaaataattttaagtagaaaaatacattgtatctacatattttgcatgcttttctttttaaaatgttagaattgacaccaaatgaatctatgtgctctgccatttcagtcatggttagaaaataatcaaacaaaagtttccaagaaatgaatagcaaacctttccttgaagatcagaaactcctaaattctgggctttgtctcgtcatttctaccttctcttgtggttattttgtaactgcactgtgtgctcccacactagtgcacgcttactgtgtttaccgtggtcaaagagctgctttaaaaggatattgtgttttgctgttttgttttgtttcataacagagatgaatatcaaagacacactctatgctcctttccggcccctggcttttcaattaataatgttgaagttgaaattaagttatctttttgtttgttttacctcatgccgtgttctgggacaaggtaggcttcttggtgacaggtatatattgtgttctatggaaaagccttgaccagagagatggccctggctgtcctgtggcctctgggtgaccttgcatatcgtcactttccctgggaatgcacgtgcacatcgagtttagtatggcaggaattccatgatatattaaaaggggttttttgtctgtttgctttttaattaacatgctcatgtgagccagtgggtggagtgttcagtggcagctctgtgctgtaccaggttctcactgaggctgtatcttcctggctgtttgaccttggtaatgctaactttaacattaggatacagtatactatttggctgttgggatcatgggctgggttaagcatgcatctcattatggacactaccaccattatgtcacagtctgtggcatgagtggataatgcattcaaagtttaaacacggattaaaagaaatggaaaaactcctaagacatgttcttcctttgaatgactaagaatttaaacagcttagaatgttggtggttgtaaaagcctgatagatcccatctagcttaattctcactaagaatagcctcgtggagaagctgcactttagcaaatggaaacacagatgctttgaagtccctaagcctattcttaaataatatttccactcctccttaaaaatcggtagaagtgctccataccatcactatgcatcctcaacagcaggaagttctccacattgccaaggcaatggaaagttccagagatccttatacacattagtgcaagaatgagttccacccacaatgtcagtgattacatcccgtccatacactgactgaaggaacaatgatcatggatttttccatgaagagctcattctacaaaacttcccataggaagtacaaaaagagaatttgagagtaaccagaaaggtgagattctcttcttctagagtatctccttaacaaaccaccccattcttcattatttaagcagaaatgcaagtctaggagtcttagctgtcctttcctttcttctgtgccttgcagtcgttggctttttcatggggaatgcttgcttatatcagccgttaagcatctacataacatgaaatgtgatacttcagtaattcattttgacaggtggagattaggtgttctctattcaggggcctccactttcattttccctgacttagctctcagccagaatccttctgtgagcagcaatactgtggaggcttctggcccagcccagctaagcaataggcccacagaggactgatacattatttatagagtggcaagttcaaggaaaatctggactatgtatctacagggtgggaggagcagatgtcccttccttacacattgcatattaaatatgttccctaagaatagctccagaagtcaaggggtcaaggacaccacaaaaagacctacagagccaattaacctgggcccatgggggctcacaaaggctgaaccactaaccaaagagcatccattggcgggacctaggcttcctacacatatgaagcaaatgtacagcttggtctttatgtgggatccccatcaactgcagattagatgttcctcattcagggacagccactttcacttttcctgcctgtctctgattctgttgcttggctttgaatccctttcccctacttggcctgcattctctggcctcagtgggagaagatgcccttagtcctgatgcaacttgatatgccagggcgggttgatacaagcgcagggtgtctcctttttgaggagaaggggaaaggggaggtgaaaagggaaaagagggaatggaaggatgggactgggagtagaggagggagggggtctacgatagggatgtaaagtgattatataaattaatgaatgaaaaaagaatagctccagatatagaatctggtcatcaattttactgagacttcacatccacccccacattgactttcaaactcttcaagaacctttcccacatccctccttcagatgggggtctctcattagcaaacccctctccttggcacttctctccttttaaattcatttttattatttaaaacacacagaacatgaaattttgtggcgtgaagtctattcacactgctgtgaggtcatcaccaccattgcagtctggaggccttactatatcagactgaacctgatgcccttcatcagtagccatcacagtgttctctacctctgtgactgcaacctccctagacctgatacatagtactacccaataacttgttctgttttgctttttggtgactgtatcacttagcataacattctcaagttttatctgggttgtagtctttgtcagaatttccttcagtttttcctacattttgtttgttctctcatctctccatcctcaattttcttctgttttttgactgctgccctattgccatagcacatgggcagagctttcttctttaaaacctgaatctaagccgtcttagcctcaaccccgaatagcttccccatacctgtgggttaaacctgtttttgctctctttcgatccagccaggcctcctatcttcccctcagatgctatttttcttgctcactgtccacagccaggcctggcacttccatagctcgtttgctgctatttgttaacatgaggattcagtctccctgtctggcagactgtatgtactctctcattcacaagcaaaatctcttctcaaacaaaacaaaacaaaacaaaacaaaacaaaacaaacaaacaaacaaaaaaacccatagagaacaagccaacagaatcaggacttaagatatgggtctcttcccaggcagaatcatacatcagccttctgggctatcacaggagctcctagccactaccatgaggctgaaagggtggaggagctgtcctgcagaagcaggaggctagagcttgcacatatcttgactcctcttgttactgttcccccttcacctgagcagtgcagttctctgtgattgccgacacagtcatagatggcagaagaaaacagaaacatgacttgatttgtagctctgtatgtaagtctctagaaggaattcccatcaaacatattatagtcatgattttggagaaaatattgttattgtagctcactgattcttagaggaatatttgcttttcttggttggggagaaatgcaatcgactgcacattctttgggcagactgttttaattattaccagtttcatgtgtgttttgctgatttcaggaaaatccttgtggctccgtgatatgcttcaatgtcacagcttcatatttggataaataagacctcacagtatgatttctgagcaagtgactgggaaacatacttaaccactggaaagcaacagtatatcttgagaaaaaagacaaagtatacatctgaaataactgtttgccaaatcagctgtgggcacacaaagggcaatgattggtctattgccattttaccctttggagtcttctggggcaaattacggtcattctgtaccttgggagtcttcagcttccatgtttttcacctttgactgtcatgacttctgttctcgggattttcataaatggattatagaacaatgcccatgtcataggccctctaaactgaccctgacttctcagaaacaaaactgctgtcttgggtacggagcagagagtagggtagggtggaagcacagagcataggacccaaaccaatggtcccgcatagtgggagcctcaaggacccccctagaacttgcccttttctgatagacctgagagtttggggccttagccagggccaaaaaacaaaaggttgcaattaaaatgtgaacattgcaaagctgagcactattggtagccaggccagttcctgtctttcatctttctggtagggctttcctgggaggaaatttgattctcagcctcctttggagacactggactagttctgataaactaaagtgctttctttcctatacaacttcctacccactcttctcctctctcttcatctttttctcctctgatctgctttacaatgtattattagagttgcttttgggtttttgtttttgggtgtttgtggtgtttttctgttgtgaggttttgtggttttgttttgtttgtttgtttgtttttgtttttgtttttgtttctgtttctgtttctgtttctgtttctgtttctgtttttgtttttgtttttgtttttgttttgagacaagatctcactatggagccctggctggcctggaacttagagattcacctgtttctgattttcaagtgctagaattaaagatgtgaacacctacgccgcttgcccaaaaacatgtgagcccagccacaatgaactgattctggctgaagctgtctaacctggttcttgtaggggttgggaggagtcctgaaatttcattccctccgtccctactgattttcttgccttctctctccctgcacacgagctcttgccctatgcatattgacagttgtggatcatgggagttgccagctgaagtctgcctgcccccacctgcctgttcttgtttgtgagcaccacccccacttcctttctagaaagtggaattgactaagggcttcccattacacctagcactgaggcttcattgcccagatcccctaaccagaatttctctctcaagttctctttgtaaaggtactagtgcttctgtcggccttcaattctcaaccttggagactatgacaggacagactgaaaattagagagaggctaaacaataactttgtattgaaggattagcctttccccagctggacattgatatgcaaaataaacaaagcccagagctctttcttatgcctgtgttcttattatctgtgttcccttcaaaaaactaaatcccctctcatggtgcacacaccatccatttgcctgtcactgactttcatttgcaaaattggtgtgtttagaggaacctaggggctcagggaggaagaatacctttgaagaaaacataggccaagtcttcatcctttaaggaatttttgctggagaacaaaaaaatgttcacgtgctccagtcatctgcctatcactccagaaaaccttactcttgctgcttactctttcaaaactgagggatgcttagagtctgcgaggcatagagtctgcatgctattttctaagcttggacttcaataaagctataccttccaccaatctgcaactcctggcttgtttctgtaaaggcagcagcagctagtaggacctccaagcattgttatcttgtaatacctccagacacaggtaccattaggcaactttcccagagtctcaaatcccagcacttttgttagaatgtgcaatatggaactacatttgcctggaaaataccacctgaggatcggaacactgtcctaggacagcaagaaagttggtgtgtttagacaagagtgctgtgaatgtaaatagtgcagcttctatcaggtcaccagttgctaagcacccattttctcctgactcatctacagggtgagggttttagaaacagacaagtccttcaattgctgctaactggtcagggagcatctggctccaagcaggtgcatgccaatcatctatctggttcctaagagtgaaacagttcttctgacccacagctctgcagcaagtgtgactctaagacttgcttggaaacggaagatcctgccctggaagcagagggcccctcattcacagttagaggctacctgggatctaaggagaaggtgggatccttgctcaggcctctcccatacctgtcctagagcctgctgaacctgtttgcacattttcaagctgcacttgtgcatatgcagcagtctggcagtattctgaggatggccctcgtgttcagggtacaccccagtcacacccaccagagcctttctcctagtgcctgctttcccaactatctcaggcccctccctcagtaaaatgtttttgactcttttctgcctctgttgctcctacttagagcttctcaccagggcagccagggcagtccgcaaagcagcgcttctccacctattctttggaattatactgtaatccttaaaatagttgcaaggtgacccccgaagctgcgaatatgtgagaagtgctttgggatggtacctcatagatacctttgcaaagttccgcaagctataaaaagtaacatagatgcaattcctaacatgctactgccaacttaaaatcttctggttaactacttttattaaattaaaaaccgaacattccataatcagtctacacttgggcgactgcaatgatgactcagtgtgaagcattttctataactgcatacaacacataatatgtacaatggtgcctttgaacctctttctcataagtaaaggccctacttcgaactcatgtccatcttctaacttctcttctcacctttctccctactgttccactaatcccctacctcagacaacagaactaatggaacgtcatagaacttcaccttggacagcttcattcggagtcagttaccttttgctcacctgtgctttctcttctcagtttgctctcccctgtttgaggccagtttctggtgcttcatccactttctctgcttaccagggcacccagagtgagcacgtgtgctgctgggtgaatctgattccccaggcctctgttctcatcgtgtaaaaaatagcctaggcttggcagattccactcatcctgcctagccgagagcttgcactgattcaataattgacggactggataacaattaaaacaaaagacgagttaaagctttgattcttaacaaatgatcacccaaatgaataaaagtatcttcagaaaatagagagatgggctgcaaatagacatctgggcattgtggtggtaaactcagcagttgtggttatgtgcactggtcccgttacagtcagggaaagcagacaggcatggatgggagatcagagaatgtgttgtacacatttatgaaattttgaaaggatgaatctaattaataaagaataaaacaaaagcatcttgttgaaacataatgtttacattgtgaaggctacatctggcaattttggtggcttaggacttttctgggaaacacatgagtatttggggttgtattcagtaggaatatatctatgtttatgaatctgtggtacatgaaaaatcaaggaattctacttttgtgttttagtttcatttctgttgatgttattaaaaataaaaaaagcagcacaggggaggggagagtttatttgattcataattccatgtttatagttcatcacttgaggaagtcaaggcaatggggacttgcccgactagtcacaccacatccacatcaaggcctgaaacaaatgaaggcatacatgttgctcacctgcgtgggctcagctctggtagtccacttttatagagctcaggccctcttacctaggaatggtgctgtctacagtgagctgagttctcctacatcaattaagataattccctacagacatgctcacaagccaacctaatactggcaatccccaacaaaactttcttcacaggtgatgctaagttgtgtccagttgttttaaaactatcgggcatatctggcttattctaaagaaagtaacagtgaacactatctacataatttctaaatatggaatattctgactcacagctaaagatttgtttccactgattatcaagctgttgataggatcaagtattcatgaatctccacagggcccctccgaacagactcattttcccacacaactgaaatgtgactcaatttagcctcatttgtccagtgtgttccaggttcacttactattgaatctagttgcctttaacaactcactgatgaattatatggcttttaaattcgtggagaagtaaaattcaggttcaatgctaggtcaaaattccttgtgtttacttggtctatttgtctctcaatcatcttatggaaacttgtcagattttagtgtggaaataattttcttggaggcaatatttgttgagtgactggtggaatgaaaaacaccaattacataagtgtgaaaagatccaggtgtttggattggatgcaggtcagtatgagccaacaacagaggggtgctgatgttggactcgattaataaaagcacagtgtctcacattcagaaattaatcacatgtccaagtcctgtgctgtttagactgtgtgtggagtacagtttaacttccggtactataattttaaaagtgttaaaggaaccattgtgagctgaagtttgtaaaatggaatatctctctagaggtgaaggggaaagctgtgcagagcagccgaaggcacaaaggccagatgggaggtgataggacagttgccctcacttagcgcagactctgtgatacagagaagaaagtggacttgtactctggctccagagtgaaaagctaagatgaatggtctgaagttcagagggaggcaaattttggatcaacttaagaaagaatgttacaaacagctgaacagacctaactgtggaacgcactgttcagagctgtgactgcgtcgggcttgaagtgtttgagcaaagtcgagatgcagccttaggagcccctttccaaagagaagaatgtggtgttcttaggaatctgagctaaatactcactctagaactacaactaggttcagggacctgaagcagatactttcttagactcttctggtctacagctttgttttcttggcaatttgattaaataaaaaccctacccactatttcagtggagtattgaaatgctaagagtttgggttcttttaaaaaggattggaatgagtttgtcagattccttaataatgccctgtttgacttcactatcaactgacatttcaaatatgtgcaatttcaccagccacctcccatgttttgattgagtcatttatttacatttttaattctccataaaaattatacacacttatagagtacaaggagatgtttttgaaaacatagactagtgggtcacaacctgtgggtcacaacccctttggggtcaaatgactctttcaccagagtcacctaagaccatcagaaaacatagacatttacattatctctaatacctgtagaaaaattacagttatgaagtagcaacaaaaataatcttatggttaggggtcactacaacgtgaggaacaattaaagggttacagcattagggaagctgagagacactgttctcaactatgtataatattcaaatcaaggtacacatgtctatctcctcaaacactgtttctttaaggttggccaagttattttgtttaacattctggcacttgactttctggtataaagtaaaatggagtgagatgtgttaactttcctgttctcagtccaataggtcatgatagatacttgactgcataaggggacttctggggggctgtgagagacctactggggtggaaatgccacacagtggggaaatggaattattatatcttaccatatggcgtgccttcattctcccagagatgtaccaaatgaatattagatatatccaagccaggtaaagtctgtgtggaggtctatctagaaacagacagtaacccatgactctctccatgcatggtcaaacagggagcagacaactcagtggtcttccctttaggtgctaaggacttgttgggtgctgacccattccatgtcacatgaagaaaggctgaaggtgattctaacagatgctaagatgccctctgccaccaagagaacaatttaacccttcttaaagtcagtcactctatcccatgtctcttacctttcataactgtaccattttgtatgcttctagacactgaattgcccgtgaaagtcatgtggtaaattatattaatgtgctctgctttgttcaactattcttgggccagtttgtgtggtttcttggtatttcggccttcagtggcgctttagttttgcaggaaattatatttctcttttgggttctcttcttggggactaattcaaaaagtgaaatttactggtatttttttttaatttcacagaataatgatgatgttttctttcttctttttgccttttaattttacttgtttacatatttggtttttagtgacagagtttctctatgcagctctggctctttgtagatctggatagactctgaactctagagatctgtctctctttgtttcccaccatgccttgcttaatgatagtgttttcaggggcttatattttttcctagagttagaatgaggcaagaattgattgaatcaacattatcttagtatatcttccttcaatctttaggaattcaaacgagttcaaggagtcatgatgtagtaaatatctatctatcggttcgcttgacctcaatcagtttcatatttttttgccttaatttcaggaaatcatcttagtaatttctcgccttgtactctggaagccatagatggttaggagaaggatgggtctctgtcagatagtagaattcacatgattgtcaccagtgaaacgatggaagttccttgtgaaagtgaaggagtagacattgagaacgttggtggctgtgtgtcccagggcgtcaatcttgaatgcattttggtagcacatgaactcgttacgttactcacacatgacttgcttactatgcttatctcttgtctcgaatccatgtcagttatcctaaaggaggtacacacatgtggctcgtgaggacctcatctccatgcacacaaaatagtatgagaaagcaagatgagccattgaatggtttacttagaatttcatgattttatttaatagccgcctaagctggggaagcacacatatcttttgtagatgtggactcttctttttttaatgttaggtatatgttgcaattcagcctttgggacacagatctggggaggctacagggacctgacaaactaggccacccacaataaaggaagctgtccaaggagatcatttttctcttaccgtttcagctgcttccaattagtttccatgtacatagcccagttgtgtcttcatcagtacatttttccctatgtcattgtaaactttaaacgacagaagtcaacactggtttaatctagccctctcctctattagcttcttgcctagcccgtatatttttactttagttaaatgaacacatttcataggattttccatttgtaacacaagcttttctctcccaaaaatgatggtctcagaggatattttatgtcaaaatgaccaggtagagtcggcaggatggaacagtaggtaaaggcatttgtcaccaagggtaacaactcaagtttgatccctgaaacttgtgaatagtgggaggggacaaatgacttcttcacaacgtcctctactctccccatctatggcatggcacacattcccctcccaagagagattaaccaaaaccaaggaagaactgtaagtaacaacacaaaggtaaacatacccctgggatttcattttttatccatgggattttgcaaatgagataaatggaatttagccaaaagatgaaagaagacaaatcagccatcacctactattcctaacttaccagacagagagcaactcaagtaacactgtttttacagcacccaagaatgaatctgctcaagaatcctaagtatctataagtgagtagaattaggctgagggttaaagtaccaagtacctccttatgtactgtgctaaagtacagctagagatacttctacttgcctgagatcacagaatgctggtattagccctccggtgatttgtgaccctagaggaagagtgaaaagttctccagaacttggatctgcaaagtcaagagaaagggaagggtttggagtgagatttggaagcatgaaaagacctcaaggcacgtcagggctttgggaatgtcatgtttgtatttgtacaaaccaaaattagaataacattcaggcatgaaagggctaaacagcagagaagcaagggactcaccttagtacttttaaccctttaattaagatcagagcctttggaacactttgaagaataattaactgctgctcattcaattgcatgacatttttttcccctttcatcatctatcatttgcatggaaaagtatgccctgccttttcaaatataattttgtgtgtttgcttccattgtatctgtgccactggtatcatattgataaggaggcagagacccatacgttactgtactttcccattactaattaacatggaaggggcttgatctggagtcccagctgcctcccttcttgctgcaattctttgaaagatcagaaatcgactggtggaatttttgaaaggctgcttcaagtgagaagccgtgctttcagctccgaattatgctttcagtagggtttgccatacccttgctacacataccagatgaacttgaccaccttcttcgtgcttgtctcacaacatacaccataatgcaggcgatatgtctccattttagtgcttgcagttagcttggagagcagtattgcagtctctttatacagagagaaagcccgggaggaccataaatgtgaagtagtctctcaaccaattcaaaagctgccagttcaagcccagggttgggagtttctcaagcctgtttgctccacaccaccacatggcctttccatttactccacctgagataaaaatcacagtaacagatggaggtcaagttacaaaaaaagtaagagaaatgaagaaatctatgcctggaagcaagaccgtctaacctcattaccctggctccacttttaccgcctgtaatttctgtgtttttctgcctttcagtccattttctctcccaccagtttcctgtttgaatcctcttccctgggaaagcaatttggttctagtcttttattttgcgctggtccatcatttaggtagaaccacatgtgctgatgtgattgaaacgatggagaatattttggacagaggtagagctgtgggagaacgagatgaaaagaccaggtatgggagcagaaatctaatgaaccaaaatgggatgtttcagtgaatgctaaacctacacttaggaaaacagccttgttcccatgagatccccctgaagtattttagcataaacacacaaaagtcacagcttacctagatccagccaccatgtaacctgccagggtgcaaggctcatagaagggacttcggaacccaagagaaaatgcttatctctgtgctggtcttattcagtgagaggaggtgatggggatagtgacttacaaagaggagttactcctgcacacaaaagaagggagaagggcctccatgtcaagatgggaggagcaccctggattctaaatttcacttgccttttccctaaacctaaaagaaagctaacatcacaataattccccgatcctagcacatttgttttgaccttccacctcctcatgcagctcttggggagtaaaattctaataggaaaaaatatgttaagctttgtcttgttttttattatatccagaaagaataatgcatcttccatggaagaattcctaatatgattcttgggtcatgttagccaaacagagttttaattcataatacttgtgacatgttccaattatgcaacctttgctgtcacgtccatccatggattaacagaggaactgtttcaccttcactgatctagacctggattattttacagggtatcctgtgttgctttgttatattggacacacaggcagaaagtacactgggtcttttcataatccatttctcccactccggaagtatatgaagatacacacatagactgagggtaaacatgagtctgagggaactctgcagcatgtatacacctgttttcttactgtgtcctctgaactcaaagtcagcactcaccctttatataagcaagacaaagactacttaatggcttacgtttgtctttttaccctatggtctcagacttctgacttatagaaagtccaacatcagggtataagaagcagagatagaaaatagatggaaatgtaatggtttttatcattcacgtaacaccaggcaattcacaaaccaaagcccaggaaatgaacatgttccaccattgctcagcaaggcagcctcctgggaaagggccacctggtgagccacactgcagccacatctaacgaagcctgaggcatggagtgaaaatattcaccgcaataaacatcccctccaggcttccaggtgtccacctgagtcagtgggaaagtgactttttttgctgattgcacattcctgataagtggaaggctccaactcaggtgttccctgtactctctgaaaaatgtaactgggatttcctagttttccgggagactcctcctgtattctgggttttaatgtataaaaacgcacgtgttctaagtgaattacttccagggaaggaagaagtagtcaaaaagtgttagctagtgactcatgagccctgtggaaattccctgggccagtgaattgcactgggtgatactgaagagttaatgagctcccaaggcaaggcctctaattcttcagtcacaaagaaacattcagtcactctgtatgtgagtggatacttacacatttgtatgtttaaaaacacaggttatgatttatattaagagaacaaaggataagttagaatgaaggacttgaaggggtttgcaacctcataggaagaacaacagtatcaatcaaccatgccccccagaactcccagggactaagccatcaacaaaggagtacacatggctccagctgcatgcagaagatggccttgccatgcatcaacgggaggagaggcccttggtcctatgaaggcttgatagatgccccactgtaaaggaattgaggacggggaggtgggagtgggtgggtgggtgaaggaacaccttcataaaagcagggggagagaggatgtaatagggtgctttcgggaggaagggtaactaggaaaggggataacatttgaaatgtgaataaagaaaatatccaaaaaaaaaaaaaggaagaaagagagaaagtcactagagactgacaatgctcccatttttaaagcattgattaaaccattgattttgaaattggttccaaagggaaggagacagtcactggagtttggcagagtaagtaagcagcatggtgaagagctaatctctggtggagagcttacctcttcaggcatcaagcaagccagagtgtgctgggagattgtgagagatggattatcccttagcgagtagtggtgtttgctgctgcttctcctgaggaccagcacagctcatggtaagggaaacactgggccaggacaggaaattacagcttctgaccaaacgaagctgagtcacacggcgcttgtcaaggtagaactatttcctgctacacattctttttactcttcttgttagggctttggggcagggtgtgtgtgtgacacctgcctctgtgtgtcatgagaaagacagtctccaaaagctgtagattttttgggtgtaagtgtatttgctcctaccggtgactacacggataaattccaatgcagagggacatgtatgcaagctggtagaagtgtctccatggatatagtgggagctgcagtcacatgtacatctgtcatcctgctttcctctcttttgctcaggactccaccagtgggtaatattgtccttatcaataaggtcacgcatgcaaataaccatagcccagtctaaattctgtgtttaaggaaaccacagacctgacgctgaagcattactactgtgtccacaacattgtcgcactggatatcaaattgttccctcactgtgtcttctatttcttttcagatttactaaatgaaaacaaatacattctgtggaatgtgctttggccacttgttatgagcagtggtatttagctcaaggtattgaatccttcctcaacaaggaaggtcagcaacctgagccatacaagtcttctctccaagtcaatgaaatttaaaattgggacagtgctctaaagtaactgatttagagcacacacttccatgtgtccagtgtcataaagtcatttcattttgctatcagttgggattggtgggttaaagggagaccatttaaacccctggtgttacactgatattaagagaatacaaaattggttctacctttgcttgcagctagacacatcctggttcttttcaccgagatgtggaggattcacgtgtaagagtgttggcctagcaccaaccttcagctgtgcaaccacagatctttcctggctgctcctggagttgattgtacagtatattctttgtatttaacagtaacgagaagtaatgacatgtacatccctgactgctgtaaacagtgcagagagaaaacaagcatgctcgaatgtttacgggtgttcccaaactacacagaggtgaaaccccagagctctgtgttgaggtcatcatttcaggaggcgggcctaaagctggagttctagtccccaccacacattcctgtgtgagtacaacagaatgaaacccagtataaggtcaaagcagagggaggctgcttatgttcaaagaaaagagatagtcagccaactgcaggtttcatattagcaccaaagaacaaactaattataaagctccacagagacacagtccacatgagaagaccttttccactccagcattagctctgtacaacagtggtaagaggagaggggaggagcagagagagggagacgttctgtttggcatggggagatcttaggtgagactgctaagtctccttggatagtcacctcttccttttgctaccatttcttcagcaatatcaagagactcaagtcttaggaagcagtctgagactttcagttcctgatttgttcagaagatggatggtaaagttttattttgtgtgtgtgtgttgttttaagtgagatgcttatttcagagaatgcaaatcatttaagtgaaagtatggtggttactttctttgtaaacttcattgcttgtgtgaaagacatattctcattatttcccctgtactgtcattgtcttcagaaatgtaaatgggctgtttacagtgcaggaagcttccctggcttttgaagttttcagaattcatgtcctttggggacacaccagcaattatctgtcacctctgaggtcaggaggtctgaaagccattgcttatgctttccccttccaagaattccaggcggcctacttccagggatgttctcacaaatatgccatgtatttatgaaaccagaagtcgcctggagtttccttggctgtggcagacagcaatgcggtttgtgtccttagctgtggcagagagcaatgtggttcttgctgcttttcaagcatcacacttgagaagctcatgaacaccaatacatctagtaaaacaggtttcttttgttttcaaaggagaacactgccacatgccttatcccaccgttctctgaactttgtggcctttttctgtgcaccctctctggagtcttgaaagctccagtttcccctccttcacagcagacaatactattctttatttctgcttagacagaacattggttttggtaaatagcacggtactcttttgagtccccctgatatcaacttacttattctttttcagctgttcagagctattctgctgcttcataggaccatcggggcttaggataaagaggagttattcatttttaaaagttgacctgtttagagaagaaagagagccaaagtgagtactgatccaatttccctcacaagtttggaatgtgaaggcagagagaagacacatataaaggagtgtgtttttaaaagcatgagatcctgggatggaagggggctctggcttcggttccctcagttccttttgtagaagaaaatgctcagactctctcagagggttttgcgaatgtcttctagtactgttgttagcagcattggtggcttcccatgctgatctgagaaacaaattgacacacatatgaaagaagaagtgacgtgctggaagacatcagagctgcagagagaacaggcagtgtgtcccgatgataggtcttagaaagagctcatttattcatttcataaaattttcatttattcaatggcaacatggctacagacataccacatagggttcagtagcttaggtctgtgtcaaagctgctatcggtagatgtggagacaagcctggatctgaatgttggatctttccttgtgcctgagtggcctgggatctccctcttgctacctactcacactgaacaaatagtgtgtaggcaggtctcagtttcttaggaagtagcagaaaggaatccagggcatagacatcactgctcaaaagtaagagatgggggaagagacccatcgttcttgttctattggtgtatgctggagtggaaactcataaaggacatgacaggatacacttgtttcctaaactgtatacattttttttgttaggcatttatgcctaagagaaaagaagcgattgttttgaatgtatgttacattttctgttaccttaactctattttacccagtcatttctcagtgatagccaaagggctgggtcctgtggtactacaactatcctgaaagacctctgttttccttgctaactcctaccattgagccccacaagtcctagggtgccccaatctagggattgctcatattttgcttttaaaagggagttagagagatagcttggacctactacaatataggagtctgtttaaccctcttccttgaagcatatcctgtacagatggcacagccagcataacctgcctccatgactcctttcagacttcaaaagctcttcctttcttaacagtctgtgttaagcacatatccagagcagcacacgtgtatgtgtatgcacatgagcacctggagttcacagagactccagacagacatgtttctgcttaaatacagagaggtttgaagtctgttttaaattgatggagaatcaccactctttgcagactgtatctgaaagagaaaaaaacatacaaaaaataatctcagcatatttaggccacattaactatgttccagtgtgctgcttatctgtttaaagacaattaccacagttttctggatgaggcaagacaaaatatccagtaacttagcaacataaacagaaaagagccagcactactacagatttttctcttgggctggatcacaaagtactggcaagaaaaaagctgacagccctagccttgtcctgctgaggtcactgtggccagggtagtgtcctgtgcacatgctgcagtgtcacatgcacattgtcccaagttcccagccagcaaattttcttcccttggtgctgaagatgaaacactaagtttcacatactatctaactctgaatcacaccccagccccattgccatggccctaaataaagctctccttttgtatgtgacccacaagaatgtaaattaaatgttgcatataaagttaaaatgcaaacttcctttccaatttgtgttacatctgtcgaggatcagaagctgttagcaaagtaatttggaccttttgttcaagaaacttcgaatgggctttatccttacttgacccattcaaggtaagtctctcgagtctcaaggcgttgtacagagataagagaacttgtgcttacacaaataaggtgcacaccccagcttgcctagttagttgctaagggattggacagtaagtgccttgagccacgtgcacctttgccttcttgttggcaccacagacgtaataatatttattacttgaaggcagcggttctcaacttttctaatgctgtgaccatctaatccagttccctatgttgtgatgcctctcagccataaaattattttcattgctaggtcataactgtaattttgttactgttataaatcataatataaaatgtcaatgttttctgatggtcatagatgacccctgtgaaagggttgttcaactcccaaaggccaaactgtgttactacacttagactaggagtgctcaggcttgactgtaccttatctctcctgggagccaaccctctggctacctgacctgtcagtcatcatttctcctcctgaagaatgacaaatatctgacattaaaggtccccaccccattatttaaccagttagtcacctttgaaaaaattttttttctgaacattgaaggaatcccttcagtgcagccacatccaggatgaggcagggggagacttgatctagaacgtggcacaacatggtagatgagaagatatttggggggagaataaaatcaagtatccctcagagtgtgtgctcttggcatgcttgtatgggagatgcttgcacagtaagtacgtcaaaggtgcccccagtttggacaacttccaaaatctaccaacaggaatttgaatgcaccttgtttggtacacttctttctgagctaagtttgcccttccctcacaggcactgtacacaatctgcatgctttatggctgctccaacagccctcaggcatgggtgcagaaatccttagtgctggcttatttatggtttttaattcttccggcgtgtgagtctgctttttgtcattcctgtcacatgtgggctcttctgagttgcatgctatcttccctgtgataaaaaaaaaaagcgcaccaaatccacacaccttctcagactctgagtcacgttttgacagtaatttctattatggatccagtaagaacttggggaagatcagtttcagtctgcgacttgatttttaattcccttcctggttgatcacttaacctggtgcattaatatccatgctccattctagatgccttgaataagaactgcaagttgtgagaaagtttaaaacaaacactggctcactatggccttccgtagttagctcatgtcagaaacaaaacgtgtaagtggtgatctcacactttctctccagttggaaggcatgggacgtttttccagaaaaaaaaatttgtggataatacagatttttaaaaatcatctaacattataaaaatatctcctctcttctccacactcctgcttttaatttctatgtataatattattagggaatgtgtaatttttctaatgcatatcttaacatcaagggacatttttaatcaactagattaactggcaatgtcaagattatcttgtcaaattaagaaatgatgtatatcagtcaaacaactaaaaagttctgggaaggtcatttttttttaaaatgtattttcgttcagaaattaattcaaaattaaagccatgttattttagagctctgttctggaaactgttggctataaccatcataatagtggaaaatcaaaaagggaacttcaagagactttcagtgtcactaaacacactttgtcaagtgcttcaaatttttaaagagcaggtataggtacttgaacagaaggcacaggtgtgttggtagcacaaaaaggccacccttggaggaacagatcacatgatccactctgcattcttccccaaagactaaccagtgcagaagcaagagctaaaagaaacacactcttaagaaacaccacaggggcctggagagatagttcaccagagtaggtggcaagcacctttttcttctgagccaagttcaaacctcaggacacacatggtagaaatagtggcttcccacaagttgtcctctgacctccacctgtgcgaactacctctccccaaaacacaagtacaaacaataaatgagcaatcaaatgtttacatcatagtctcaggtcagcacactgtctctgctaacccggacagtagtggttgtacttcttgccctgttcctacatcatgcaaaggaccccgcctcttagcccctgcaatcattaccttttgctctgaaccttccctttatggaagcttcccttttatcaattgtcttgtaaatgtcaccactgagacacaagttcttctgtagcacagtttatatttaacttcagaatatatccactgtggaatatacttagaaacaatagcaagcaatatatttaggatgaatttactaatctgattcccacccccacccccagattaagtcctatttatgtcattagttatacatggctgtgttcttcctgaatcttaagaatacatccttcagacttcatgacattgggctacctgaagcctgcatcctggtcacaagtttgcttaggaggcagatcccatcacagtggtgagaaaagagcccaggcagcctctcaggagatcacagctgctgtctctggcaagctctgagctacaccatgttctctgggattggaactctttatttttttcttctttcagttggtctgcaaataggattctacaataacccatgtgcatgaagtctccaaatcagaatttgctgagctaaaaagagcactaaatgagatgggctggctttcagttggtgagaatgcaatctataactacataacagttctttacaaaataagcaagcagactcactgggcatttccattcaactggaaatatccaagcttatttaactcaattaattgttcttgtccatttttttttacagcctagccagtgtccattagcaattagttatgaatggcacatttgatatggaaacatctcatttgaggtgctactgtggtttattttgaaaatttggttagctttgttctaacagctttaaaagcattacaacccgtcctatccgggagcttaatgaacattccatacaacttaccttgccaaaattttggactgaaataaaatcctcaccataactgaacagaccaatagaaatggtaacaaatatcaacaaatatacttaaaactcaagaaagccttgcaggttcctttaatgagtcacaacatataaagattttaatatgaaggctccatgctaccagcaaaagctaatttccttggcagacaaaattgtaataaacattatgctatgcaccttggtttaagttattaggacaatggggggtgtatgtgatggggcatgttcggggagcacaacaggagggggatgaagactggactataaaaaaggattaaagattaaaaaaaaaaaacatgtttttaggacagtgtgtgacccagattacacaactaatgttaagagaaagatttttcttttggatttttgttgctgggtatacccattttcatatgcaagcacacacacacacattcttcatctattagagatgagtgagctggcctgctctcattgcttcaattgtgttctgcctcctaagaattctcatgacagcaacttgggctttcaagtggcccagtgtagtcaagttcaaaacaatatattcctaagcttcaggaggaatgtaggtatgtttgatccatgatataaacatcatttaattcattaatattagagccctgtatgaatcttccaatgctccttgtaataaaccccaattaaagcatgattgcttcacacagaagcctccagcaaaagacttctgcctgtttgaatgccattagtggagtagacagctctccattctcaaagaattatttgtacacacattgtactgacccacttgagtatgtcagattatgttatgtcagagctctgaggaacttcatataaggtttgcaccttcataggtatgcctggtccctgtcactggccattctattgtaggatgtcaataaacatgaagaatagacaatgggaagtgggaaatggcaaacagcagaggacatgaatcagcatgtgctttgaaattagaaaatggaagtcactgcagagagagaaccaataacagctaaataaaagttagataacactgcacattactgccaatatatgtgtgcccttactgaggacatacacaataatgtgtgacctgaagaatcatttgatgctttggcaagatgattgagggtctgcagtgcacatacaactcagcccttccttcacctctaggacatcttggcaaatgtgacagtttgagtgactagtgttctttgccagctataggctacttatatggtgctgtgaatgggccaagaatctggcctctggaacacagcattccttgacagtcattaagtaaggtttctgaggaaaaaaaatatttatggctgtgggattgttttcttgaagatacctagagaacacaggtgtaactatgatgctttccttactgactgggccttagcttagtcatgacatttacacatgaaagtgaaaacttgccctttccttggtgtcccacaggaagcctgcatgtattcactgctgcctgtgttgtgtccttacagggatgtataagggctgtgtgcctgtgctgggcaacctggttcacacattcccctctaattctccctacaagactatgatgtgattaaataacaccagtttactttcacatggaacaactcagaagcactcgcagcagggcagctatttaggctaacagatctgaacctactagagaatttggaaaacagcattctagggaagcccaggagctgctctaggctgcatgaagtcttcctctagagttagcttctagaagagatgctctggagacttggctggtgagtggcagagttgcgttgtctttcgccctaaggcagctgcgaagagctggaggctgcgtcctgagctgctattggagagcaggctctgacgcatcaggctcagtcttgtttagctagaaaagcttggcacagttgtaatgtttctccagctaagcactatctcaagtgacccagtgacactgtgggtgtagaagggggaggaggcggccagggctgctggggcaaagtacatggctgtgaagaacatttgaaaataataagtgtgagtcagaagcaggctttactcctgacactctggaaaccatgcaacacttatcttgctcctgttcttgataggatcttacatgtttacatttgcatatgggcattcaggaaggaaggaaagaagaaataggtggtggcagtgaggatgagtgttcctccagtgttaggtgacagagctctgcccatcaggcttccagtaacacttgcccacaataccatccctgaagcacttacctgcaccagaaagttccttttacattatcattttagacttgacactgtctccagaaaggggaaaccttttctactttctttcttaaatgataagaaatacacaccagttataccaagttagctaaaataccttagcacataaaagtttatacacctctctcttcctccttctgctctggacagcctggggaaataagttttataaactgtgatgtgtctttacttgcctacaaaagtttggagtagtttggagaccacatgctccctacagctaatgaatgaatgaatgaagtaatgcccatgccagtctagcatggatcagtcttgattagagcttgggtactgctacagagccatagattttggctgtcctaagaagggcagggagtgtcattgagatggaattgaataggcaatacaaggtccctgtgacatcacttgccctgctctagagcagtggatcagcggcatgcacaaagaacctcctgacctgtgtttctttattggcctgttcatgctagcctgggcttctctatcgactagagtgggttagagcagagcaccggactcccaaccattcaccagctcttcttgttcttctggataacagagaggatttaggtggtttcagaaggataaagagaatcaaacttagctttctgaaaagctatgtgggttgaaatagtcacaggctaaattcaaagtaaagggtgaaggagtcctgtgttgaggctaggtgaagaaaagaagcccacatgggggtttggatggaacatccagagagggaaggaagaggcggagtctaggagggagcaggtcagcagtctcaggggctgtagaggtagtgccctgtcccagcctgcattagagacagtaggtgggctgatgtgcctcggtacagatgtgcccatgtggattctgccgaggtgacaaatggccagagtgtgaatgctggagtgaggagaaatggaaaagaattgtgtgtcctgaatctgggagagatgttgagaaaaagagggtgggcttgcacattacttcatttcccctcagagatgtgctctttgtgtgacttctcttccagggtctggatttcagcgaaggttgagacgcatgtgaattaaacctccgttccatttactttctactattttgtttactgctgattttctcacgatagtttactgtgatagtacactgtactatcacaggttgttgtcgttgctatggctgaataccacagaccggatgatttataaaatataggattttgttcagctcagggttaggaggcttggaagagtgaagtttgggaagctgcatctgtggggcacctttgtgacagtcaggactctgcaaagcctcaaggcagtgcagacagtcacatggaaagggatgggataggcaagacagttttgtgacaggactactcttaagttagctaaatcatccattagttcactaacagattaattcactcctgaaggcaggtccttgtgaccgaatcagctcttaaatattctcacctggtgtcaccttttaatgtttccaagcgagccttaaattttgatggagtctttcaaaccacactgtgtgctctcatttgctgattgtggagaattttggtggccttctgggtttgtgtgcaagaaataggcttgccttgtttgctttttactggctattattttcatagaacctcaaaaccttagtaggcaaaggaagtgaatccaacagctggtgagaaagaaatgctgtgtgcttctaagaactccgacaaagctgaaataggcatgcagccaggacagacatttgtgcattcagggttctttatatagtctatgttactcactctctactagtagtatataatagctcactttcaatttcttgacataatcatttgctagataaaagaaaagaatcttatctcaaaagtgtttgcctttcatgaattatgctttttgcgctcatgttttctcatagtatcttctagaaggtttttgttttgtgttttagatttaagtatgacatctttcctttttaaagttttaagcagttacatcctggtgcatgcttttgctatgatgtccatttgctttgaaaaggtccatgttttaacgtaagacactgtaaggctgcactgtgcaataagtacccatctctgcttgttgtttagtacatacaagatggaatcctacctgtcgattcaccacacaagcagagctagaggacattatgtcacaaggctggatgcacaatggccattttgtgtgacctcacttacatgtagaatctgaaagggagggcagaacccatagaggcagagaagcatggtccccaggggctgaggagatgccctgggaaagcaaccagatttcagtttgctggaggacataccttcaagaggtctatggaaaataatagtgactacagctaataacagtgcgttgcagactctagaactgctagtggagtaaatacgtatctttttactattccaaaataaaagagaaattatatgaagtaacacatacattaattatcttaagttagccattccacagtgatgaaaatatcaatatatcacatttagtaccgtaaatataacaatttcatttgtcaactaaaaataaaattagataaaataaataacatctaccatagcgtcgatataacaatgaaaaatatggaactctgttgagccaggacacaacccagtgacatcagtcatttgtcaggaaggttaaattccctgcccttacacaaggaggcacttcttgtaagcttgtaagctctgcacactcacatgtgttctgcaaaatgtaaagacaaacactcatttgtggatcccagatgttgaagatgcacacccgactgtcacacttccacaagatcttcacataaaacaacaaatttgctttgaacagaaatcatttgaaatgtattcttggcagaactgtgtgtgaccagggaatagaaatgattaacagaatgttatggattgtggactattgcaacaagagaagttatccattgatgccatctgcacacaagacccacccctgagatgacagattctgtgctgtttatttcttcattcaccacagcggtgggaggagaaaggtctactgagcagggatgatgcgcatctttggctggcccattcatgcctttggcatgaaggaatcttgtctagactagttctggttttccttttctcagaggactttgcccacttctgggacaggccaggtccaaagtgcaatgtggaagaacaagagctcaagacctgggaggtgacctgtccccaactacctctaattatatagaggtgggcgtgtcttctgaagtgctctctgttgccactgggaaagcaagactcaaatctacttctcctggatagtaagttcatctcagatacacccacttaccttgggctagaaatggtcacttccacatagttctcaaccctgatggaaggaaggcaggttatgaggccattctgaaaaagtgagttttgttttgttttgttttgtttttaaatttctaaaccttccatgcccctcacttaagagcatgccttggtatgttccaggtcattctataaagtattctgagccagtcaacagttcagaaatagctaacatggaaaccattctataacattagcttagtggcttacaacataatttcaacctgtccaagtttagagatgttttattacaaaaatcctttgagaattccatgcatgagttttctgcatttctatcattattacttttcccttcccctccatctcttcccatgctccccccacacactatcctctttcaaattcattacctcttcttctgtaattaaatataaatgtatacaatacacacacagacacagacatgctcacgcacacacacatacacaccctactaagttcaattaatgttgcctatatttgcctgtgtttaaggctaaccacttaggaatgctctgctccctaaaagaacaaacaactgattccctctccctaagaagtctttagctcttcatttaagaggagagcattgtgacattttctcttccatgttggcatgctgattgcaagcatattgtagaatgttaatgggtgaagcattcctgtactgcctaaaaaaaaacctcatcggtaatcaggctcttaaaatctctctgcctccacctccaggaacttccctgagccttacagtgccctttattcttcatttggaccagttgtaaatcattctaatagcctctgactgcctaaagaagaagcctctgtaattatagctgagaactccatctacctatggacataagaatgaatatttgaaagtcaattggagacttccagtcacatgatagtaattggttctcctctagggctcgatattgccatatccacagactattgtgaattcctgtaaactcagtgtactttaggttcagttggactactccaagtgctgattactcctaagatacaagtggctgttattgcactactgagagtatcttaccactctagtccttgttgtggttctcagtctttatagctggatgtgactattaatagcttttctccctgggcagcttgcgtagtattttctgacaaatgcttttttactattttgacatatactcatggctccacatagtttcagtgcatattatcttcatggaattactctgatcttttccacagtctgtctctttattttattctacttctttttctttctttaaattatactcatcacaattcacagtaacaatgttacaatacaatgctgggttgagactcagtttgaaatcccatttcggtgtgatcatttttacatccagcgtatgaaactgaagcaactggtggattcaagattaaaccagaatattcaaagttacataacagaaatgccaatagtagaaaaatgacagcatgacatgtgtgaaggaacttagatctttcttcacgcctcaatgagcaggaaggtagttagtgaactttgaacttctgtagaaaatagtcagtattccccattttccttgtttctgtttgtactttacactacctcacatttctttaagcatctttgttttctttttgtttccttgtctcctgtctactgtttgccaagaaccgtctatttctaagctaaactctaagaacttggttagctgcagagccacccacaaagcaagacagtgcaatgtcttaatgtattacctaacaacacggacaaagacttgctttctcctgtatctttgaaagatcactgtctaagttgccagtcttttggtctacatatgcagcagaccacacacccctgtgctcgggagctcacatcacttcctgcctgagacactgtttaaatgtctggtgtgcatgcagaattctgagcaattatagtataccattctctgaagctgctgcaatcaaataccacagactttctggtctgaaacaatagaaatgtattctctcaaggttttagattccagaaatctaaaatgaatgtgccattggagctatgttttctctaaaacctaaaagggaggtacgtgcttttccagcatttggtgctgccagcaacacttgccctgcacccagcctctgcatttctctgtgttacagggcattttcttatgtgtctgtttctgtgtccttacatggtgttctcctctctgaacatccatgcatatgcaatttcctcttgtcttgtaagaacaccagcaattgggcctacccttatcaagtgtggcctcacggcaacttgactgtatcttcaaagaccctctttccaaataacatgtaccagagttaagatgtgtgcacacattattaaaataattcacgtcacaacacataaaagtttacacactccttaaaggctgattttgatggtattagccctgcagatatccccaacatcgttaagacatccagagctgatttctaaaaggcataaaaaccactgggctatctttcttaacaaagcagccttgacctccaggaacagtttcctctggatcgtctttctgactcactccaccatggcctcccacagtccagagagattgctgcagatgcaatctggaaccatcagagatacagtttattggtaaatgtgtagtgagagaagtacacaatggatcactgttataaaggcaacaatatttatctggagtataatcaaagaggtgcctctgttctcagtgtccttgggggtcttacaaggctggggtcacctggaacttttgattcttcccttagatcattctggctgttggcagaatcttgtttcttgaggtcgtagggatgagaccttgcttttaaaagcttctttctgatgggaagtatctccttctaggaagccttggtcagccttttcttcccatctgaccaagtaaaccccaaccagattaaacttaccattaattcaaaactaactcacgtggaaccttagttaccatttcaaaactttaactgactaatcctgggagtgttatctacaaatttgtgtcaagtcacattgagataagccagaaatgtgaactggaccagattctgtgtcttagtagtgttaaactctgaggctatgctagatagggatgtcaaaagttgggatggtcagaggacaatgaagtcactaggaagaaatcacaatgtaaccatgaactgggatgcttgcctttgagaaaattaaggaggctcaccgttcagctttatgccacggaggaatcatacctataaaaaccagcatcggaaagcaaaggaagtcctggtttacaatttcataagtttctatccaagctcagtcactcagttgcttctgggcctgtggtgaaaaagtacaaacagcaggagccatgtacatggtagccataaagcaaaagggagaacagaaaagggggccaccactaatgagcctcctttcacaaggctctacttcaaaatagcacaacaatatacaacagaaaggctttagcgtgggggccttgacagatgtttacattctaaaccattgaggatgttgtaagagctgtcatcagatgtctgaaaggctgctctgaggtgggaatttgatgtattggactttggccttccaaggaaagcaatggtgtgcaggcttcaggaacccatcaggctctgatgtccacccattgtgaacctccattgaggttctccaaatgaaacatttctctaaaccccaaaggagcttagccacatgtcttcagcagtcagacacaaaatgatgactaagtaaacaaaaacttaaccaagaggatgatcccctgaaagatagaccaaatccaggatgagtctcacgtttccttctgcatatcctctgcctcaggtaggcagtaggcagaaggcaggctatcataaccttcagaagtggagagctcctccagcaaccatcatcctgccgaactgtaagcagctccacaaatgttccctgtggaaaacggtgaaggcacctatcagattgtagctaatggcttagtcattagcagtatgagactcaatgtctcagaggttatagtcagccatttgcttttctaggtggccaaatatgcggcattcatgtaagctcctttgatttttccaaaacctcaacacagttctggtcttctgcatgcctttgcaagcatccatctatctttccagagattcagcatgcacacaggaaaggctctcgggctttagacctacacatgcactggccgcctcaaatgctaggtcttcgaagagccccaccatgactcctgtatatttgttccactttgctgcactctgtaaatgggagtattccctcccatagctgataatatttttctccataatgtctcagaaatagtctaaaaagctaatactagcattacagtagctatgtgtcaagtacttaaggtgtaccaggccccgaaatagagacttttaaaaatgaattatctgggtttttcattgcctcctggttcccacactggtcatttcacagacctagtggttgggaatctcaaaccagagcattctcacagccagacgcagacactcggagacttaacaaggttatggctacacactcttaagtctgtggtaacctaaaagagccagtcagggagagaaagggaaggagggagacatgggaggaaagggaggaagaaggcgtggcatggtgaggggtgaggtagggggatgattttgctagcttagaggaatcgagcccttgaaagacttgagtatgggaaaaaatgaagctgtggcttttttgtgagccagctccttcctggcaggagcttggactaaaaccaagcatagcagagttttctgttttaatgggagcggctacatagtggctcgcccttcccttttctcccttgcacctctgtgcctggatttccttgccctgctgtctgtccctggcctgctgtgcggcaggtaggtccagctagacgctgactgcacaaactagggactggctgctgcctgctcgctctcccagaccagctccagccttcactgtctctttgttcacagtgctgtcagaaatatctttgtcttgtaggcaggaaatgagaaagccatgttttagactattcaggaagtcatccagagttataatggcccattatctgatggccagagtttacttagcctttttactgtttcactgtgcaactgagacctggaaacacaacctatcccaccccacccccaacctgtcatcactgtgcgtgtgcagatgggaaccatttcctcctctacctgtatcttgggtattcccagcttctgggctctagtgctcagcctcttaactcatcatatctcattgaattggccaacatcagtaaaggtgctcacttagcaccagagcatccctggtcatacaggtacctacctactggggttatatggttagagacggttctcagaaaagtgcattctggccatagatactgtgcagaagaaaaaacaggagccttctctcaccaaagcttggcccacatgcaaaacatttacaacgtgtggtaaaatgttttatcggcaccaaggatttgtgattcctagaagcaaaaataagctccaaccttgatggaaaagagagctcagtctttctaacatgccatttgtggtgctgtgacaggttggaaccctcccaacttggtttatctggatgaacaagcacgcaccccagttaaggccagcctccctggcatattcttgccctgggcagacctgagtcacagctcagggaagcatctccagcccagaaagtagtatcctcccttcttttgtgcttctttccttagtggaaacagatggtagagctcccagggaaatagaagcaaaggaaatcattttattttccagtctgtgttctactgcagctatggctgatcgaaggtagggtagacttggggagggcccctttgtccagaagaccccaggaagagtctgcagtccgttaaaggcaagatgggtggcaggttttaggaggatgccactggaagctttagaacagagttgcacacagcataatcagtagagatccaccagtgtgcaggccccacgcctgcaatgcacagctaccttatagattatgaagccctggccacactggtagttgttcagaatccatgggggtaattccagagtaattttaaagtcaaccgccaggcatctgtgcttgtaaattaaatgcctggcacatgattgtgctgaggtaatagttcattacaatacaaattacaggggtgttccagtgaccatgcgacctttgcagtcatcttgactttgcctgtgattactgggggcagcctcctctgttctgctaatggagtttactcatgttatcagcccattgctgacatttgtctttttaatgaaaggcctttatgatgaaactaaaatgtttctctctctctctctctcttgtctctctcttgtctctctctctcttgtctctctctctcctctctctctctcttctctctctctctcctctctctctctctctctctctctctctctctctctctctctctcccttcctccctctctctgaagccatccctctctggaagttgacagacttgccttccgggtccctctgtttttgttccctcactctgccagaatttctgtctctatttatttatttatttggctgtattttaattacaggatacaaaaatatcctctcttcgtttgtaaagttcaacaattgctccccccccctcaaaaagagacactgtagaaagccaaggataatttctcagacccttccctttctacactcactgtcaggactggggagataccaggtttttgttctgtggacgttacatagaaatatatttaaattaaaaatagaatcagtttaaatatatttcatacagatttgagtttatgtgatgcacattgttagacacttatttttcatacaatttcgctttagctgagacttttcccaattgcagtatatataaatcagcttcctttatctagtggctgccccaacttccacacagctgtctgtaacagggacctagattgttctggaattttttagctagtgcaccagccctttaagtggccctgtttgtacaaacctcctgtgcacacttaagcaggatgtacaggtcgcacctaaaagggaagggactgacatttaaaacaaaaacttttcataaattttgctctcattttcaattattcacagatgctgtcataggcatctagacttgaaatcaccatatttttttctttctgcaatgtgtgcttgcatttctgaagttcttcaaagctaaccagatggaagaaattacgccattttatcctacatgcttcatgccatgtatctctcaacattgatttttttctcctataatcacaattatcacactttaaaaatgtccacactttaactgcatcatcttcaactagtctggttcacatagacactactgtctcacaagcatccttttgtgtattgtgtttaaaccatgatctataaaagctaaacacacacctcacctttctcctgtgtattggatccagtgttccttagcagcaaggtggcatcaaggtgctttctgatatctctgggcttccaggcttcctgtttcctaccactgctcggagccttgcctccattaggctttctctgtgagcccagctacatctctgctgatgctgactattaactgtctcagggccttttcagacactctcagctctgatgctcatgcctttactctgttgttaaaagaaattttagatacttttaagacacaaaactgccggcacagtgaggtgtaggccaacttaggagtttgccaccaattcaggttacaaaaccaagaaatacttctaggcaactgtcccttcagcccacagaagcaggctttctttggtatttaatatacagcttttctagaatgttctgttttacttaagattctgatctaagtgctaaataaaggtaaaattacagaaaagcactttagatgtcagaaatcacacagttaagtgaaagcatcaaccccggaacttgaaagatcatctagtttcttaaaatccccacaataaacctcagttaaaggccagaacttgaccaggggcccaggatgcaagctatggcaagcctcacacgtggaaagagtcttttgcaagcaataaaacttttaaaatgtagctttataaggacttattttatttttaattctttgtatgtgtctgtgagtggacagtatatgcactgatagagaggccagaagaggacactggatcatcttgagctggatttaccgattgtgagccattggacagggctacaagactggaacttgagccctctgcaagagccatgcatactcttaattgctgagccagaccctaagtatatctttaaaaaacaaaagaaaaaaaaagacaacaaacaaaaaaaccccacctttttaatgttttatttatctatcttttgtagacaacaatcctgctggcttgcagaatgagagcagtgaattgtgaaatactcacacatgcaggagaaagaatttttgttttgggatttttgtttgtttgttttttaactttgaaaaacttaacaatgcatttcaatttttaaagaccctagtttggaattttataaaacacagagcaggcttgggtttataagctttttattgaaatgtgagttttaaaagtatatatgcttcttccctgtgtgggtcactgtttactatttgaatatctgacctcagcaacagctaaattctgttcctaaatggtgtgtggacccatatcactagtcagtcatactttagtcctgataaagcaaagagtctgctctaaaagcatcacaaagtcaggaggaagagccagataagcagacacttgcactgtaacaggctattaagatctgggtaatgggaaaaataacagtgactatcctgaaagggcctgatgatagtagttcctcatgcagagagagaggtgtgtgggctgagggactggtagcagacacaaaaggtgagggaaaggaatagctagaggaggcagatggttatctgtgtcccctccagcctcctttggtatgtgcacttctttcttgtcacctgctacagaacagagccaaggagatcaaaatttccatcatttgggtaacaaaatctcccactttgttcttaagtctgccccagagtgggggcaagcagcagctaagcagctatgaaggtgcctgctctgcagagggcgtttggtgtgtgtgtgtgtgtgtgtgtgtgtgtgtgtgtgcgcgcgcgcgcgcgcttgtgtcatctgagtgtgtgtctgttagattttggagaagacaccttattaagtccgtacttccctgaaatccttaagcttcatgactaatccctaccccactctatttcctgaaggaagttctggaggctggagaggtggctcagtggttaagaacatggctgctcttccagaagacctggtttcaattccctgcatccacacagcagctcatacctgcctgtaactccaggtccaggggatatgataccctcagacagacacatatgcaggcaaaacacccaggcacataaaataaaaataaatcattaaaaagcaagcagcttgttccaaccaacaaaactgatgtcctgtctcctaagtgggcagcccttaatcattttcagagaacgttaccaggtgtctcatgcaaccctgctcaatattgggggatgaaacttcatttcccagatctctttcttttttatctgggctggcaattcaatcaatgctgaggtctacagtgcttaggaaagcactcaggaggctccctgtgaacttgatatggccctgggatttgtgtcactgtgaccccaatctcatacagagccctgcagttgaaggaggccacactcaggctccaacttcttattatttcatgctgcagggtactggcaaatcaaatctaaactgagagcctaatgcccttaagttgtgcccacccacacacatgatatgttttacatttcctaccaccatccctgttattgtttaagtgagtttgggagaaaaactgtttttgtcatcatacaaaactcaagcatggaaggaatcaagtttatataccttttttcaagggtcaaaacaagcttgcaatatcaaatgttgccaagcatggaggcaacagacgtcattactgtgctggtctaattacaactgtgttgttgttgttgttgcgtcagccacgccaagaggagacaccagcaaagtatctctagccctttgcagatgataagtatggttttgatttcattgctaaaatctagcttgtttggagatagggtttgagattatggatctggagaacgcctcgtgtctgtgatttcaaaagaataaccagataaaagcattaagttccaatgtctgggaattcatctctaaagagttcacttgattggttaattctgtgcatcctgtcctaacccgtgcaatgttccaactgtacctttctattttaaataaaagactgcagccttggtgctgaggtgtcagtaggaaaatacttgagactataagtttgacctacagaccctaaaagcaaagaagggtctaaactaaaaggatattctaacattcatttagctaatttttctgtgtcttggccctcaaccagtagctaaaacacagatgagctaaatggtccagtgatatctataaatacgctctcgaaagctggcattaggcatttcaatatgcttttcccaggatgagcgttcttggattttttttttttttgcactgtcttttgtttaattctttttcctatgtttgaaattctaaagtctttgtattggtctgtatgcttttcaaaaatgaagattgttttctactggagttgtattggtctacttaattccactgcattctgagttattagcctgagcaatatcctgccttgacggcaaaacaccattattcacatagaagaccacaagtaagttcaaatcttaggtcagtttctcttttgcaagtttgagtcctcattcatgggaaccaaaggggaaaattttctccttcctgtgttgtacatctgttgaacttttcctggacttctgtgatgtaaaagttcttatttagaaatagtcatttctaagtatatctgtggcctataaacaataacaacaacaataataagaccaagtaacttttaaatgctgtgtttttcccaattttgattttttaaaaataattaattaattttatctatataagtacactgtagctgtctcagacacagaccaaaagaaggcattgaatcccattatagatagttgtcatccaccgtgtggttgatgggaattgaactcaggacctctggaagcgtagtccttgctcttaaccactcagccatctctctagtccctcagtttaaactttaatagaaactctgagctggaagctagtgctgtcttcttggtttagggagtaggagaaatgagtgcaattctctgtacatcttccctaaggtggtgctgtacttgtccatcctgtgggtgggaacggggatggggttaagattggtcctttgtctcccccatcttgtcttgaaggctgtggtagctctgggagttgtcgaggccttggaggtgcagaagtgccaatggacatgaagcagatggctttataaaatatcagttctattaaaaatgatggcaaaaccatgtgtgagacaggaagtatatctaccaaaaacccgcagtgcaactcatgttagacataaaaaaataaaacctattctacagaaccaagatcggctccgtgaggtccacttttccctattatgaagaatatgtttatcctgaaggagtgacatctggtgataacattccttcatttggaaatgaatccgtggaaagaagtttccactgacttacagggagaaaaatgaattggcttaacccagcatccagctctttatcctcaggagagagcccagtcagtcataagaggcagctgccttgcgcagatgccaagctcctgcggcttgctttgtcagcccttcctgagcagtgggttgcaggcaactgcctatgtaggtgtatccgcagatgtggaggagtcatttgggagacgagcacatcccatgaggatgtgcagtcaccagaaagcgcgcacagcccacttatctggacagtgagcacactacttttgggagaatgcttacccagtagactaagggttacagaccaggaagccataagtacatgtagggcctgaccgtgtacccagagtgtgtactgcgaataggggcagtgctagtttttcttttatcgttctaatatgatggccacatccagactttcaggcttcacacgcatgtgctcatcttggatcagtttgaagaaaatgaaggtgaaaagaaatatagagtgctttcggtgtgttcccgtccatcttcattgctgtagaatcacgggtttttaactgaggttcatttcacaggatctggccagatcctactctttggcaagtggagcaattatttttggaaaatgagaaaagcacagaagaatctagcagaagcatcttcggacatcttaaaccatgattcatatcaatgggaattctgctttgaaagactgaaatgaagtgcccaaagtaactctgggagttttgagggagagcccacgagccctgtcttagtgcccatgagattgtgatgggtgaaaataccagcttgttgttcatgtcctttcgcaactttcttccaggtggaagacggtctttgacacatgaattgagtcacctgaatgaatgacatgagctccttaggcatctctgggcttttgggtgtgtagacgtgccaggaatgtcttatgttcttggtaactgaggactgtcaccttctggcgggaaagatggtgtggtcatggccacggtgcctctcctcccctgaacatctggctctgtgccttccatcatgcttatcagctgaggagaaacaagcttcagggatttagttgactagattctgctgaaaagaaagaagaaaaacttagaaatgaaatgtgtgctgagttaaagtttatgactcagtaaatagtataaaatggcaggtttatctctgggttctttatctgtgttctccttctaatgagacagtgtaagggaagaagggagggagggatagaggagtaagagacagagagaaggggtgggagagagggggatgggggaggcttatctttgaaggcagagcacacatggacgctgagcagctaaagaagcttgtgcctctgagttctttcatttctgtgtccaaggctaggatccttaacatgacctcaaaataaacaagttttgaagattatttttactaattcattgaaaatttcatacatttatactgtgcaccttgattctataatccactattacttccctctgtttatctcctgttgcacaagcttcaggccccacaaaatatgacaggccctttgccccactgttacctctcctcctatgtggctagagttgccagttccagtcatctgccctttctcaagtgcaaaccacctttcccctaaagcagaatgatgctaggtggttctgaagactaaaggggagaggctacataactaatgtccagcgatggtaccagtcattgaggttctgtcttacatatggccacactgaagaggattcctcacacggaagcagtttggctcatccttcaacaagaaactgttacacgcatatctcctagcacaggacagctgtgtgagtgagcctccatttcctaatttgtacaatggaagaactagcacccatctcaaagggtcacatgtaaacatagggacacatatacagacatagctacacatgcacacacagagagagagagagaaagagagagagagagagagagagagagagagcatgcactagagaaaagcagatctttatttctccctgttcttcaacaatagagcaaagcaagctaatttgagactcagtaagtaccacaggatttcagatctcctcactctcagcccccgtccctctcattctgagcttatgtgaaatgttctcactgtcaccgtcatacctgtcttgttacttttgggctactctgtaatgacgggccttcctgtgacgcaggccagactgtatcagtgtgttcatagctaatacccagcaacagtgaactggaacttcacacgtatggtgggaatatcacatggtctgtctatggaacctctgttcatttcttctgcttcttcatgaaagaaacagcattgggccgcccacttaaacggaatgttctattctaggctgtttaacttcagggaagctgtgaaacactagggaaaacaaaaggaccacacttgggaaggggaaatgtattggctcacccagaacagaaacctctccgctgctttctctcgtaactgtgtctgtcctctgtggcctctactctccaggttgtttgtgaggattcttgctgtctgagacaggcaaagctctagggtggtgagtttttttcacaaccccttcctgaagttctggaggttttgccttcattggatagtgaccaacacaccgtgctccaaaccagtgtaattctgagaaagaaatgaaatgaacatggtgtaattatttttcctccattcttcggaaaacctccatttgctgttttactgtctttcttttgcttgcgaggatgctcaagccagggaaattgtgccttactccagcccacataactgggctctgtcctcacttcctgctttcttcattcctgcttctccctttccatctgcctcccttccccctccacctctctattttaaattgacacaataactgtacagatttatagactgcaatgtattgtacattgtctaatgatcaaactgggtaattattgcatgcagcgccacaaacatatgccacttcttcctactgaaatacataaagtcttcccttgtagctgttttatataagacactgtgctataaatataaactttgatgaagacatgcaactctatccatctctgcctagtctccttccctcttccatttccctctcccacacccagctctagtcagcccactctccatgagatccactttcctaactttatttcaaagaacatgtcattcaatgacataaatataaaataattaaactatcactaatcactaagaacaaagcaagcccaggcaaacccacccatcaaccctgtggcgatttcatgaatcaaagtttgcacttgttaaaaagaatcagagaggagttgagatagtaggtgaattatgaagccatgtgagtgttatctgtgcaccagtttactaaacagtttgaactttcactcccccaaatcttcagattccctcagtgacagattaagcagaagtcccaggcagcctgattgtggacaaaagagcatccaggaggagacagaagagcagagcctgtgctcctgggtcttaataaacgctggttctttctatctgttctactctccattcacatgactcaatgagaaagggaaaatccacttctaccatacttgaacgtcctctctcccatctgctgtcatactcgcagatgcagtgttctctgcacagccttctagtgttccctggcattaggcagatcgtgaccccattcccacaataccactgagcttcattttccccttgtcgcattagattacacagcgatttctgattgcacaacagatgccagtattggggcaagcagtcacatctgacttgttttgtttctagccacatcatgggcaatgttgttagtggtacattcctttacgaactagaagttacagttggcctctgaaagttaaaagtcagaatgattgtgagccatgacagtgagtgctctgtgagatggtaaaacaatatcttggcatggctgagtagtgtacccagttcctagtgccagcaagaaccccgagaatgggaggaaagagctctaggtgcttcattggttttagatctgtagtcaagacagtggggattgctgccacctgcaaccttgtcaaagtactaactatgaacagtggttccattcctctgtgcctttcctctaagtgcagtctcttctcaccaggctgtaagctgcacacaagccctcaaaagatggagaggcagcatcccctgccttgtgtgccccctctcagggtctgtttcccacaaaaagtgtgatatgaacttcacagtgtccctttgtacccctcccagacttctctgaccagatgtggagttcggaaacaagcaaaaactccattcccattagtgctatcaatgaaaactcagacaaaccaatgtattcaattaagatctcagaaacagaatagatgtgttaacgtgcatctgtgcttactaacaggctatctgacattttacatttgcctgttctttctgtctctctctctctcttttttttgatacaaaaatcctttaaacttttaaaatcacattctatttatttctatagcacgtgtgtttgtgcatgtctagtgagtgacacataccatggtgcccatgaagaggtcagaagactgtcaagaaatagttagcttctaccatgtgaaccttgggagggtcaaactcaactcttcagtcttgatagcaaacacatttatccttagctatcttaccagcccaaatataggatattgttatattgtctatgagggtcctgaactcctagaatcaaatcatcctcctgcctcagtctttggaggagctgggaaaacaggcatactcataatgcccagcttatgatcttccttcattttataatttttctgagactctgggcctagaagcaccaaggccctatttccctgttctgttctgcaaccagtccaactgagagagactagtgtccaagagtttcttctctaggacctcccctgaatcccctgaacagaggctggtgatgccctccagtttcaactacagtccttctctagatagttgatcacgctcaggacaggtctaggaactcacaaatgccgtctcctaaactaccccggggtctggctgacctagatttccaattttaattatgtcaagtatttcacacaggcagtagcttcctggaagactcatgagctcatagtcataaggttgctgcagtcacagttgtgttattatacacacaacagcaacctctccctgacagctgttccctgtaaacaattgcattagctacatcttggaaacatctttggggccaggtcctctgagactgggtgcagtctttgaggtgggcgtcagggcccagaagagagaaaagccggcaggaaattctctcctgccattccttctgttgtctaaattgttttagtcaccacagctgtttactgcagaggaatcgtgttcataactgcggttatgcatggctatgaaaggggacctccacttccgctctctctagagtaagcatgtgtgagcactgacttcttccagggcctcagtgtgatctacacactccattcctggggatgctgctgcctcagtgtgatctacacactccatccctggagatgctacacaccctgcaacccagaagccagccaccagagctcacttgtacctcacttgtaacagctgagccttaattaatacatatcattattgattgaagaaggaaggaaaggggggaccaaaaggaagggagccatgaagttcatctcaatacttctgataggcaacttaaccatgaccagtcccaatgctagctggtatttccctaagatctttgttaaagattcctaggtctttctgtcacctttttttctggcatataggttttgttgttgttgttgttttggttttttggtttgtttttgtcccctcttcctcctttgggtgcttgcttaatttgaagacaactggttgttctcttctgaaaactgagtttcatcttccccacatccttgggatcaatactctttgttctaaaatgttgttccagagctgctagaaagtgtgtttggccttcagagcagggttagtggctacttataacccagcagaagtgcctgcatccgtccacccccacacacacctgtgttcctggagtttgtgaccgaggtaaacacttgttatctacccgtcttaaaatcaataaaactttatcatcacttcttcattctaacttccgagatcatcacagatggcccttgtcatccagccccccacacacttctttttgatgttgtctgtagctttatttactgaaccttgatgaaaacgaaaagaaagcagagttctgtggcaccatgcaagcacttgtgtgatagtcagctacctcttactaccatgttgtgtttaatttggggtcaatctgtgaagtcctctcacccgccgccattttgactgcttccccttccaacactatttgcacccccctttccacctcagtcctgtgggtagaacccaggacctcgtgcatgatagagaaatctgaaccagtggccccagtatctccagtctcctgttttccttttaaagtgccggtgaattggaagacaggctaaaaggttgcatccatgtatactgctggcttcagctagtgcactggcctgcctgccatctttgtaatgccactccaaaatgaatcaagttaattcaataacataatctgcattttctgaggttgcttgatatactagtaactaacctgtaaatgtgtaagcatcaagttttaatagttacttatatttttttctatttcccatcagatagatatttatctgcagctcttaccctgtttgaagatgggacaaagtgacctgacagcaattctgcaacattctgggtgttgtaggatggcctcaggctgaacagtgcttttcagtaactttgattcctcttagttcacctttgcatacagctaaaggtcttgcaaacaccccggggattggtggtgtctttgcttacacaggtaatcattttcttaaagcctgtcatacatgtgttagtatattaatcaaaacctgcaagactgacattataacctcactccatggccctggaaagccacattcccctctcattcctatctaggtcaactgtacaaacatgccacttttcaggctctttctccagaattcagaatgctgctttctttcacctcatatacaactcctgcttgtgagtgactctctcctttctccccaagataaacctggaaaggtacttcagaaagtcatacctgtgggtttgctaaccccaggaacactgggccagcttattcccagcctttgtgtgtctgattgtttccctttagccccctctttggtctgcacagcagaagaaaaggcagccaaaatactgctctcaagtagcattcactcaccaagctaaactgcacaagaacagtcaactggagctctttctgctttttctgggagctcagccagtcaaagcatcatctcctttacaatatagcacttatctggctaagtaacatagtatttttttctatatcaaaataacattacttggcattttttttaatttttatttttctatatacaaagggtagagtgtttgtgcttgtgttaaaaaaacagaggaaaaaaatattgatctgactaaaaattcagtttacggaacacacactaacagacggtgtgcactcattttgaaaaacatttctgtaaggttgagtagagcagaccacctgtggctagcaacaataggaagcactcattaaatgtttactatgttgcaggagggcacttttctatgggctttgagttttcattaatagccctctttacaaaaaggcatatgggctatttaccacaaaggaactcgggtatagtgtaagccatttaaatctcccgaggccccatagaaactaagctgcctacctgaatggaaaccctagtccatgcatctccaatttattctccactacctagacacatagactttaaaataggctgggttgatccaatatccatcatgttttgttggtgcatccttgacaaatgaactcccttgagcctcattttttcatctatgaattgaaaaactttagggcctgtcttttgaggttacctgacccatcatgactcctgctccatagtactttgtcattgccaacaatttgtcagtgataatgaatattttcagtggagaaatgccagtgttataccttcatttgccttgcctctctatgggaccacttgctccctccacttaacaaagagcacaccagcaactctgggagagaatttgactttcttcacctaaaagtgaacagtaagctagctgtagtgactcacccatccaatccccatcgaagaggctgagacaagaacattattgtctgtgtgaggccagcctgagctacagagtgagcataatgacttccaggaccacctgggctacagtgtggaccttgtctcaaaaactgcccatgttaataatcttgaattatttttttctgtttcattccagtaaaataagcataggccattgggtcaggaaacgtgatttatagttattcattgttggcatcttggtttcatttgatagaatgatgattagctatactgagaaagctgtttaatccaattaaatagtaagccagtaacttttcagcaatggaaatattaattgctgtccctttttatcttttttttgcaaatatgttcaatgtacactacagtgacaccttgttcaagacaaatcacacagtgaaagtttgactctgagtttagaatttttaatataatttttattataatttaatataatttgaagtatgatttaacttaaagtattattttaaattattattattattattattattattagcaatgattttattttaaggactcacgtctccagatataatggtcaagtataatgtgtctccctcataaaaatgtcataaattggtgtggctcatggctaaaaacaactgagaaagctcacccagagagaaacaactgagaccgtggcttgattgcctcaagcatttttgataaaactgcacagctcatttgcagttactttttttctcacttgttttaaggagttttgtcagctagtatatttctcaaatggcttttagctgcttatagaggattctctgataatttctggttaaacactcacacataatcaaagagaaccaggctctagaagattctgtgagttcacagtggacactactattccaagcctccttaacaggaacaactcgtgcagtattgatgcctgtcagcagatcagggacacagctgagaaaccccagggaaaattggtgcatatttgaccatctcactactatcgtagcatacgtggccaaactgttaaccctgcaaaaggatgccatcaaccacaaagtgcctgcttaaaaacctctctattgagctacagaagaaaaaaaaatctcaaaaccttctatacccataatggtttttaggatattttatattgaactgcattcttcactgccttcagctacatggggctgcgaataatctgagggccaaaggttcaacatgctggtcagggtttgaagccacccagtatggactgtaaaaatggacccaggttgtctgatgacgacttacgttaaacactgttgcagtatataacctgttctcagtgctgtttcttgatgctgaggtttagtcccagctacatttggctatttgggtaaagacatcatctattgagtagacaaagaagtaggatgccaagaagttcaaagcataaaatgagaggggctgacatcttcctattgggaaacaaaattaagagttttgtaaagtgctgtttgatgccatgtgctgagagtccagtggactgagatgtatgcagttcctgaggctgaagagcagatggactgcacatgaaagatgccactgggaaacccatgccatggctgttccaaagggcacgaggaattgagcacttggtgctcgggaaactctaagatgtttacaaacctaacgcagttgtcagtgatttaaaaccagggacactgtattttgtcattgtgcaaatatcacaaactgtacagttgacagctgaaacatcactaggccataaaatcatgtgcagtttctgcaatatatgtgtcccagccttgacagaaatattgtttgctacaaggctataattagtagaatacaacacagaagcataaatgctaaggagttccctgccaagtttatctgcaccccataaatggaccccagtgtcatccctagccaaaaacaccaaaatcactgttaaccctttctgttttctcgaagttccaaggattccctcgggtgagccacacccatcccttcccttcagcttacatcataaagagctttgctccttggagtgaaattgaccagtttccttgagcaccgatatgtcttatgattgttcatccagattcttatgtttctttatattactccatacatctggaaaggcaccaggtgtgcttcgtcatcatagagttaaaggcaatttagtcttctgtgtcaagattcaaagtaactaaaactattgaaaaagaaaactgtctgcttctctttactcatttgatgtttgcgtgtgagcacatacatatgtatgcatgcctatgcatatgtgtgtgtgtgcatgtatgcatacactcttgccatggcatgtgtatgcaggtcagagaacaactttcaggtgttgactttaacttcccaccttgttgaaacagagcctcgacggtttccactgcgcacactcccagctagctggcccgtgggcttctctggtttttattcctatctcatcaatggacagatctgattacagatgtgtgctatcacatctggatttttttatatgggttcccagaatgctctggtgatggaactcagatcttgggctgcttggcaaatgcttttacctgatgaaccatctccctagcaccaaaacaattatttcatcaaagaggctggatccgatgaatgtactaatctgaaatatgctctttgattcaaagccattccccccccccaaaatctggaatactgttacatcctaccatagcatgatagcttatcatatgatatctaaatattagaaaaatgcattttaactttttagatgcctctatattcaggttgttttaaatttggtatttactaagcttgttaaaaatctcaaggaaaaccttagcctttcatcatgaaattgtattcaactcttgactcaagtgttgctaaatttgcttttataacattgtttaatatagctatgtatggagaagtattcactcgtacagtaaaccaggtttaaagcccagctggtagcgtgtgattgctgaaacccaaacatcatggtttacacagtccatggtgtgaggattgctacttttcttccctgcccattgcttcttcttcctccccatcttttatttctgactatatatatatatatatatccattgtaacctacatgataagcaaaagcaatcatttcctcagtgaagaaaaactcctatgacactcacctattcgatgacatacacctatttttatgtttgattttctatagcacctgtgcagtaaaaccaatgaacagcttattgttttggttctatggttaatagtttttttgtgcactgttggctgtaaagcaacataaaaatgtgatgtgaagttagcaaggtttgaggaacaagtagaacataaacctcccagcggttctgtggctgtcccacagtagagccccagaccgtgctgcatggagcccttgagcgactccctcgacttcagagaatgtttgacttccaaattcacaaggccacagatttgccagctgagcaatatgtgtgtttgcaattgcaaggcagcttttagcagaagcatctcacggcctcactccacactatctgtctctctttgccctgtactttgtacaaactgataaaaagacaaatctgcttgtaaaataaatggtttgcaaactaaggaaaatgatgggattacatggaactgattctgcactttacataaaagtgtcaatattcaaaaacctgctagtgaacagtccatgctaccaaaaaaaaaaaaaaagtcaccattttccctgcttcccattagacttcttagaaacatataaacatatgtattcttgagtgtttatcctcaaaagttgaaatgagggaaaaagttctattcctttggagttgttggaatttccaaaatggagtcttagttacactgggactcattcaaaggacaaaaatcttcaatcatgctcttgtcttcacttttccataagacacctgaaaagctgttagtgttaaaaaatatttttgtcatctataggaattctgttatgtgcagacttggaagactgggggacaggcaggcaggctagcagctgtggttgactaaagcttcatggaaggccatacttactctttccctgacccagaaactaatgcaaattcatactgcgggttagaacactcctctagtgtctcgtgtgtccatagaaggctggtgaggatctaggacaaagcagagagttgtcctttccacaagtgagaccacttcttttttgtttacttttgacaatcaaagtaatgcttacttcatagaagctcaaaaattatggaaaaatatgacagtgttaaaatttatataaccttacatcccacaactcaaaattagtataggacctcctcatttttgcttagtaaatagcatgagaatagttgtctaaggaaaatgtcaacaaaataagaatcacacattggaaaagtaactcagagctgagttcttcagaattaaattctagaaattttcttattttttttctctttaacttcctgttactgtttgtgcatattttcttgcagaaacagaaatctagctaactcttttgataatatcctgtatttgggtgtgtggatagcccgtactatgcctgtcgtgtcttcaattctcccatatttggcacattcctttgaaaggcctgaatgagcactcccaatgttgcatgtttatgtagtgaggccagcttctgtgggtagctgtgggaagtgaagactattgttaagtgatatgaagtgctttgtagaatctgataatgtgtagttaagagggacgaagatcaagtgcttgagatttgtgaataacagtggaaagaactgagggctgtgtgctatgaccagagggatggggaggaggctgcatcttcaccctcctgtggaactctttcagagttcatctggtgctggtataagagatggtgagtgaggagaaatatgatggtccaacaagcaacttaaagtccaatggcgttgacctctacagtggacaacaagcataccaaatgcatgcggctttgcacatggtcatagaaacacggcggcaaggtcctgaagcttgtgttttaatgatgaaagcagaaatgtagatggaaggatataaccggggaaccccatgccaacactcacagatctttcattcccctagatgtgcaattttttttctaacgagaaactttgcatagtcatgataataaaatagaatagcatgataaaccttggctgcaaagaaagcaatagaaacagcatttaataagctagacatcacaggtccacagggtggataggttgccttatttggccataaattccctcaccttggaacttagacagcgcacatattaatggaacttagacagggcacatattattgcatagagaagagttattatgagatctgcaaagctgcttacgtatctttccacccaacgtactgatgtgacccaaacaaagcttacctgcatgtgctcacactctctccgaaagactacgcaaaggttctcgctagaaaaaaaaaatgtatatctaggggaatgaaagatctgtcagtgttggcatgggttcccaggtaattggctttaagcaaattttgctgttgggatagagcctcgcgatcctgaaaataaataaataaaaaacaagggcctttctctgaagtggcaatgctagctgccggctggaagcaaatcctgtgtcagggacggcactgaagcaagacagggcaggttctaaggcagtgattcagtggcctcctgctttcccatgtgactcattgttagtcagaaagttacctttgcagagagactggatagcatgtcagctcttaaagtgatactcgctctgtgcttaggtgtgaacctgggtttcccatgacaaatttaagacaggttactgctcttagattgtgttccttttctggcaatggaagtctgacctgtgaaagtctacagcaaacgaaaagaaaagcatcctcctttccaaagagcactgacagagttctagaccgctttgtaaagaaaaggggagcaagctccttcctggtgggtggggcacatcagctatgcagagtctgggccaaaagaccttttccattgagcatgatcacccagctaatcagatttgaaagtgctttcaggcttaggataaatggggaaaatattccaaaacatatgagcattcatcgcagaagtaaaacattctaagatattattgtggggcaagaaagaatcttacaattcttaagagaatttcaaagggtttccaaaaagaccttttaaggtttttatttttgtttaatttgtgaaactcattatttaaagctgcacataatatactccctagtataatatatttcatggtataaaattttggacataatgtccacgatatcttctagtctgtatgtttctataaatgggaatagagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggagagagagagagagagagagagagagagagagagagagagagagaaatagaaggaggaggagggggaggaggaggaggaggatcctggattggacatagtctttctatgaaacagagtaaacaacaaaacagaagtattctttcgaattgttgtgttcaaggttgttcactcttccgagggccatctccttcagcgttggatagcccgagcacagaagaaggagcaggaacaggttaaaatcagcctaaatactttgacttacatcaacctcagtgatttgcaagcccccccacttttttttacatcttaaatgtcttacaaatattcactcatctatcattgtcttagcatgtatcccaaaccaagactgtacaagaccgccgctgagaggacaaattcaaagtaaagcggccgtctcattctgtaacctccgtgttttcctgccctttcctcttcccatctggaagtagaattgcaaatactgctttgtatgctttatttctaactggtttcagcctgctctcctttcttctgcctctcactggctgtcatccactagactgcacatgaccagctggcccttggcagatcttgggcccaggtgtgaagtagctggagaagcattctgaagccaggatgggagtgatttcattttccattgatgctatgcagagatgaaggggattcaagtgcctcctgaaaagcttcctccagtgagtggagttttggggggtttccagacctgcaactgcttttattcttggaagcatcgttgttgccttttccctcttccatttatatcccaggaactgattcggaaaccatagaaattggatttggagttgctgaatgctagcagacagctgactgcactcttcccaagaaatcctgccagctggggaggcggggggaggtatgcagtgcgcccgctctctcttggctgctggggctgggtcctctcactccaatccagtcacatctcacagcactagaactaaagtgttttgcttcattctttagacattttgtggtttggggctcaatcaaccaggatatgatttccaatccaccataatcagttttggagcagctgcccaagtaggcagttttcatctggcttcctagacatttttttttttttgtaacttcacaccttttgtttattagccttgaagtccagtttccagagcaggatccatcatgctctctgcctacttgcaatgctgaatatgttagtaagttttaaatcactcaaaatatggcttcaatatattgtgaccacttagactggatataatcctatagaaatgacttcttgatgggaaatgtgaactgctcttatctggggagggatgagtttagttaggaggcttaaagtaagacaggatcaaacctgggcaagaattaacttgagaagctccttagatactttgttaaggagctttttaaagaaggattcatcattttatgttggcaactcactaaataaagggcaggtaaatagcatacttaggaggccttgggtgatgccaagtgtgggagacatttttgaaacaggaaggagctgagatgaattcccatatgacatgctcttctgtgcaaggattttttcacattacctcatttagtcgaaagtcacctgagggcgggaactggggtaggcacgcagatctcagagaaactgagtgatggagttgagctccctagctcgcactgaacagagctccacatagaactggagctctgggtgacatggatgaaaacacctgggctctactggctcatctgagatgttcttgctgatggtacaagatctctgtgtactagggaagtagcaactctcctgctggagactggaagcttcccttacaaacaatttcccaggtgaaagactagtgaggtacttgatggctagtctctgaaccctgctaggactcccagtgattcacctgaatgtcagactgcgttaagggtggtttagtcagagtattgtgacagctgcagccaggcgggtattttttccttttggagctcttcccaagttcagtgtgtctgtgatggtctgcacaagtagtcaaagacaggcatcaggcaggacacagaagtcttggccatgatgagagctgaagaaccaggtgactgagtcaggtaggatggaggggtaggatggcatacatggttgagggccgcttatggattctaatatgtaacacagttgatctgagaattgtcacttttaaccaggtgttctttcattgtccagattcaaccatgggtctgtctctgaggcagccagagaattctagtttgtagctgatacaaactagaaaccagggtctgaggtttcttgtctccctcagatgaaaatggcttttcctagcagctcctgaaacaaaatgcagtatgagtgaaaagcagctgagatgtggtcaatacacagattttatattctttgaaatcctgaggcatttgttaaaggaacagagtcagtgctgggatccggattcgctgtgtgcagtcttgtacaacatgcagactggtcgttgtactaaccacgaccttcaaatgctttctaagcaggaatcaggacgagtgtagtagcaaactccttggatcccagtacttacgagacggaggcaagtgagtctttacgagtttgaggctagcctggcctacacggtgagttctgggacaaccagagctacactgtgagatcctgtctcaaaatcgaattaatgataatcatcatcttcttctttttcatcatcatcaggaattggggttgtcacgatggttcagagagtcatcaggggagataaaattaaccctgataaacctagagtgaccctgtagtagacgttgtagagttaagaataggcagcgtgtagaccctggcacagttgtcattgagaagactatggtggcagtgagcagcaaccctgtgctatgtagaaagaattttgaaagtcaagctagaaagagactttgttatttagacctcagttaaacagaaagttcaatgaattagaataaacatctaataatgacatagtactaacagtactgctatgcttgtgccagatgtatcatggctgtaataatcccagggaccatctccaagccatcacatagcaaaaggattctgcaaggggaaacatctcagaactccctggcccctgagttgattggagagtgattttagtctcttttttttttaatctcaaagtgcactctgatgtagatgaacgacatgtgtttgatttttggacaagtaaattgtctcctcttcaccagtgtcttttcagtatgcctccttgacagagcagcaaaaaggaaaaggccattagaaatttatatagatatgctacttgacccaagatcattatttaccaatccaacctttgtttcataggttggctggaaagtgatgtttggttcaaattaaaaacattcatggatttcagctttgacaaagaccctaaggtaatttaataagcagctgggcagtgtttgggctcctttggcatttaaataatgtatttttcttgggtgtagcttcaagtccttttcagatgccacaaacatctagggaacagactgaacaccctgtagctgtaaccctaggatctgagagcatggagcacataaggacagatctcttcccagcattctgtttgaaaagttcccaaagtgactctaatgtgtagccatgccaaaagatgctttccaaacagataccaacagtggttcttgctgcttctgtcctcatttaacatatccttctcaacttacaaagagaggtactgtcatttttgaatacagaaagatgtaaaaaggcattattgccgtgccactcaatagtttcaatgatatcgaattttatatctgtgttagagctttacattttacacttacacttaaccttatcaatttataatactaattaatccataattataataattaattcttttataattttacttataataatattaattattttcaataatttgaaattaaaattattaattataaaaaataatcaataattgtattactttatacaattttattaacatattactttatattgtgtaattagaaatgtcttttgaaacttaaaaatctatggttttgtaacaaggaaccattaacgttgattggaaatacattctcatctactgtaatctaaccaatgaagaaagtattaatccatgtgtttgtgatttattctttattatatggacaattctaaacatattgtaacctgtaacagaatttgagagacagaattgtaataaaaatactgcagcaatttatttgcattgtggtgagttcacatgaaaattttatttactttaacatagtatcttaaatgtcactaaatcttggcttggatgaagttataataaaagcatctcagatacttgatggcccaatgtacttcagcccactggtagttttagaaatatgaactgggtacattgtatttcacatatcaggattataattgtgttgagcacattgcccacacaaagtaaatatccagtcagtgattactatttttatgatttctgtttagcaaatatttattatctccttactacatttaagaatttatgtttatcaacagctagtatttgagctattttatcttttaaaaatagatttggcaatcagttcacaggagagagaactgactcatactctaaaaaccagggtttttccagaagtcttctggagataccggggctgttggagcatctggcacacatttccatcccagatcctctctacacactcaagttagtgctctgaagatccagtcagttctctacatggaatttgcccatgccatccccattttccatggtccctctgtctctcatctgattccactcatataacaacctgccaggactttctgctgaatagtatagctggtttgcccatggatttcataaatgtaatggagacttgggtctgtaagctttatgatctcccaggaatcatagattgatagagcttttcagtttatgtaactgtagatcatgtgtagaaaaatacacaccaacagccacactttctaactgtttgcagctagaaacaaaaatattcctaagtgtcaattactcatgtactttaatttgcaaggtggttcatgcttactgatataaccttatctaatgtgacctggaaacagactccaattatgttaaaagaagcagaattctcctaggaaataaaggcaagcagcatcattttcagaaagacacaatttcttgagttctgtaattctcagctctggaatccgggattccctgccttgtttgtgtctgctctgtagcaggccactgagatcctgctgccctcaacccactctgtcagatctctggtgaggggggtgcagtgtacctcaccttcttcaggtcatttagtgggcatctggaaagtactgttagctaaaacacagtatttggtctcttagtgccttcccatgcgcacacactgctggacccccatctgaaatcaacagatgagctgccagctgtgcaatttgatgattattacaaaccaatcagctcagattgggagaagaggctaccatttcaactccagcatgctttgtgctttcttaacaccttgcctagtgttcatggaagtctgttttcctgctttggagttgtatataaatggaaacaattgtccagcccatttcctttgctcctggtttctttctcttacagtatggaaatgcttcccttatggctccatgtagtcatggtgctttcggttcctgtggtggacggccccattatacgagtgtcatgttgtgtttgtccatcctgctgctgatagatttggccactgtttccccattttgggtggctatgtatgttgggtggctgtgtatgttgtcacatgtgctcttagaacacctttgtgtttgctcctgctgagtgctaaagctgggacactgggtcattgggcaactttaaaagttttgatagatgtgaattataatcctcaagagacatttggcagtttctgttgcactaaatctttcccagaacccgctgatgtcccactcctttatttacctatattgatgagtatgtttcctgaaattctgataaccaaagttctccaccttacacttgcaaaactacttgtgatgtcaacatcagggtagagccctaagccatacgcaagtcctagagtcagacaaggaaggcttttaatgccatatctgtccttgcccacttactatgtaatatacctgaacctcagtttctcattttataaatcacacaatggagggaaagataaatgatgtgatgtcaaaaaaactagaagacccgaagtgtaatgaacaccgtcatctttgtccttcatgcccttcgcccgcagtctatttttttttttttttttgtaaaacacacagccttatttctacactgatgtggataccctctaggaaagggctggggtgtctctgtagccatgagctgttcagaggataagatgggaagttgctttgacttcttcctttccctggaggatgtgcattttcatagcgttgctagggacattcgttatattacagagggatgcttacagagagcttggcagtcacctaaccccaggatcccttcacctgaagctggttcttccagagaatcccacaggtagcctattgtttaaaggtaactagaactcagaatcctctgtctagttctagcaatctttgcacagtattcttgcctttaatgacaaggcatcaatcaacttgtaagcagtaacaaaaaaataataattttggactaattacagtttctgtaacgggatgaaaaaaatttcaagttgttcccaataaagcctaaatattccagataaataagtgatgtaattgttcatcattcttgaagaggaacttgtggattcttttattgataggatttgtcaactaggatgggaatgtgggataatgaatgtttgctgaaccaatgtgtaaaagagcaacctctgtagtgcccagtgaaagatgcaacaccatccagaaggaagcaggtccactttttctggtaaaattcctactgtgtgactcccacattcagcagacaccttatagtttagcttatcaacaaaaataaaacaaacaagataacttgacaaaataagtgacctctgggtttgagtgttatcactaagggaacatttgacactagtgaagcatccatcatcagacacaggagaaaactcatttgggtgacagaggaacttcccaggaagattggcactgacctacttcactgccctctataagacagaggcagccatgaagtcacgttgtgcacagcattcactgtaggcactttgcaggaaacactaccctctgatgtttgcatgcatctctttgtaggtggtgactctgagggacatagagtgatttgcatgaagccatattaagcgggcgtgggagggttccaaagtttccaggctagattttgtagatagagaagttttgaaattactgtcatgattctgatgccaggattactttgagagatgatctgtgtagaattgggccttgaacatgttaaatggagtgattgtgcaagactggcttctaccagttgggtgattatgcctgtaaattccatatagtcagggtctcttgctgtgaatttatttctatattctcacctcagaacaggtggtcttaaagtttctagcccaagttaatgttggaatgtgcactttatatatatataatgaatacaggcaattattctttcaggcttgaagctacgaaactaaagcaaggcaagctaagtagataactagagatagtgttgtaaaagccagtcacctaggttggcctcagtttttctgtgacactggtgtgggtctttgtcctctctgactactaacaggatgactttctgcaatctctgacagcacctacaacagcatgttctccatgccacagtccctgtcctgccacacaccccatgtttttctgtttatgcatgggtgaccctaaatggttatttgtgacctatctgtactttctagtattccacttgaataatccagcttactacatggatactgagcaattttataaattgcaataaagttactctcttgctcttgagttgacaaataatgacttccattgttttgtccaaaggttattcactcttacagaggaaagaaaaatattaccacgaggatgtgtatgtggtgataacccatttggaaaggcatccatgtattttccccttcaatggttaatgagggggtcccatgagaaaggttaacctgaactatttcaggtctttattctcgaactatcagctcattaaagacaaagtgctcagcactaaatgggatgtctacattaactcgcctcaccccacaaggcaacatcatagatgagggtgcagaaacaaggtaaaagccagaggataggaagcaatgctgccttctgcacatgactcggctgttacattcatgcacccacagagctgtggtcacctccacaagacctgcataggatcaagtcagtcaaattttttgaataatttatttttattcactttacatcctgctcacagccccctccctcctctcctctcagccctgtcctcacaaattcctttcccccattacctccttctcttgtcctcagagaagggatagatcacccttgggttctaccccaccctgggacatctagtcctaggaggactaagcacatcctctcctactgaggcccagccaggcagcctatgtagggggaaggagatctgatggcaggcaacagagtcagagatagtccccctccaattgttaggggacccacatacagaccaagctgcacaactgttacaaatacatagggggcctagatccaacctctgtatgctctttagttagtgattcagtctctgtgagcctatgtgagtctctgtaggttgaagttacttgactctgtaggttgtcttggtgtccttgacccctctggctcagtggttggtgaaggtcccatgaagtcctaccatcagctaagaagctattagcagttgatggcttctgagagaagaagaattatttccattggtattgtggcttctagaaatctccacattcaccagtcaatggccccacactcatgcacatataggcagcagtaattcaactcagtgggttattggagatggagcaggaaacatgaaattgagagggatatatgttgactggtgtcggaaggaaagtttaggtcaggaaagtgagaggtgaatatgatcaaaatatgtatgaatgaaattgtcaaaggtaaattaaatatttttaaaaaggaaaaccttgatgagaataacccaggcagctttagggagagaaacttacaaggtgccttggttgacagattagataacatgcttctggtcaagttaattgcctgtttgctgcaagctagaactttgctgaactggtttacacgacagaaagagataagtgaattttcttgtgagagcctggaatattccatgaactaaatccaagtgttacaacacaaggaaatgtcgcggatggttcagggtaatgaaatctctaacgtaaaaacaaaagttcttcatgtcatcctcgttggaaattctctataatccaaactcctgaaaactttggtgtttatgggcataaataaaattggagataaaactcagaaagcagagagaacataaactattcttcaaactcacaggagcatcctctccttccccctcctccccctctcccccattgcttctgtgctttcagaggccctggaagaaaagcaaagagcacatgtcagctcttcagacagatagctcacatgtcgtttccatgacaccttgtgtttccctgcttagatgcctttttgaccatcagacatgtctcagacaagttcaccttgcattgataggagggactaagaggctgtgttctatcagagtctttgatctcataaccaggaaactatgtgtcctctgccagcctgccttgtcttcctctctatgcctctcctcaccagaaccagcttctccttccttcatttccactggtacttgtttagaggatggctattaaacatggtctagaaatgcagcctgccacagcagaattggtctgttttggattacaacgctttcctgagtaacttgagtcaaactgaagttaatattagaacttcttccaagagcaggaaagcatagaaacttcagctttcaccagccattaattccacaaatgtatttagcatctgggtagtggtgactggatctgaacggaaataaaaactgacttggggagtctttgtaatgggaggcatctcacagaagagcagtccttccctttgagcagtggttctcaaccttcttaatgccatgaccctttaatacagttcctcatgttgtggtgacgcccccattataaagttactacttttctacaatcattgctacttcaaaactgtaatttttctgctgttatgaatcttaatgtaaatctctcatatgcaggacatctgatatgtggcccatgtgaaagggtcagtcgactcctccaatgaggtcaaaacccatgggttgacgctgtagagccttctaagccttcactatatccagaagcctggctttacaattctgtatctccagcgctccttgttccagctatccagccttactgttggtttatgtgtcctcagaagcccccctgtgaataatgtgagcctttattgcacagttctggccacatcacctcttcttctcaacctgaggcagtttcaggtcatctgtgcctcctggcttctcagctgcactgagcccacacctaggagaggatgtgttcacatcaggctgctgcagaaaggtggtgggggtgggggtaagcaaccacacacacacacacacacacacacacacacatccctctgctattagacaaatgcaaaacaaaaacgaacaaacaaacaaaaaccaaatcctttccctgaggcagaggctctgagatagacccccaatctcagaggtcaatctcctgctagtcagtgctatctcatttcccacagacgctgttgtaactggacattcggcagctgcattttgggtctcccttcatcatgcccctcacttctgtctgtttagttttctgtttgctcttctctccctggttctgatcctgcccagcaatgcatcattcttcacggtacagctcaagcctcaaaatcctctggaaatcctgtcatctgctaaccagagcagagctctctgacctgttgtgaaaggtaatggttagagcagtcctgtagcttgaggccaggccatctgagtggcctgtcatgccatctatcactcagtgctggcaccatgcgtggtgtcagtaagtggctgtcaatgtatgaacagattaggcagtcactagtttacaatagcatagcttttcaagcaaagtctcattaaagtaatccacatggtaagctattttcaaatgaagacaaggctagtctgtgatcaacaaaacctaattaaggctgggtaatgattttccacctttagatagtacgattgctgtagaaaggtggttctcaatctgtgggtcccgacccttttgtgtatcacatactgttaggattcatgacagtagcaaaatgacagttatgaagtagcaatgaagattatggttggcaccacctcaaaataagcaactgtattaaaagttcgcagaattagaaaggttgagaaacactgctataaaagacattgaaatcaacacaagcattcagtaaaacctgtacacacccaagcgcctcaaatcgagatgaaataatgaatagtttacagaaaatgtacaactgtatttccactgattgattgcattcctgaagaaaattattcttagttgctacgaagacatatgtatctcctaatgcttccatggtactttgagtttttggcctcttttacaaagcagtgtagtattgatgactggcgaaggtcagctgccttacttttgtgatgttaccaaaaataatgttgcaattccagataatctcttcagaaaagttaggtttccttgggaggggatgagcaagagaacacatctagcctaacctccccaaatcaaaccacagccaccagctctggcagtggtacccaaactatctgcatgtctcattaactggatgtgcatctctatggaaggaagcattaccgcggttctgagaaagaggcacctacatcctcaagtcttcatctccccttcccatcctcacccttccctctacccacacaacatctgtagtagttttaaactaaaagcacaaattactgtaaaagtgaactgaaattacaaagaaatgcttgtgtagaaaactctcttggcttcaggggggaaaaaatcttctctgagtggtcattcagcagcctagaagcagttcattggaagcgactcatggcacccttgggagcgacccccttcctcctctgctgcaaaggcttgtcagcgggccagagtaaacaacttcagaccaaattgagttaagacataaagtacacacttagagtcgttcacttctccagtttctggcttcagcctccccgcagacagcttaaaagtaaaaacaaaacttactttagggcttagggcttattgaaacacatccatcccacaagccctctgccttcctgccactgaatgggcgctggaaaggaccctcctgcattggccttccaggcgcatgcccgagtccatgatgcctgcaccagtattagcatcctttgttgtcaggtttaaccagataaccagggaagcaaggctagtgcaagaagacaggaagtggtttcctatctcctggagtgattcattgcgcttcgacttggtattcagacataccaaggggtatgcctctttcatttgtactggggttctgccacctcatttcacactccactcttcctcgcacctaattagcagagtctctagacttgtcactatccctgactgaagttactttcattgtggaacttcttggaaactgccttgtcactcccaggtttaagagcacctgaggtgtctccttgcaacttgcctatagctgtccttgaagggaagaaaatccaaatagtttgttaccggtggataatgacagcctagttcatggagccctgaagactgcttaagaacgggtgatgaggaaattcacaaaagctatcagtagttgaggcagagttatttatttttttttaagaatatatgaagtgggctctgtgacttgcttgggcaattctgtatgtatgtatgtatgtatgtatgtatgtatgtatgtatgtatgtatgtatgtatgtattcatgtccacaatagttacaatgaggtgattccaaggttaatgcatcaataatcattgaaaatgaaggtgttcttttttttttttttcctactgaatttacaggctcttagggtgtgataggaatctaaagcccaagcaagacagagcaaggaaaagtacttcctggtctaaactttggaactgactaccaaccctgccctcttatttgtcaatgctgaaggtaaaagctagatgctaagtgctctgccactgaactatagagccagtgtctcacttccttagccacactggacttgagcttatgattgtcttgcctcagccatctgagtggctgggactacaagcttgtgacaccagtccctgtgccacattatctcattaagaaacagaataaactgtgaaatagcggaatgtttctcactaaatgtgagcaacttcacacagagagagagctacgagtatacagaaccagaaagagcagctagacctaggcccttgagaggtcctgtgcagagaagcctgggaggcctgaaaaggaggggactctacaggaacgcaatgggctgagaacagtagtgagaagcattgttttaaaatgccagcagggccagaaggtggacagagagacgtgagctatgtttgtgctgtgccaagagaagttaagatacagcaagtttcagtaaacataagaaataactgcaccatagagatggcaatatgagagaaagtaggggcaggagggggagggggagatcattccattcttagaaggcaggattactagaagtgctttaagtggggtgaaatctatgtctatagtgatgtccagcacacaccacaagcaaacaactatacagctttttcctaccatctttcagtatcttgtatcttacagtgattactctgtttagtcaataatgaaataaggaaagtttaagcctaagaaagtctcttacgatgaacccttagaaaaatctatcattgagccaggcagtagtgactcactcctttaatcctagccctaaggaggcagaggcaggtggatctctgtgttcaaggccagcctggtctacagagggagttccagaacaggcagtactgcacagaaaaaccttgtctcgaaaaacaaaacaaaagaaaaaagaaaaatctatcactacagtcaatgttctctctaactgtacaggaacaggggtgtctaactatagactttctgactttttgtaagcctcctttaaagcaggctggtaaaatacagcaggagtttggatccatcctgccacctgcttttgtaaatgaagcttcatgagagcacagagacctccgcatctgcacaactacactctgtgtgaccttttcggagaaactgtgctcaccctgtctagaacttcatacataatgctgcagactccctctggtagacttccatgagcaaagtagaaagccagttctggtgggcataagccctcagtatttgtacagacacttgggccatttactaacaagtggcaatgcctaagaacacaaactcttttttttttctttttcttttcttttcttttcttttttttaattttttattttattttattgtaattaagtattttcttcatttacatttccaatgctatccccaaagtcccccataccctcccccgaccacccactcccacttcttggccctggcattcccttgtactggggcatataaagtttgcaagaccaatgggcctctctttccactgatggccaactaggccatcttctgatacatatgcagctagagacacagctctgggggtactggttagttcatattgttgttccacctatagggttgcagacccctttagctccttgggtactttctctagctcctccattgggggccctgtggtccatccaaaagctgactgtgagcatccacttcagtgtttactaggccccggcatagtctcacaagagacagctatatcagggtcctttcagcaaaatcttactagtgtgtgcaatggtgtcagtgtttggaggctgattatgggatggatccccgggtatggcagtctctacatgatccatcctttcgtctcagctccaaactttgtctctgtaactccttccatgagtgttttgttctgaattcttttttttttctttttcttttttttttccattttttattaggtatttagctcatttacatttccaatgctataccaaaagtcctccatacccacccacccccactcccctacccacccactccccctttttggccctggtgttcccctgtactggggcatataaagtttgcgtgtccaatgggcctctctttccagtgatggccgactaggccatcttttgatacatatgcagctagagtcaagagctccagggtactggttagttcataatgttgttccacctatagggttgcagatccctttagctccttgggttctttctctagctcctccattgggagccctgtgatccatccattagctgactgtgagcatccacttctgtgtttgctaggccccggcatagtctaagaagggacaaagtgtccacactttggtcttcattcttcttgagtttcatgtgttttgcaatttgtatcttatatcttgggtattctaagtttctgggctaatatccatttattagtgagtacatatcatgtgaattcttttgtgattgggttacctcactcaggatgatgccctccaggtccatccatttggctaggaatttcataaattcattctttttaatagctgagtagtactccattgtgtaaatgtaccacattttctgtatccatttctctgttgaggggcatctgggttctttccagcttctgactattataaataaggctgctatgaacatagtggagcatgtgtccttcttaccagttggaacatcttctggatatatgcccaggagaggtatttcgggatcctccggtagtactatgaccaattttctgagggactgccagactgatttccagagtggctgtacaagcttgcaatccccccaacaatggaggagtgttcctctttctccacatcctcgccagcatctgttgtcacctgaattttttatcttagccattctgactggtgtgaggtgaaatctcagtgttgttttgatttgcatttccctgatgattaagaatgctgaacatttttaggtacttctcagccattcggtattcctcaggtgagaattctttgtttagctctgagccccatttttaatggggttatttgattttctggagtccaccttcttgagttctttatatatattggatattagtcttctatctgatttaggactggtaaagatcctttcccaatctgttggtggtctctttgtcttattgacggtgtcttttgccttacagaagcttttcaatagcctccaccatagaaaggtgaccacaacctagaaggaacaaaacagcaagcccattgagatggcttttggagcccaagttcaaattgttatgtgacagagcttggcttgggcttttcatgagagaatttggtagttgttaatgttttttgagtaggtttttgtttttgtttttgtttcccataatgagtgaatcctgaaaatgagctttgaattcaagatgtctaagagaatctcaggcctccttactgggaggaacgatgccagattcagctctcctctacaacctaccatagccttttacccatttaagaatcaaacaaagagatacttagtctaactaggagtaagtgaaaaggttgctcattttcaagggcaactgaatacaaacatgtgcaaacaaagcacacaaatccaaatcaacttagttttggttgtgagcctagtctttatataatcaacgtagaaaaccactgcaaagggtcaggaaagacccgttactgaatgaaaaataacaacaggggaaaacattccaagaggcaagtggggactccttgtgaaagaattttgcaaggctcttggaggcttggctttcttactgccaagtgccttagcacaccccatctggtaagacttgggcccagtcaccttcctgatgggccatggccacatccctgccatccgggtgggcagttagctgtggtcagtattagctatccctccctctgtggcaagaccttatagatcttagaaaggccacacaccagcagtgtgagcagcaggccaagaaggtcagcctcctctgagagcgcttgaacggaaggaagcaattcacgctagtgggaaatgatccagatttaattcagattcaagccacagtggggtttagtaagggttttccacgtatcacgtgctttgccagggactctcccaactcaccaaatcctcccagagtcatagtaattgttttgttcctgtttaatagatgaaaataagaggctcagagggattaggaagtttctcagataaagggaaaaacagggttttagtcctgacttgtcactgcgagtgtagtaaccactgacaagtgccaggaaaagtctggttcaagtcactctgtagtcaaacatctagggggttattttactctctctctcttcttctcattttgattttgaaacactttttttgatgaagacacacacactgctatctgttttaagtagctgtgagacctgccttgttctgtaacttgactaacagctagcttaccactgctttcactggtgagatcaggccagcaatttgtttaaagattcttttctcccttttaaaagcatctgtagtacagagaacagtcttagtctgaaagaacaatagaagctggacttgggtgcaccttcggtcttggccggcagctctgtctcggtatataggttcatgctcagcctacttcatcccccagctactcttccagtagttgccttctttctgaacttcagcatcatcaccgctaactactcatttaggtccagtgtcttgtcctttctttttattttctgtgataagaggaactgtgtacttgtttgttagcttgtttttctagtgctcatggtagaacaacataaaagtgcatatgtttccagagatgaccttatatatgacagtgcattaaaatcggacttttgaaaaccatgagtaaaaacaggaaagcatataatctgtcttgtggtgaggactgcactgcatggctccctgtccagaatctctctgcagagatttgttccaatctaatttccagtcccattttctggatcagaattcttttatttccttgcaaattaaacaccttgtccaagattacttttgatttataattcatataaataatgtaaactatattcctaagtaatgatgtaggcaatgatctggaggagaggaatgcagagaaaaaaaaacataaaaatggaagacacacacacacacacacagtttttcaagtggaaaattgaggcactggtaaggtctctgaattcaacactgacacttatagccaatttattcctttgatctgatgttgtgttttcacttgtttaccaagggaagttggagtatttctttctggtacctggagcttggtaatatctcctccagctgccttgttatattcatttagcatggctcacattatgggatgttctacagctactacatgtttcatgtcatttcctcaaaggattattggattccttgagtcagtatttctgattcactcttggcaactatctttgttctgctatattaaacatgtaggtcgatggattaactaaagagtaaacagaagaaaggacaacttagagcataggcatttgtaggcctccccaagtgagtgctaggaatcaaactggagtcctctgaaagagcagcatgtactcttaaccactgagccaactgttctcaatctcattactactcatttactactaccctgtgaaataggtaaaaccagtctcatgttacatatccagttagtacactgagtggggttaactgtttggagacaacatgggacaatacaagactgtgtggcagtcttgctaagagaaaggtatttgatgatgtcattggaaatatagtcttctgtccttcataaacctgcccttcctataactcaatgaatgaagaaatgaatgagcagaagaaagagcaacctctcaagcctgtgaagaaaacaaaagagtaaggtaaaccttacttgttggctgcagagttgttctaggttctggccccacacgtcccgatgcctgttggccatatatggcatccacatgaattctaaaggaatggttcaaggttgaacagcccgatctgggaaacattactcagccatcatcatcagggagtgagtcattgaacctgaggaagatatgaaagaggatttatgtgagctgggtggggactgggcctagagtaaggacatcttacagacctgtctcacattgccttggtaggaaagacatagatggtgaaggcatattgaggaagagacaccacaccctggtggaaacacgcaaccctcccaacaaaaagaagctcttcaggaaaacagccaggcaaagacatgtgctccaaggccttggcaacactggatagtgagagtagactccagctcatggcacacaggctagtaaggctggattccaactaaacactagcctttcataattccaaagtgttttctgatgtctagtcctccactacacagactgaagagaggtcataggtgactggtagttggcctcaacaaagagctttctaagattcagtaaaaacctgtttcccttgaagccaaattggtcaggtttcaaagccaatgttcatgcaatcatttttatcaccagcctgtgaggattctgtattttcacctttctgccactgctccagattagagtttatataataaccgtgtatgtcccttagtacttacgcattcaaactctccattcctttcccatcatgtgtcctagcatcccatgatagcaggaagcaaatgttaggagctaacttatactcattgtagattttctctgaggtcttgtgtggaagagccccccagctttcagccataggagggaggtagccgtgctcgctacttccttgaagtcttgactgaactcagacattgaaactgtgagattcggtggcagtgctgatggagtgttgtttgtgactccatgctgccagacatagtgagctgaaatcctctgagaatggcaagctctgaataaataggtcagagtcatcaaaatgccacagaggcaaagagtggaagtagaagtttgattggcaggcttcaggaaaggaagtattatattccctgcagaagtgtacctctgtgtgaagaaacagctatccccataattgtgtaagtagtagtgaggctagagaactagaactcagaacccagagaggagtgctcacttgctcaagctccaagaagaagctgagcacagtaacaccccaccggttactctatatctccatgtaaacagacgttcaaccagggccactttctccatggtgccccgctcagcagaagtactccaaccctttcagttcttgtttgctgtgaatctgcttttcttaccttatgagtttgtgtcaagagtattttccaacagtgtagataattgggggaaatgtttgctagggtaatgtcaggtactcagtggtccttattgaattaattaataattgtctagcaagacaaatttatttctgatttaccattcaacttcttgtgaagaatgggatagattgacctgtgatttcagattttcagttaaagaagcagtagtgggaaggaggttgctagtatcattgaagacatataaacagaaatatctagaaatgtcactgctaccataaagcctcagtgaggcacataacttgtattaagagaagaataaaatttgtaaggcacatttttgtccacaatctttcttttttataatttttaaatttaaaatatgcatatatgtgtgtctctttggaggactggatgcacagcttcagtacccaagaatgtaggaaaatggtgttgggtttgcaagagctgcagagcaagcacttatgagcatgcccatgctagtgctggaaaccaaagtggagtcctctaaaagagtaacaaatgtcttacccacagaactatctctctagccccctgttcacaatcttattacactcacaattaccctattagagaggtacaactggtctcctttgacctggtgagcacattgagaggagttaacttgatggagatggcagtcttgctaacagaatggtatttgatgatgtcattgaaaacataatcttccgtccctcataaaactgcccttcctgtagaaatttcatctacctcctaaggaagtatgacaaaatgtacaaaggaattctaacactaattggtgtggacattcttagatgttcaaaatttgttttgaaattatttataggctacagaggagaatcgtgggggtagaagtcaactcatcttgatgtttgctttcccagctcaaaatgcaagaaatgttattttaatgtgctttgcttgttaacataattgggttgttttagttttcaagagtgtaatcatgctacaacatgtcatggttagcaccacacatttattaaaacataaaaagcaaattaagaaaaacataagagagctcttctctttgagtattacatctgtctgtatttctaacctgcaatatggatatggcttgacacatatgtgactgtgtctgcaaactgaaaaccatttcctagttgtaacagaaaataaaacagctaagagaagctctgaagatcgctttgtaaagtgttggggtagcccagtcaacaagagccaggtgggtctgagagaagttaaaggcatgtgcatgggtcaaaaatccagtagaaaagtaactaacaggggtccacagctatacagtttgtggacccagacagaagctcctgtttatggtaatgacaccaggaaatgctctgacagctcagacccaggtcttgtgtgatgtggtctctgcttgaaaatggaatgctttgtagaaaacagcacaagaacaaaagaaacaactagagaggtgtcagggagacatttccaagaaaccagtaatgttggcagccagtaatgtacagttgaggacaaaaatatgttaaaacaattatgaatttatttgggtacttctaaactatgagagtgaatttggaggcctctggataagcttatcttatgctgtgtgttaattagtctaagagctgtatatgcagtatttgcacagaggagcaagagcctaccatataagcccaggaatcctgcacaaagaagacaggtttttcttagttctccagttaagtggaagtttccttaagagaaaaaaataaccaaacttcgaatcaacccttggaatcttaagaaaccacacagataaattctcctactgcatgcctggaatctgtcacaaaggcaaagattaatccccgaaatgctggtatgtgcaatgcatccaacttaaagggttgtatttcataaatccatttctgtgacactccattgtggacacaaccacactgcagtgaaaatatgtagaaataaattgtgtctggtatggaccaagctaacctgggaaggaagactcaggaagacagtgacagtttctatcatgaaaggattttaggttgtttttggatatatgcttgtttgaatcatgcacagttcctcaaatacagctgtaaacacactgaactgtgccatgagtcaaagtgaagctcacttgtgtttccccttattttaaaatacagttcaaggaaccagatggacctgggtatcagtgtggtacagtgtggtgaagtgttcacattgggaggttcacattgtaactccttcagtttatatatatatttataaatgtttgtgctaccgcttgaggcccagaagctaagtgctttgaagacccgagtcacccaacctttgttctttattggtagcacttgccctggatttgcaagatggaagtcaaattcctacatcctttatggaacttgaagccctttggaatgtctagttttctcacggatagtcctaacataatatgaaaattcacttctaataaatagcttcaatattcaacaccaaactgggtgtttgtgagattcttaaaatatgagaatatttttgccttccttttgatactctgatctgataaatattctacaaagtagctgtttaccgatacttacagctgagcagtgactatgcagatgtgcagccccagtgtgcagtgcctgtggtcctaacatcagcctgtatgcatttcaaaagaaattattaacaattccattcactcagaggccttctctcttgttatgtcatattgtgctaacattctcagtagtgacaggaatggaattctttcaataaaacaaaattgaagattcttgcttacttctccatcttcaaacaattctgggaggataatattattgttatcactgcgtcatctctgaggcttaagggttcaaggaatcaattcaaggacatacagtggggaagaggtctccatcaactttcttctggtttaataaatcaaacacaaaaatccttctttctagaggtaggagagtctcagtggtagagtgtttgaagtacgagggaccagtcttcaaactccaattttgatgaaactgtagttattattttcaataattttacttatgttattgacactccatttgctttttattatagatttaaaatttaggatgcactcttcaggtagaggcagataaatttctttgattttgaggtcagcctggtctatcactgtttcaagttaaccagtgctatggtgataagacaattgcaaaaagaaaaaaaatattttaaggttaactatttggtcaaaagacagagccaaatgatgttttctttcaattaggcaatttagatcaaatacttccattgttgtgtttccacccctactactgccccgcacagctgtgtgtgtgtgtgtgtgtgtgtgtgtgtgtgtgtgtgtgtgtgtgtgtgtgcgcgcgcccgttggcatgtctgtgtgcctgtgtgtccttctactgagatatacttccttctcctttatgaacttattctcatcttcagccttgacctcatttgcatgttgtcatctcttaggaacataaaaagagagacggcctcaagatgaacagaattgattgtgatttcttttgaaacaagaacttaacccatatatatgtcaatgtagacttgactttagtaagtcatataaaatatcaatctcttccttattctcaaacagaggcctattgggtgggactgtgagcacttaggtttcttttaaattttatgcaccatattaaaaaagtaataaacgatgtacataacacagttttaaaattttagttttttttttcctcagaatacatttttcaacatggaatcgtggtttagaatttaacatatttgtttttaaaaagtttctcagttgtttcccaaagtgttttctgaattaatatctacaccaataatgagtaatgctgctattactcccaaacataaaatctttcttttcctgggtattagagtgacctatcctaactacagatactaaagtatctgtatgcacaaataagtgcttcaaatgcttgcttatcattttgaatagatgaatgacatacaattactttttttataatgcactaatctcacatggcgggttttgacttctgtttgaagaaagttataattagcttagtaataaagaaaaaccttagtgcaaaccaaaagaaagtggcaaggtaaagtagttggtgattttaaataaaattaaatatatttctgcgtgctgagaaataccatctgaactggtcccagcaccagcaggttctgcaaactgcactgatgtggagaacaagactaaccagacgtggtgactagggccacagttgatcagtaggaactaaaagcaaaggctacctgtgagttagaaagatggctgctaatcaatgatgtgatgatggaaaagtagcgtatgattgtccaaccactacacctacatttatcgtgacatcttaaggaccaagaatcggtatataaacttgcgctatctgtatgcacagaagcagttgtttcaagtagaagcaaacatcagagcagtgtacactcttagtaaaagcagaccagacatactgggtcaagtccaaatcatatttggaaaaattactacggacttaccctgccattacaggtaggagattgggacccaatcctgtcagttttcacagttccctgacatctgctgaattagtagaagaaaatggaaggggagtagagagattcccatggagttaaagaagatgagaagattgcttcgtagtgtctgtaaatgccttgggttgattttgtggtgtctgaacatgtgctggttgcttactgtggctccatcatacaaggccagacagatgatgctcatagaacaacccaaggggagggaacaaaggagcctataaaacagagacgtgcattgtaaaagtacctgaagaaagtaccactgtgttgacattggccttattttgtgctctgtaccctggttactgtgactatcaagggagcaactctggcaacacagaaggatctggccagttctaaatgtaatgtctaaacctagaggccatatttcttcactcttgggataattttggttcaaagtatatcccttaacaagctccctgcttcaaaagctccaagcctctttgttttgttatacttgcctaaacatgtctcccccaaagcaaggttgtaaataccattttattacggtcttctcctttgcttttaaatgtagactactgagtacattaatgtagtctaactctggccactaatttctgtgttttcttgaattaatttgtgtcttgacaagctttatattggcagagcatataaggcaaacatggataactgtgttgggtggattaatacaatgtgaagaaaggacagaaagacatggtggtttcctactagcctactgctttaaagtattgtcttttcttttctttttttttaatgttctgggtattttataatcagaactttaattttacctttgacaattcagaggaatgtttttagtttctagacaggtgacttttaaaatcccatcgttgtccttgttttagggtatacagaattgtgattagaaaacattgcctattgagtgttatgttcttggagattcacgtatacgtaataatgtaaaacttattttctaagaagtaaaatgtccattgcattgttattaacttaccttgaaactgtaacattcacataggtttgatgggcatctttctctataggcactcttaagtctatcctgtattaaagactgctatggttaatcttgactgtcaacttgacaagatttagaatcaccacagaaacaaacatctgggcataacggtgaaccatcttctagattagattgatgtagaaaggtagatgatatcattccataactgaggtcctaaaactaaataaaaaggaaaaggggaactgagtggtccccatctctcttgattcctgactctggatgcaactgtttcaaccttctattgccctgcctttcccaccatagccaactgtcttccctaaaactagaagcctgcacaaacccttccctccttaacagtttttgtcacgggttttgtcacagaaacaagataagtaatgaacacaaaacttctatagactctccatcctctacccccttgaacttttaatgttttgtttactctgtatctttaatatcacatgattgcatgcatcacagggatgagttctgccttactatggattacagctgtgtaaacttaaacatctcttaccacatcagcgttgtggtggctttgatcaaagttgattgtaagccagtgtggctcccaaagttgatgattattgttttgttgtggtttactaccatactcagaatcttctgaaagacctctttcctttttattctagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaaggttagttcattgaattttgtcaccctaaattatgatcagtcatgatcagactgaggctgtagacaaatttgacttacgatatgcaacttcatgctgggcgtggtggcgcatgcctttaatcccagcactcaggaggcagaggcaggcggatttctgagttcgaggccagcttggtctacaaagtgagttccaggacagccagggctacacagagaaaccctgtctcaaaaaaccaaaaataaataaattaattaattaattaaattaaatgaaaaagatatgcaacttcatctgaggggagccaccactcccagggactaccagtgggttttatgagaagtccactctgccagctaggaccactgtttgtggaaggtgaagttatttgtgaaaaagaaaatagaacagaaacccacctgatgtcccacagtcctcatagacactagcactgactgctggccatcgtctcagccagatgatgttgacctgctagcttttcaattaaattattaaatgataaattttacttagttttgaggtatgcacctatgtatgtggtataaacacttacaccatagctatcagtaatttataaggactttacaaaactcctgaacattcctaccaagccattaggagccacctcagaagaatttgaatttgatttgcaaatgctttgggtttatctcgcctttatttcttttattccctccccatcccccatttttccttccacaagaaatcatagttgatatgttcaaggtaattcttttcacttccattttcatttgggtcaaagtgggagtcacagcacgttaaatgacatactgtacctttatttgggcctccaatgcaaacacaaaagaatcgttgcaagcctgccacaccctccacccaagtgcattgtctaagtgtcttaggttttctgccacgtgaatgttatcttgaagttaaatgggctcctggacccacttcttgttcactccagagcaaactgataagcgttttttcctccattagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacagggtaagaggcaaagaagcatcaaggcagaggtggattctgatggccattggtaacaggaatattgagttggaaagagatttcagccaggtaaaaactagttcttccacagacgaggaataatatccatgttttcagaaatccagtcagccttggtaagtgagagtttataggaaggaaacttgagccagtagcagagagggcattcggtcaccccctcatattccaagacagttcagatgtctgaaacatcagttattgcaagccatacataccatgactttttctgtatcagtatgactcttgtcactcaattcattgattaggcacagaaagatactaacaacaataatgaaaactaacagaagagttcgagtgctgcaaccaatgcttgtgaatttggtcatttgatgtctttaccaaagtggactaaaagcagttgaacactgagacctatgggagaggggtctaatgtacttcaaaaatttccatgatagagaagcaggcctcaaggttaatattgttacataaaacctcaggttgagttagggaaagaagggaagggtttgaagttgaaaaggaaactggagaagatgattgaaatgaggataaacagcaagtccaaaccccggcccccacccccacttcataaaatgtttctcaagtcagtaactcacttaatgctaaggtcttctttcacagcatgtattgtacactaacattttacagagaaaggcatggaaataagagagctctctcaaagccctgtgcccaggcctggttctgtcatctctgtgtgccctgcctttctgatggggtagcaaagtggactgggaaggggatggggtgcaaaagatagaatgtagagtggaagccgagcagtatgtagccatgccactgaagtgaggaactcagccagccagacacttccttccccagccccctgctttatcaccctataaactgctttcagaattcccacccaccattctaactactctgagcacccacgcacgtttctgtatttgtgcttacattcatctctcccatatacacattgcatgaaacggcctgtttggcacttttggcatgccttgttctgcctgccttgccgcatacgtgtgtctcctggagccaggctgtctgtgctccaccactcagcacccaaacaaccttgatgtgctactctacgttgctgtttgacctcttacctagggttcctcatgtttctttctatcataccactgtcacctctactttccaggctgagctccacatcagccctttctggtttgcctgccttccttctaaatttcttccatcccctgtcatctgtaaagagaactgctacctgtcccagatctgctgttctgctttgaatctctgtctcctggaagctgtctgcacttttgaacatgtacaatctcctctccttgtcaccctagcagtctccacacgcttccccagaaaatccccccccccccccccgttccatgccagcactgtgcagacaggagcatccattccctgcatgtgcagagctgaagtcacttttgtgtctattgttgggtttctccacatttatggtttatactttcaattttaactattggatatgtgtatgagtgggatgtgcccatggaaaccagaaccataggatcctcaggagttgaagttacaggcagttgtgaaccaccactgtgggtgcctaggacccaaaccccggtcccctggaagggcagtgtatgctgtcaacaactgagctgtctcttcagtctttttcccacattaaatgatagccattgggccttggtaaggattaatggaggtaatgtctatatatatatatatatatatatatatatatatatatatatatatatatcatctagcccaattctcagtcctgtctcctctggacacctatctctttgtgcatttcaattctcagagagaagcctgtaagtcaaagtcatctttgcaggccagagcatctgtgggttttgtgcacgtgtatcattccatgtttatggccaatgtttctgttgtcaccttctccctttgaacaagttggactttttctcaaccccgactttgtaatgtcgtctcctttcttcttccaaacaactgtagagctttatatgttcttgcaccactggtatttctttgagtcttcctcatgcataaaattcttgtttctaatcacgctcagactctttccttctttggtggaaatcctccaatggcacctgaaactagacccagtgacagtcactctgttttggtcttaaaattccaaatgattttaccttctaccttgtccttctgccatgacttcccctccacatcacccacccattccactccaactgagatgactccagaactagaagtcatcatatgtctgtctttcctgccgtgcacattgtataagcctccccccccctactgcatttgtaaatttcacaacacagtcatcaaagaatcctaagtctttcaggtctttcaggtcagtctcatgaagaaattcttcacatatccctagcaggtcttctacagggtctttgggtgggggcatctatatttgcactctggaaacattaaacagaacatcagaaatgtaaagacataagcatgtgtactgtgtgaattaataggaggcaaagggccctgatcactgtggttcaattcatgcagaaatcctgattggtgctgtgcgattcagcaacaaccccatcctctgcaatatggatactatccagtggagggacatcgtccaaaacgtctttatgagcaacatgtcaatggacttacagagccatccgagcagttgtaagcgcgccttttaccttttattatcttcagatcctctggtgggctgaaatggagtgttggggtaggagagagcatattaactttagatcacattcattaacatacaagaaaagtaagtagtaagcaaatgctctttgcattggaggagattttatgcaagacaataatataaatatttttccattgttcaatacaacatccatcatggtagaaccttcataaaactattgaacagagagaaatttctctatggtgcaagttgcagtggcggtctgctggtacaaggaatctcccattccacctcttacagtggcacagaggtcatcctgataacgtgggctctgctcatcagcttatcagtgtaaacattctaacacagaaccagaaaggagggctctccatattttcctaaatgttctcatccatgccctaatcctcaggcaaccccctgcaactgagggccctgcagagggccaactaagcttagggatgcaacctgtgccctttgctaacaccatctctggaatgacatgttttcacttaacaaaactccaccaaacctgttcttcctaatagtactgacctttcaatacttgaatataaagcatggcctcattttctactgtcctgttcctgtaattgtgggctgcatacagggtgagtttggacctctagtggaagggacatgaatcacaaaaatatcaactaaaactttctaacttaatagctgtatttttattaatgcattgaaaaatgtagaaaaatctgacaccatggtctttttatgtgacagtctaggagcattatgtgtctacactgttttgcagctataaccaccaaccatcttcaaattttacaaatctgaaactctgagctcattaaacagtaatgacctattttctttttctcccaggcaatccaaacctcctttatgtacctatgaatttgactactgtaggtacctcatgagagtggaatcgtatgctttttttgtggtttagtgtctggtttacttcatttgattaaatgaccccaaaatttattcgtattgtagtttatgctaggaatttttttttcaaggcttaaaatattttgttattggctgtactaccatttgtttatctctttataggcacttgggttgactctctgaataatattactgtgagtgtgggtattaagttttttgttttgtaaatatatatcctaccagctacacactgtgacattgagcatgtaagaaactgaacagtattttacaatggatttttgttattacctatgaaatcaaggttagcagttcttaagatttttgatgttcaataggtgaactaagtcatacatatttaaaatattacatggagagttatggagctgaatttgccacagttaaaatcaagtaccttacaatggcaaatttatactcattgatatatgaaaaacccacaaaggaatgttgaaaaacagtatacaagattcaaatgttttaacatttgatctctgacctgaaaaggtattaatttaataatatttagctctctgttactagaataaaaatgccttagtttacaggcaaggtttacttgggctcgctgctttgcagctttcctccacagtcagttggccatagtgttctggagcctatggtgagcccatgtgtcatgatggtgccataatcacaagagaaaggaggagagatcaggattggcttgctccttcaaagaccctgccttcagtggctgagattccagtactgccacccttttttcccctaatatagcattttatttattatttgagaattgcacacatgtatataagtaattgtgatcatattcaatccccttttttttttccaattcctctgttccccatgccctcatcccaattttatatcttgttaaaataatccactgaatacaatcagtgctgcacatatgtgcatggatgtaggacatccactggagcatccttaaccaaccaggggccacaccctcttccagcagtcagggatgagttctcatgatcccttcccccacccatgctggaatgttgacaggcttggtcatatgcagggcttaggcaggcagccacagctgctgagagttcctgagaagaacagatgtgctgtgtccagatgttgtctcgcagcagtcttccctgggctctggttcttatcatcttcccaccctcttttctgtgatgttcttagagccttaggagtgtgggctgtgtggcagatattctatttatggctgactattccataggcacttactctctgcactttggcacttgagagtctctgtagtaatcgttatctaacacacaaagaagcctctctgatgaggactgagcactaatgactgtagagataagtatttggagggcagcttgatgatgtgtctgtgtagcaaaataatagtagtcagttcttcccgagagctcaggagctcttgagccatgggatcctggccaaatttgcagtaccaggcacagtgtccatctgtggagtaggtcttaagtcaagctaaagaatggttagtttctcctcataacgttcgcacacatcttgccaggtagtcattagtcctatctcttaaagtccccatcacctctctgtgccataaagcgtgaacctctaggagtcgttacgtattcaaactatagcactcatcatgagaataagcctaagtgaaccaaaattgcataaataagtgacatttcaagtaagagttgattcagtaaattgttctgcagtgccaatgattaagggacaaatagcccaagtattagagctataacagatttttaaaaacaactagaaaatgagagttatatatattagaagatagggaatctctatcccctggatctcttccttctactctcctcattgaatagctgcagatgcgcgttccttttgagaagtttgcacttcatctttaacaacaaaatcagtattatgaggtggctttaaatgctatacatgtgaggcatctgagattcagaagagcagcccactgtggccaacatattttatcattgataaagtttacaaattgaggttataagagtgaatttatgagaaagaaaaaaaacataaaatcatcagctactccatgcatcaatataagttccaaatatgtattaagtatatgtaagtatatataaataaatatgttatatttatacaaaatataggtgtagttctagaaggaaacatgaggataaatatttatagtatcaagtatcaagttgcaaagagagttctgacaccgtcaaataagcttccatgtgaaataaaattgttctgtgagataagattgcccgaagagggctacagaactaagcagagtggtctctacaagcctaatggaggtggtaagtaagcagcaccacaaaaaagtgaaggcgagaaaagtaaatgtgcttcccagaaagaaattctcaacatctgtgctggtcaacatgttgatcgtcagttctcaggatgattaatggctgaatagaaaccctttgcagctgcaacttgatattgaccaactataaaaatacaaatatttagcaattacaaagatttccagacagtagtatgccagctattaactaaggttttaggtgattagccaagtgactcacagaattagaatgttcgcttcctgtgtcatgttctgcaccacttcatggcttggaggaaaggagtgttcatttaccagactcaacataacatcctaaatatctagtgatgattgccccacacagtcagtcaagactgaatgtagcaaggtgcataagtgtacattgagcggatctggttagagagaagcctaatcaggtggcacctccgaaaccctaaattcattagctttgtcatttgtgtggctgtgacaagtcagtaagtaacctctgtctcagcttccacagctgaagtacaagcaaaagcagcccaaggctcaccattttttcttttgtgcaggagtcctttaatttagcttacaaagcatccaacccaactatgaatacaaagtttccaagctgttcctcatttctaggacattctttaggaccttgagagagttgtcagttgcgtgttatttgttacttttattgaaatgcacatttaactacttgatttttatttcaggccccaaatgtgatccaagctgtcccaatggaagctgctggggaggaggagaggagaactgccagaaatgtaagtcagtgcagcatcagggcctgagaaacatgccctggtgagggagtccacacagtatgtggtcctccactcctccgctttgtgactgaacaagtacaggagcttggcaaaagactcagagttaaccacttcatgagcatcagtcttggaaacatcacagtgcacaactatctaaggcttactacgtgggataatttaacctgtcattaaatgcaagaaagccaaccacccaagtgtccatggtgacacacaggatgccttgtcccctgatccaatcctccccgttttccagagccaactaatatagaagtttgacggtgttgctccacagagttcatgtgtgaatcctactaacttaaaaaacaaagtttaatttacttcagcatggttactgcttcactcaaagaacctgggcgtgtgtcagcttcaaaattgactgtagttcattgcctttgtgacctaactatctcgttcctttaaacactgcctcctgccaggagctcttcttgctatgtgccttctgtattgccagaaattccctagataatatctacttattcaaaagatctgatcagacttgtttcgattatttctcccaagtgatttgagataaatgataaaaatgtaccaaggggaaagttgtgattatattgtttggctgactgtgaaagcctagaagctgctccctgtcacaaaacccatggttcctcctttatttctttctactgggtgcaagcattccttggtgtctctagaagatgagctgccacttaaacacagctcactggtaatctttctttttcagtgaccaaaatcatctgtgcccagcaatgttcccatcgctgtcgtggcaggtcccccagtgactgctgccacaaccaatgtgctgcggggtgtacagggccccgagagagtgactgtctggtaagactctggctactggggagttgtgctgcagagctgtgcacgtgctcgacatctgactgtgacagcagccttcatgtggtgcacattttaattaagtgttgtcatggacaacagtagcaacattatgagaaatgaagggagctcttcttctgtaagaccccctgagaaccatcccagttacccagacctttgggcagtatggcatgtgcacaccatattttcatgcctcttgggctgctcccctcctaatcctaccccatcccacagtgtctcccctcagaccctctacctctggtgaaagctctagtgttaactttgcagctgtcaggggttagtgaatgtgattcctggggtccttgccaacccaagcaaactccattaggctccagaaaaggaagtccacctaaaggtagagtctagagtattctatcattctggaacagaagattcttaaattctataaactaaacctagctccaggcatcttttttttttcacctgggtagtctggtctgattcaaatgggcagcccggggataaaactacaaatggagttcttagaaagatccaacagctctctacatggaatcttcttgctaagatttctgcagtttgtccataaattataaaatatattcttatagtgttctttatgaaagaaacccagtaaaaactgagtttaaaaatagttacagcatactttccaatatcatgtgtagatttcattattaccttttttttaaccacaaaccctaggctgtatcaattgagacagtcagtatacttaaaaatgtatacttagtactcataagaggaaggtgtttctgactatcctggaaaggcttactagacatttttcctctctaattgagcatgtaaaacaccgaaaactgtcactgtcccactgacctgcaggctgcctggcactgggttcctttcatttggatgccacatccttgaccagacatgttgtccctcctatgacaggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgtgagtttgccctttcacccaacagtcctcatttcctcttctgtcttatgctagagtcctgggcagtttggaggcagccactgtgcttgccttgttgtcctgtaggctagtgtctgcctggacaggtgcaaggatgagaaccccactcagtgctgagcaatggaggcagaggcagcctgcagcagtcaggatgccttcctttaaagggtggcttgacctgcactgatccagtgttgctggcagccagactgtatagtacaaaccacctatcgcttcaccccaagtcagagaggaagcttcagtaacctggagtgtcttggagctgactaacacaaggtcgtgaccctctgggacaacctttgtttgactctgcattgtttgactctgcattaaacagacctaaattagaaaaggcagcagacccacccccttgaggagaagaatttagggctatggctgggctcttggagtattttggttttgggtttgctttgatttactcatttgggttcaagttttattcatgtatgatggtactctatggtacctataggaaaatggcaacatagatcggtcccaaacagagaaagtgaaacaactcataaagagccttaaaaccaatcttgacttctagaaagtaaattaagacaaaaaaaaatgtaaagtggaaactataagggtgagattttgcctacctagatttaggtgattgaagtcccattagaaaacacacacagagaggggaggggaggaagagggagagggagagagagggggagggagagggggagggagagggggaggaagagggagagctagagaataaggtaaatggaaaactaagatgaagaaaaactcatgacagtcatgccatagatagaatctttgtgtgaaggcttagtaacagatctttaaactctgcaggaaacaaaacctatgatgacaagagcatatgactcacagatatagtaccaatgcccacattttgagcatgtatttcagaaactcaaaataggagcatagagtttctagtaatactgtaatcataaatattaattaggttagactacataaaggtgaagggagtggagagaaagattggggcgcctgtctaggaagcagaacaaactggtcccctcgttgtcccaccaagaactgcatggtggatgggtggggaagggcaaagctggtatcaaacagaagaaactgtagttacctcaatgggacatggtctgtctgataagcattagtgtgtgtgtactacatatcttaggtttccttgtatattctaagcatagacctgtcagaggaaattcatattcagcaaggggctttcagccagtgaacacgcatggtggtgtttcctctcatagctgttttgcacctgagatcaagtatctgtgtttgtccacattactgtcagaaaagccattagactagagcttggttcctcttctacttgaaatctgtcagtctttctcctcaaagagaagtcaaccaaactaagagggacctttttagcagcccatacacagcaggacatgaggatgtttgtggaaggttaggagcacctgctgtagccttcaacaccttcttttcattgcctcttcctcaggaaactacgtggtgacagatcatggctcatgtgtccgagcctgtgggcctgactactacgaagtggaagaagatggcatccgcaagtgtaaaaaatgtgatgggccctgtcgcaaaggtaagcagtagggtttttttcttgatctttgtgccgaactcttatggccacctccaaataaacccaccttttaatctttttttaaaaaaatatatttattttgtctggaaagtagaaggtaaacttgcaaagccaaattgcatggtggaggtgggggagttctcttgaaccaggtacagaggcgccacctgcagcccaggtgggtgaactgttgtagccagagagaggcggagccaatgtctttgtgagtgactagattcagtacagccagaacattcaaatctgacagaggtctgtgacaaggacagcccaagtgccactccagtgactgaagggaacagcgaagcctgtcacaggagtcctggcacctggagggtcccctcagggttgttgggatgaatcaatagtgcacggtagcagggttcttgcttccgcttgtgcagacccagccttcttaattcacattcttaattcacatctctcttaacagtttgtaatggcataggcattggtgaatttaaagacacactctccataaatgctacaaacatcaaacacttcaaatactgcactgccatcagcggggaccttcacatcctgccagtggcctttaaggggtgagtaacagctgagccatctggatgaagaactgtagaatctgctttaagccacggagagtgtccaataatcacgttgctgtctgtttcagggattctttcacgcgcactcctcctctagacccacgagaactagaaattctaaaaaccgtaaaggaaataacaggtttgtactcgggtgtgcaggagcatatatgggaaattaaattttatagcgactcccagacatttccctttcttccctgacatgagaatgtggtgtctgcagcttatccattatgagtaattcttcgagacatttttaaaaaccagtttcccttgatgcaaattgaaagcactttaagccacggctgctgcaatcatgctggacttgatgtggacacatggagcggttctttcctgcttagactgtccatcgtccttacagaccccaaaacccccagagagaagatggaggaaaagatacaaggttgacgctaacaggcagtgcaggctctcgagtttcacaaactagatttcaaaagattgtccaccagggagtcttgggtctatgactgccaccagcatgccattttcgtcatctatgaaggggagataatttgatctgaaaaacaggattaatatgaggatcagagttaaatggaaaaaaatatttaaaaggagaccatggtaacaagagactggagaagagtcagaaaaggatccaggtgtataatctgatattccttatggatgtcagagccagagcacttgtcacctgctcaggtgggagttggcctacgcattgagggaagggcagccagggactctaggttgcatagaaaggacaggattctttcatatatatatatatatatatatatatatatatatatatatatatatatatgaaatatatatatatatatatgaaatatatatatgtgtgtgtgtgtgtgtgtgtgtgtatgtatgtatgtatgatatatatatcacctggacctgtgtgaggacatgcactatcatccttggtgataggaacaggaagaatccactgccacggtccatacagcagccttatctgagtcctagaacacgcttcctacaacaaggaaatttctaacagtgtgagtctaagcctttcttcttccctctaggctttttgctgattcaggcttggcctgataactggactgacctccatgctttcgagaacctagaaataatacgtggcagaacaaagcaacagtaagttggccataacaaaagcctagtagaattttttccccaagattgtcaaaagaaacagaaataggacaaagaccgatcttctactcggcttcccctaatgtgagcaacttatgtgagtagatatgaaagttaagataaataatttgacaaggtgccatgttcttccctggaccatgtacttcattctgagtttaccagattttccacgaatgcatccattcttttctgtcctctccaggatcccacactgcattaatgtctgatgtcttcctagttcccttcaaactttcccagctcctatatctttgctgatttttgttgtcttgacactctgggaaaatatgactgggtgttttatagggcatctccttgtttgtgtttggttaatatttgataatgaggcagttgaagacacataacttgtcacaccagggagacagagaagatgggagacaggtgaagagctttcctagagtaagagaaatcctaagatttgtggtgaggaaaagaaatctggaaatctgtagctcaaatctgtcttggaaactttctaattatgatagctttttctgacatttaccaccactaacatcactaatcccactaatattgtggaatatttaacaagtcaaagcacatacacacagaatatacattgctgcccataaactcctttaaataggcacttctgatactaagcatgccactgcttttgcttcctgcctttcctcttaaattctcaggaatgctctcgttctgaggttagcaccgtgtttcaagcgactgcacaagagacttagccttaattttaagcatttaagctatgggataaccactagttcctgacatgactcacagaaagctgggacttgacctgcaggaaagaccccagccagaccctgactccttggcttttctggacatacgctgggggagaattcccagtaagtgatggttgtggatctcctacccagacccctcacttccctgaaaacaggctgtggggaaagataattcatgaagggggaaatgagaataagcatgactaggaagagggtctgccaaatactactttaaactttgatatttaaccccatagcttccattctcttcttttgtcctggctcagctggctcattcctgaggctagtgtcaagaagatgcctacaaatgcacaccgcttctatgtgcatttccatcagtcacatgtgacaaattgtgcctagcaggggcatacatttgagctctgacctcaaccatgatcctgagtctgtctccctgccctcgccaagtgcacacatcctgcagagtcctgtgatttgggactccattctctcttatctgactaagtttcatccagacacatatctgcagaatcttatttaatcaaatatgaggtatcatgacttgaacatcacccttccatgctcttcctccatggctctccttcagtgttcacccatggctgacccagtcctcactaacgctgcatttatttctatggactcaaaaaaaacctctgccggtgtgattatatcacctttagacagagtccctaagtaaaagagacaaatatttaacctgtgtggtatttgcaaatggaaccacagatattcactcaataaacatgactgggcagctgagtggtaggcagatggacagatattcatatttaccttaagtacattttgatgttgccagatgctagaaagcatgttcttgatttctaggaaaactataaatatagcaaatgaaatgacatgaatcctctgattaactcctcctgtttatccaagtttaaagataaaaagcaaatgagaaactgtcttttctttgaagaaatctataaaaaaacccttgcattttttaaaacgttgtgattcatacttttcgcagaatgattagtaataactggaacacaggattcaggaaacataagtggcccagaaaaactgaatttgaggatggcccattgctttcgctatcacacaacagtgcaattttcttctctcccatttagtggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcagtaagtagctggtcccctctcacctgcacagatagttcccggaggtaacttagttttggaagacatactgaagaggttttcaccaaacattctaattgcttttgctcattccttcattgaattaaaatctgcatattcctaattgtaacgctagcatcagaattgtttccagaatgttctcatctcatagggtgaatttgccttgtggggtttcaacgtgaaatgtccttcataggctcatgggtctggacactgagtccctagctaactgtgctgtttggaatggttgtaagacccttggaaggtggatctttcctggaggaaggcaggctcgaggactccacttagtgtgtattctctgcttcctataattgcaatgagatcatctgtttcttcgtacttctgttggcatgcttttcctgtcatgattgattgaaccccttccttaactgtaaatcaaaatgaacccgtccctccttaagttgctcatgtccagtatttggttgcaataacgagaaaagcagtaaagaaaatggatgccaaacagaggagccttggctttgacgaatttgaggatgtggctcttagccctttggggctagcttgtgggaggaatgtagagaagttcggaactttgtctgagaaagccccagaattttctaagccatcctggtgggagtttggaagatcataatgctgagagaaatatgaacagtaaaaaccagatccgttaggtctcagaggagaatcaggacactgttcgaaagtgagctaaaggccatttgtggtacatgatgataatgaatctggctgtatctgcccatgtcctgagaacataagtcactagaaagcaatgacccaatttgattggtggaggatatctcaaaacagaaagaatagcattcagtctcctgctcgtggttcttatccaggactacagagtcctggagaggaaagtggacagagagataggaaaatatgcagtttgatgggcaaaggagaaaatttaaaggtgcatgtaagccaggtgctgaggaagcaattgtaactgtaaagatattagcactattaaagagaaaccttgtataatcacactgagacaataggaaaaaggtgctctgaaggcaagaccccatctcccaaaaggtacatcttatgcaaatgtacattcatttgaaagaagagagccaaaactgagaattctgctgaagatatttcctgcttctagaggccaggctacatctttagctggccactccaatgggcagcctcatccatggggtgctggttttatacacgtgaaagatacaggattgaagggggcatggaagcctgtgccaagattacagaaggccaggcaagccaggtggtgtttggcaggcttggagttgtgaatggaggctacgtgagactgtaaagatgaagcttgagtggcaatgggcactctaggattttagagatgtcagcacggtggaatgcctgctaaggaagaccgcaggcgtggcacagagcaggctaaaggagtagcttttccacactgcaaggggcagacctggcagcacagaattatgaagacatgggtaattcttgggtagttctgctgagtttgttttactttagtcttcgtctttctttgctgtgccctgattctacttgttgacatgggaacatctactatgtgccattgcatgttggaagtttgtgattactttttgattgcacagaagccaatagttaaaagatgtctttgagtcttgagagaaaaataagacttgaggcttttgaacaatattgatagtgttaacaatttatcaagggcaagtgagatggctgagctgagagaacattgttaccaagcctggcatcctgagttctattcccaggactcacatggaggaaggagagaactgactccaacaaataggattctgagacacacacacacacacacacacacacacacacacacacacacacacaggagtgggggggggcatgggaatgcataccctctacaaaaaataaataaataatgtggtctgttaaagacttaagaatatggaatgaacatacttttcattataaagtggtcataatcctatgtggcctgggagcatggagtgcagcagaagggatgctgtggtttgagtatattcccagcaggctcatgtgtttgaacacttggtctcttgcttctaccactgtgatgggcagtatcccttcttaaactgttatccaaagaaaccacttcctctcttaatgtgtggtcaaatcaatgaataaggtaacatatgttctatggtctaggctactaaatatctgtaattttgaaagcaagttgtagtactccttatattatattttaactgcagatagttctgtgtgtacattatccttcaattactatagccaaatacacatgcacacatgtatgcacatatacacatcgaagaatttcacatttctattcctaactctggttttaaaacattggattagcttttgaaactggcaactacccctggatttggaacaggactctgaactctggcagaggcaatactgtgttccggaactcctctggcccacatgggcttcaaggaacttgtcttgcatattttaatcacttctggcctctgattcccattcatacatgatgatttcagtgtccctcagtgacacggaattctgtatgggaagctcttggcatggtgcccagcactctgcaagcacctacaaccttccctggcgtttctgtccgctgcaacatccatcaccaaaatctccccagagtcaggttgaagctgccctgaacactacagagaagagaggccttggtgtcctgttgtctccagaaccccaatatgtcttgtgaagggcacacaacccctcaaaggggtgtcacttcttctgatcacttttgttactgtttactaactgatcctatgaatcactgtgtcttctcagaggccgtgaaccacgtctgcaatcctttatgctcctcggaaggctgctggggccctgagcccagggactgtgtctcctgccagaatgtgagcagaggcagggagtgcgtggagaaatgcaacatcctggaggggtgagacattgtgctttcagcctctttgtaactaaaaaataagacaccacactgattttagagtttgtagttatccgagttaagttattctttttcttttgttcttgatattatctttgttttatgtttgtcttctggcaaaatgttcatcatattagaaagtaagtttctcatggttctttaatccaactgatcatttatcatgtctctttttctgaaaatattttaaaatttcattttacaagaatttctcaggatagagcaggaacagtgactgaggcagctaagaagcatgggaatttggcctttcctttccaattcctattcccgctgaattacgatgtatcatcatagagtatatcctattgaattttagttttatgtacactgagcatacaagattattgattgatgtattaaatgatttttaatacaaccaggaacaaggaagtaattgatatatctgtttagtttagtttaatagtaatcaatacaaagctcagaatatgtgtacactgagaatttcaatatctgtgtaaacttttaagtttctgctgataatgcttaaaataagttatttggaaactagatggaagggacagagagtggcttttttttttaatttaaggaaatagggaaagctatggtgagaagagccatgtgacttacagacgatgctgagaagtcatccatcctgttccagtaacagggtgtgggcgacaggttgtatccagaaatatttcagagcagggtggaaagacaagtttgtgtgagttcctgatgctgtcttagtgaacttaggacaactgttatagctgatgtgtgagttcctgatgctgtcttagtgaacttaggacaactgttatagctgatgtgtgagttcctgatgctgtcttagtgaacttaggacaactgttatagctgatgtgtgagttcctgatgctgtcttagtgaacttaggacaactgttatagctgatgtgtgagttcctgatgctgtcttagtgaacttaggacaactgttatagctgatgtgtgagttcctgatgctgtcttagtgaacttaggacaactgttatagctgatgtgtgagttcctgatgctgtcttggtgaacttaggacaactgttatagctgatgtgtgagttcctgatgctgtcttggtgaacttaggacaactgttatagctgatgtgtgagttcctgatgctgtcttggtgaacttaggacaactgttatagctgatgtgtgagttcctgatgctgtcttggtgaacttaggacaactgttatagctgatgtgtgagttcctgatgctgtcttggtgaacttaggacaactgttatagctgatgtgtgagttcctgatgctgtcttggtgaacttaggacaactgttatagctgatgtgtgaatgtgtggagggctgacatagtccttgctcttgtaaatagacactcacattttcagcttttaaatctcttcattgtatctagagacccaggtgtctcagtgggggatgcctggtgccctgcggcagcacctgaccactcttcaagctgtagcacttctgtgggagacgacaaataaacaaaactcagaaaaaaaaacccactctgggtttttaactactagtcagttggctgtggtttgatctgtctatataggaactacatccaatgtgctcattggcttcttttgtacacttctgagtttcacagaagtgagtaatagcaaaaggcaggtgggaccctctactgccacaatccttattcatgacttgtctattgatatctttagctctataagtcttcgtgctattgcataggctgccttgtaggcctcttaaatgatacagtgagtgtacaagtctagcacactgggatcccctagcccttagtagcacatggtgcagcctcaagaaggaactatctaatggttttctcagtccctgacaatgattactgttgtaattcttggctccaggatgtctgagacccttgcttctaaaatcttggcactactctggaactctttcagcaaccatgatctccagtttctcctgctctgtaaagtcttccatccttcagcctcagctcgccatcctttctacttccatcatccccatcatgtctgtttggcccctctcaagctgttcagctgcctcttcttcacctgtcaagcagctggccactgtcacttctgcaggtcagcctatgaccactgctccatggcctcttccggcttgccttctatcccttctgcttcgtttttgatgctgccagcacagcttgaactactgaagtaggcaaaggaaagaccacttggatgaagtctgctattggattaatgtatctagcattacagtaccaggagaggcaggacacaggaagatgttttccagagcacccagaagtgtacaggcctgattattttcctatgccttggccttagtaaccatttctttccagcttgaatttggtcttagagggaaaagatgtttcataaagatgtttttcagagttgtttttcttacctagcattcaaaagttatgcctataaaaaaatgtcagaaaagaactcttgattataaatgaagatgtctgtgggatgatctaaggttctgttagtagacctcagcacattatatttcaaagcagttccagcattctgaccctttgaccttaagcttcttttgaatttctgggataggtcatttgtgttacttgaaatagtcatgactattcagggtatggcatgatctgttcatgtgctcttctttcagggaaccaagggagtttgtggaaaattctgaatgcatccagtgccatccagaatgtctgccccaggccatgaacatcacctgtacaggcagggtaagagccctttgctgttgcccactcttgacagcatcaacagaagtatcaatgatccaagccatccccaggagggaagatggccgtgcaagcccttttcagggaagaaatgcccctggtctgatcatgaaaggtggccattctgagaagaaatgcctcacacctgcctatccagtgtcacacatacatttcaccttgaccggtccttcagtgagccacaggacattctatgttggggcttaggcagtgatagacagctttcaatcaaacactagcaaagtattgttgcttaataaatcaaagttgcatttttaaaagaaattccagaattttttaaaaactcagttgcttatttttacatacagcagcaaactcataaggaatgtaagtgagaattctgggtcctctgacagcaataccctgttaatacttgatactatgcacaggcaggccttagtttcggtttgagttccaacaacaaagtctaaatcccctccctgaaacatgtttctgaaattgcccatcaatcaaggagcgtgtacccgagctgagttaagaaatctgggctgttttgcatgactggttacaaggtgaacccttggtctgcaggcttacagggcattggactgaatttccattggtacagaaaaataattgctgcctttgctttagtgttccagctgctctggctttgagtgtgttcagcctctgggtggacaaagctgaaccattaagagagtcaaaggaaaaagccttgcctaaccgctttatttcagtctccttatacagtgtgaagcacattacccaggcaatcccagtgccttcatttctcatgattttacaaggacattctaagttttacagacacaacctaacattacacattccattctgtcgccagcactgccatgggccacctttttttccctggagaaatacaaaagagggttgctcctcagcaggttgaagttggcttccctcagcaattcctcttaactccaaatgtaatacgcaagaaagataaggttgcaaagtacatgtcgaccaataaagatgattctgacaagtatggtgctcacggtgtcttaaaatactgtcaaaataaggccaagaatgtaatttaatttatgtttgggtataatgaatgcatttgctttttctacgaatatatttatagaactttgttagactagagcgactgaaaaatctaatggaaataaaatagcagctattctttctcagcagactataagattcaaataagatagattcgtgtaaatcatcactgttagcaaagagtacatgtgagagccagcaaaatgataaaggcactaggcgcccagtctgatgaattccatcaatgatccacacacaatggaaagaaatcaccaactctcaaaagctgcccactgacctctacattttcatccacaaacacataatgtaactacataattaattgattagttaattaattaattaatttaaaagcttatatttttgaaaagtcaggaacagtcagaaaaacgtagcttgtcatgggcgtagcgagcaagaacaatcacagaactcgtcatatactttaagaacttctgcactgggctggagagatgccttagtggttacgagcagtgactgctcttctagaagaccaggtttgattatcagcacccacataacaactcacagccacctgtaatccagttccagggaatcttctgtcctctatgcgcaccaggtatgcaagtggtacacagacataattgcacatagacaacaataataaagaacatctatattatttggcttctgttttctcatagtaagtactataaatagaaagttattttcttttcaaaaagaaataaaagatgtgcaaccttttctatgccttgattcagggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatgggtaagtttagagcagcccctataacagtatatgaaaatttgtttcctagaaatgtctactaaattttcaggaccttaagatgttccaagtccatggccatggtggcagcagtggtgtgctggtgggcaggtgtcagactggtggtaatatcactaagcatctcgggatgtttgactcagtagtcctagttctttggcacttcatgtgccagtgggaaagggtgatggataggtatgactgccaggttgtaacttctttcccagctatatgcataggattgggatagggatgttgtgggctggggatgggaaaggggttgggaatatggctcaatcagtgacatgcttttcatgctagcatggggactgtagtttgatccccaacatccatgtaaagagaagtcaggagtgatgacagtacacacctgtaaccccagtactggaaaggtggaggcaggaagtggggctttctgttgagtttcagttaaatgagagatcctgactcaaaaaaaaaaaaaaaaaaaaggagcaggagcagttgtgattgagaaatgacaaatggtgttaacttttagaatacatggttcattctctctctctctctctctctctctctctctctctctctcactcacacacagagtaatggttcctgaaatgttgctccaaagtatcattttaaaacctatttgactattaagctgttacaatataaaataaaactattttgtgtataattagcagaaatattctgattctatgcagctaattttttggaatactataaatttataaatatataaatatttaatatgcatctcgttgtgtttcttaaaactgccatccttactcagaactattattctttctctggatctcttcaataccaactatacggctttaggatgctgcgtatctaactcaattcttctgtaaaatacaataataaataattcagcatggattgcaggatgttgaaatcatgagttaatatctgtaatatctgtaaaatagtgactaagacagggaaagcacttggtccatgaatggtgagtgttaatggtaagggtggtagtaaggacagtagtgatgctgatagtaagggtggtggtgatagtggtaataagattgatagttgtgatggtgatgtagataatggtgatgatggtgatgtgggtagtggcgatggtgacagtggtgatgcagatagtggtaatggtgatgtggatagtggcgatgctgactatgtggatggcagtgatggtggtgccagtaagtacattggtggaggtgacagtggacattcttatgactgtgagtgttaggacaattagctctttaggaaaacaatcatattaccttgaaatattttagtttagtttcttttccaaaagtctctgattgtgtaaatagaatcttcagaatctccaaaataatatcagaaacaacgatagttgaagtcaacatttaatatctgacagtggtgggtaggataataatgtttccacattaggaacatgttggctgctggtctgagactccagttatcctgataaggaaagagtcatctgcacttttaaaatagtatttctcaagctcgggtgtggatttggaacttgccagctctgtggtagtgatttaacattgtccagtttttagtgtgtttgcattacctagctggttacttcctccagtttgtaaactctgcaaaacctgtgaaaagtatgctttccccgtttttacctaagcttatttttcttgcataagcaattttggagcaaactccctaaaacataactgcccgagctaatgccccccaaaagacactgggcaggaggaatgatctgtatgcatgcttaccttgaatatgaaataagtttaaagcacagaaagatggaatttgttctaatgtaaattaaaattttgcttgtttagttactctgattttttaagttttcttcctaattctattaagtcagatgaggagcatgtccttttatagagtcttgttattactgcctgtacttatctcaaattaatgaattacacagaaagtttttgattaaaatggatttttaaaatatggtgaaatgttgatgaagacaattgaaaatgaagacaccttttcccacttaaatattcatgcacaatctaacctactgcccctgtaatattttgagaaagtagtgtttttcctattttcatggggaaggaaagattttataggactcagcaaccctcacaatttatgagccagctgtgttagaagctgcactatagcataaggaacctacataacttcaagagccacagatgtggccacctcagcatgcataggatactggaggcacattcatttttaaattgaaccttatgttgacattaaacaaaaatgggatatttcttgacattttcatcctgttcaattaaacaaggttccacaagaatctgcccattttagttgtatgcccccgtgaatctgccactacaattatcattataaatttcttgcaaaaaaaaaggagttgagtcagggacagaatatgacagaagaaaccaatgcaacctccttggcttgccatcaggcgtccaaatacaagggaggtgctgtctgctttcctgcaggtttcttactcttgtgatgccccaacccttcccttctgtagcatctgtgctgccactgtccctgttggtcatcctgctacatgtgaagtggtttgtccttccctctgagctcactgatcacggcttcctgttgacaattaatggcaattgtccagtgtcgctctcagaggctgtatgaaatcaagcagcttgcacaaactgtcgatcccctcagcatgcctgggctcctggtgttttacactcaataataaacaaaccaccaaaccctgtgtttgaaggagcgtctaggtgacactagagaacgcttcctagctttctttgactatctatttgtgtgtctagaatacctccttctatatcccactgcattaatagatgcaataacagcaaatttgggttatgaataaagggccaaagccattgcagatggttttatctgagagcaaggaaaagtcagagagctaagccttcaaaatccaagaaaaacagaggggagagattagaaccaattcctgtcccatgtagtagaaacagcgtgtttggactgtggctccaaatgtagtctttggcatactgctcccatgtccatcctgacatttggtgccagctgtatggcaactatgtactgtgttacatttcagtagtgacccggctgatttattgatggctatatgatgccggtcactcaaaagttattttctgactaaatgaacaagtatattgttttatgtaattgaatcaatgtatagaaaatacattagtaactacccaattttgagatcaccgtgattatagctatataacagtaattttccacaattgctttatgacttactacggaacactatcaaacaaatgccagttgagaaggatgaaaacgctgtggttctttctttcctacagatgtgctgggccaggtcttcaaggatgtgaagtgtggccatctgggtacgttcaatggcagtggatcttaaagaccttttggatctaagaccagaagccatctctgactcccctctcaccttccagtttcttccaaatcctctgggccagccagaggtctcagattctgccctcttgccctgtgcccaccttgttgaccactggacagcatatgtgatggctactgctagtgccagcttcacaagaggttaacactacggactagccattcttcctatgtatctgtttctgcaaatacagccgctttacttaagtctcagcacttcttagtctcctcttttcctctcagtagcccaaggggtcatgtcacaaacatggtgtgaagggctactttgtcaaatgaaaaggtctatcttggggggcatttttttcttttctttttttcttgaaacacattgcccagcaaagccaataaatttctctcatcattttgtttctgataaattcttactattgattgaaatgcttccctgaggaacattaaattatgtatgaatttccattcaaagtcatcatgcagcagtggtatcaagcaggcagcatctagtgcagaactgagattgtctacagaatgcctgcttgatgctcagccttatatcccagttacggacatgtctacaaatagcccttctcttaccatctctcccttaacttcatgatgtggtagctgattccttctgccatcaactgaaatggcaaaataaaggaaagcctgaatcctgtctcccctcttagtttccaaggacacttgcccagaaaaatgcgcccccccccccccgtatccccaggcagcatccaggactttcttaaatggttctctgtacaatcccacctttaaaacagtcagtgaccattctttgtaatcattactttattaatggttttcttttctaaaccacctgcctttgctgttgtagcttctcaatacatgctctgagacaaatcattccttatatattccaatattgctgaaaactcattaatttttactaatagggggttgttttctaaagctcaggaaatgacttgtactccctaagtaggaaatgttgcaaaccaccatttcatgatgtacagttgattcaattaagtcaggtctgtgaggactttggttccttatctatatgtaaataatgctgataccaaatctttgctattcattaacatgtaatcttgcaaataataataaatttaacagaaactcaaattgaggtagattcttaaggataatagctttcagcctagccataaaagaaatgaaaaaatagtctttaaagatcccaaattcagaattagtaatattaattcagatagtccttcgtaagattgaaaaacatgacttctgatttctcatctttccaaagttagacttgaccttggtgagatggcaaagttaaaaaattcctggggtttaaggatatattggggcaacagtcacagcaacggtgatgctttttatatctaaatcctgtcaggttttgtttccactgagctcattcattcacctagggatctcattaaaagtaggggaccgggctggtgagatggctcagcaggtaagagcacccgactgctcttccgaagggcctgagttcaaatcccagaaaccacatggtggctcacaaccatccgtaacaagatctgactccctcttctggtgtgtctgaagacagctacagtgtacttacatataataaataaataaatcttaaaaaaaaaaaaaaagtaggggaccctatcagaggtctcaatgtgcctggaaggtctcccaacatggctgtgggaaaatgcctgacaattttttttcaattgcatgtgtgttctccgagaaaggataagatgcaagtttatataagaagcaggatttacttatactaaaatgccttacacgtaaggttcaggtagcatcgtggcagagagggtagaaagactgtaagagccagaggaccaggatgtccgctcttagtgtcttctatatatgaaagaaagctgtacccgtgaattctcaaacagttgtctacatatcacctgcacaatggccgttctggaaatctaaaaaaaacaaaaaacaaacaaacaaataaataaataaataaatatcaaaaaatcaaaaaccacccctagatgaaaagctacaagtaattaaaagctgctaaaagggggagaatcaattttctccagagacaagtccctgataggtcatccaatttcgggtgatcagccctaagcacatacacatataagcaatactaaacggacacagctggtctatatacttacaacttggggcttgaaggaagttggtggggaaggggggagagtagtaatgatgtatgtaaatacagtactcatgtacgaaactccccaaaaataaagaattcttaaaattattaaaaactggtattcttgtcttggactattttctgaattttatattaatattttcatcatcaaaagactataaaatgattataataatgagagaagttcagatgaaacatcaactgtcttaaatgtagaaaaggaaactgacttcaggcagagaagctaaaaatgttggcaaccttgccttgggacttagccaccagtcatttcctctatataagtcacccatatcccaatttctgagataattttaaatgttatcactgtgtcaaaggtgcaggacatgtatggaatgcccatattaccttctcttgtctctcattccaggccaaagataccatctattgccactgggattgtgggtggcctcctcttcatagtggtggtggcccttgggattggcctattcatgcgaagacgtcacattgttcgaaagcgtacactacgccgcctgcttcaagagagagaggtgagcagcgaggcttggttgcctctggatcaatagcatctttattaccatcaactgctttctaggagaaaaaaatcttcctttgagaatttgtagcgtgggatttcatacattagatattgtcgtagccttccatcactgtaacaaatactcatgaaaatccatgtttgaagaagaaaggttgattggactcatgggttttaggggttctggttagcaacattgctttgggcttcagataggagtgcatggtggagcacgttaactcacctcatgccagaaagatggagctagtaaggcaaagtcccttctagaccttgtccccagccaccaaaaagcctccatgtagttccagactcataaaggccccattacttcccaacatcatcattcatggtccattttaaacacatgagtctttggaagacacttgcccaaacatagcacttacataattgtcattattattatatgttatggtggaagaataaaaaaaaatgtccaattatacacaattagttatatttggaaaactccattcaacaaaagtatatatgtttttacatggtgtctttcgaaatacgaagcttagtggaggcctgcctgaggggtagctcctggtcgtgtacctaggaaaagaatcacaaaaagagatacagaaatcttatggaggcagctccatcgtggcatctccatgccatgcttaggcttcacagcccttagcacagcacctgtgtttggcactacattatgaaacctttgtctttcataagcatggaggtattatgtattccagagatgaccaaatggttatggtataacatttatcttgctactgtacttcaagtaaaactgattgacaattaaaacagaaatggaaaatgcagccctcaaatgtagatgtgttaaacacctatattagaggctctgtgtttctaatgtatagtaattatgtactaactaaaagatgtccactgctcctttgaacacattgctcctttgaacacagcatggtcccatgctattaggagttggacactctggctcagaatgaatctactattacatgccacttattttggaatatgatggtagcatctcaggtctgctcccttcttcacagctcgtggaacctctcacacccagcggagaagctccaaaccaagcccacttgaggatattaaaggaaacagaattcaaaaagatcaaagttctgggttcgggagcatttggcacagtgtataaggtaacatcctggagacaggtccgcactaggcttcctggagacaggtccgcactaggcttcctggagacaggtccgcactaggcttctgggaaccagtgtttgctgtgctctccagccctgtgtgggtaaatcagattcctcagtaatttgatttatcacaatctacctgttttattgaagatgtagaattagtgttccccaggctattgaaatggatttatttttttgttatcactgtgaaatcaaaaacattttcatagaccacgatagaaacgtagactgggaatgtagctgcttttcttgaactgttagaataagtcattgaatgagcatttcagtcttctttcctagatccatttttcataaagtctgactccagttcaaattctgaatgatccacatggcatttatagctagctgtattggttacttctccattgctgtaataagacgccatgaccaaggcaacttatagaagactttattttagcttacaattctagagggttggagttcataatggcagggaagcctggcttcaggctgcaggcccagtggcaggagcagggaaatgagaactcccatcttcaaatgcaagcacaaagcagtaaggatggacggaagtagtgtgaaagttttaatctcgtagcacccttgtagtgatgtacttgctcaagcaacagtgccctgcctacacttctccaaacagtgctatcaactaggaaccaagtattcaatatccaaggccatggaggacagttgtcattcaaaccattataccagctcaagcatacatttttttgacccttacttttttgagacagactcttactatgtaacccagtcggattttaaactcaatcatctttcaatagtgtctcaagagctacaattataggtgtgggccattaaaactcttgtgagttttacataattgttttaaataattggaataaaattacatcactttctcgccttccatttcttcctcctcccttccccatgactcctactcttaagttaataactcctttctcattatgattctcaaatatacatttatgtatatctgcatagatagatagatagatagatagatagatagatagatagatagatagatagatatacgtgtgtgtgtgtgtgtgtgtgtacatatgcacaaataagggggctcatctcatctctgggagaagctaattaccttctctccagtcattggttgcctataattttttatccccctagggtaggacctcatgcaatttcccctttctgccttagcatgtccattgatattgcaatgctctcaacttgttaatgaaccatttctaggaaaaaccatttcacagcagactttctgctattttggctcttaacagtatttctgccacctcctctggaaaactggaagttgatctctgcattttgtccagtttgtggttttctgtgatagtctccatttgctgtaaagagagtcttctctgatatgggatggtatttgtgtcttttgatccaaaaattatttggattctttgagcttgatagctaagaacctctgaaatatgaagagtcccagcactcttggatttgtaatgtagagcccttgaggactccggtccttaataaaaattaatccagctcacaaggcaacatgttactggcatgattatttcaagttaatgtcagccctcttcttaatctcagggtctctggatcccagaaggtgagaaagtaaaaatcccggtggccatcaaggagttaagagaagccacatctccaaaagccaacaaagaaatccttgacgtgagttttcttttatgtctcactaaccacaatttcataaggtcaatcttgcttccttagttcatgttttaatttattctggatgcactaataaattacacccaataatgtatatttgagcactgtttataaggtaagagcataaggactgtttggaagtattctggatgataactatgttcaagaaaagaagctgcagttctgcttatagggacgtgggaggaggaaagagagaaggcataaaagtcaagtgcacccctcgtctcagaaaccactgattctgcctcttgcatcacaatgctctgttctaagcttttcccgtcattatatcataaacaatcatttttatctctttttgtccttcttgatatagaaaatacagttctctccaagacttactgtactccagaactgcaaagaatcaaaactcagagttaacatactcctcccagggccagtcttgatgctcacttcttagcatgtgttaagtgactgagggatgtgcccatacttcaggttttacaaatgagggaatgggggcataaagaaagtcgttcagatttctatgactagagtctgagtgcaccacaatatctgaaatgaggattcactttgctttgctctattacttatctttgtaatggcttttataaaagatgccagatatcaatagtgtgaagcctactagaccattacctcacgttctaagcctctcccaaccaatttaaacatcaccctcccccatgttgctgattggtacttgctgaagcatttaggatgttctgtaagaacatcttttttacttttaattctactgaatttccctctcttttttctaactttcttagcccacaataggactgaatggaagtacaaagaacataatgcaaagagaccatcttggaactggataggacccacttcagtatctaacagggcttccaatagttgttgaagactacacctaacctgagacaaaaagttgaagaaaggcagagaatactcaggggagctccacattgcacattgctaatgagagatgattcatgaatgcaatgtcacagaaaatcatgcatgctgccaatacacttgtcaagcaaaattatctttaattttagagtttacaaatcaatgccaagtcttattaacataaccaaggacaagtagccaggggcctgtgaagacgttttacttagtctttcatttacatttgttaaaaagaaaatcacatagtcaatcttgcttccttagtttgtgtcttaattcgttctggatgagctaaaaaattacacccaatattgtggatttgattgagcactgtttataagataatagcataaggacagattgttctgaatgatagctgtgttccagaaaagaagctggagatctgcttttgcagaccttggaggagcaaagagtaaaggcataaaactcaagtgcacccctcatctggaggcgcccgttctgctctttctctctggcccctttctctttccgttgctcatgcttcccctgccctcctccctgacttttcgttcttgtcacctcaggtcctctccttgtgtgttagctgttgtgactgtagcagctagcagatgatagataaccttctgggttgcttaccaacaggctgggtccgccagacatccagtccatcttttagcacaaggccatgtgctgttgctggaagcctcagtgggggcaggaacatggaaggaactggtttctgctgagggaagcaaagcctgtgattctaagagcagtttcaacaaggcactaagtagcacatcaatcaacattgccacaagaaaagccctcagttagcatgcttcttaaatactgccttgcacttgaaaatggttccagaaaccccacactctgtggtctatctcccctgtcatggattatagtgacttaattaattggtaaagacttttaaatttcataggtccctacctttcattcttcttaagtgtgtgtgtgtgtgtgtgtttgtgtatacagtcatgagctcatatacatctgtacatgacaggggaatgccctgagatagatagatattccacagcacatgtgtggagatcagaggatggctttgtgcagttggttctctctgtacatctctaagcaggctataggctccagggatcacacctgaactctcagccttccatagcaagcactatcatacggtgaatcaactcacttgccctcttacctttcatttttaagatttatgacttcaagactctcaaaaaatttagcatctcctgggacccttttcctccattcataacacaacgaacccagagatgggtaagacaacaaggactcaaatctcttattagcaatagtgacaaatagtgacctttccgggtcaccgaagcctcagggacaaaccagcctctagtgagactgggacagaagccatcggggtttcccttacgaatgctgcctgcttgcagctggtccaaagattgttgtgggataccaagcatatttgctgcaggtcacaatgcatcttcccaacttccaaaataagcagggaagaacaaagctcactttaacttttgcacatgactacacaacactcccattgtgctgggtgtaggcaggaagtgacatcccagttctgtttgtctatcatattttagtaggaccaactggcagggctccaggctctgtgtggcctgacacccacgccccctgctccgttcctgtcccaggcatcatcagcccatggcagttaagcttctcaaactgttccagtttgcagatgtttttctccccctctaaaatgaatacaatatgtgcccgaatctcaaacacatctcaagaaaataggcagagccggaggatttcactgctgttatgattgtacagcttcccagacccaaaggagagatgtgatctgtgcttttctggcaatcccacggcttaataattttcccatatgctttccagtttaaatttaggccaagcaatggaaagaaaatgtaaaacagatttatatactacagcatgggtatgtgagtgtgtgggggtatgtgtgggcgtttcagtgtgagtatgtacgtgagtgtgttgtgtgaacatgtgtgaacgtgtgaatgtatatgagggtctcgaatgcatgaatatccatttcagagactggaagtggtaggtggaaagtgcatctctggttgatctttgcagaggtttcatgtgctgatttcttgaccaaaatgtcttgccactattcacagttcagtctggatcaagtcttccatgttgggaaaggagaacacctagaacacctgccgactcagagatctctcctgaaaaatagtctttacagtaccaagacctatgctcacttctgatgaagtgagcaagccatccactgtcaagggcatactgagattcaaacttggatcccataaaaccataacatcatcactagccttagtacgtagggaggaaggtcttctcaaggaagatagtggcatttcctaaactctgaaatatcatggtgatgaagattttttttttcatcaaagcttttgccagtggcaaattccatttgggtcttttccttttaacatgcaacatcccaaaggagtctacatcccacagtgtattagcatttaatagtcttgcataacctgacacttgtcagagtacatacttttaaaccaaaaaaaaaaggggggggcatttcattttacccagaaagggatatgcgtgcctctcccaccagccaggaaacaattgtgattcatctattgtccttaccttgtaggaagcctatgtgatggctagtgtggacaaccctcatgtatgccgcctcctgggcatctgtctgacctccactgtccagctcattacacagctcatgccctacggttgcctcctggactacgtccgagaacacaaggacaacattggctcccagtacctcctcaactggtgtgtgcagattgcaaaggtaagcacgttgggaggtctgtccactgaagtacccaaagattcaatgacaggtctcagaagcaggatcaatgtttcaatatagtacaaagcactttgacttgtggtcttccacgggtgagagtgatcattggtaagagcactaagaaaagcagcaaggatgatctaagagaagggaagaagacccgttagcgtctccattctgggtacctgctgagatgataggtgtgtgtgtctgcatacaggacatatcgttttccttattttagattacattcaattgcttgacttgagcactgaaccaatggccacatgcttcatgtggaaaatctagccacttcacaggaacagttttctcagtacatagtgcacaacaatgctgggtgttgtctttgtttctctggagttctttttggtgaacactgtggcaatttctgggacagcatggattatttcctcagttaggacttaatagtaaaacagagtgggaccagaagaaggcagatgaaggagatggcaatggtgtggacatgtggacaagataaggaccagcatcgagcctggtgttcatgcctaaaaaggctgctggttgggctacttcagtgtctctaattacaggcatatttctgagccagagagtggctgaggaattggacacttcttccacccacagggctgaggatgagcacagagcaacagatcaagtatttaactatctataggtctcctaaggactcagattttcatctcaaatttcccccatcgcagtctcagccctgcatcatattttggcaccaaacttggaaagtttggcttattctctgactgtatgggtagattttcacatgactgaatttaaggaatttgtggtaaaggctgatatttgttcccatcctctttagacagttgggtaagatgttgaaggatgtgtaagggaccacaggagcagaggaaagtgggcttcccgatctggactggttcttagtgtgtacaaatggtcatggtggcagttgctccaggaatgtagcagaattatgttgaactcacttcacccatctctaacagagacacaactgcatgcatatacaacaagaccagctttctgagagctgtggcataggatgagatgtgcttggtatgatactctgggccatgctggaaaagcaacagcaccctctccagcatccaaaactacaaaatgtcctttatatggttataccacctgagatgtttcagtcgcaatctggaaagttgggaccactccatcctctccagctagtatggccatgtatgccggcctctgcccactgttcagtcttgatgctttacacagaatataggagttaaattatgagtgttagacaatagtctgagaacagggtagcgtgcgacccagctgctgtggatttttcttgctgctaaatgtgtattgcttgtgtgtacttgtttcctggtactaccatgaaagagctctacagattttgggtctgctcactatgcaggctgtctcctcagaattctggaggccagcagtccagcctcagagtgttctagggggcactggctttaaaggcatttgggagaatcattgcttgcctctcagcctctggtgtcctcagcactccttagcttgtatcagcatcgctgagtccatatttctttattcatccaacttttcccctgtctctgtgtcctggagcccctctctcttcacataaagactggaaaatactgagacagcagtaaccacaaagagctgaggttacagctatgctacttagtttgtcttagtttctccatatcaggaatacatacaaaaatcaagttgcatcccataaatatgtataagaaaaaaagaggtctcaatcactggacttagggcccatccaaaatccaggtagatgtatctcaacatctgtaggcaatcagatttttataatcccttttccaaataggattccattctgaagttccaaataaataggaaaatttggggctattcaacctgcttcagtagctgacctctgcctaacccagaacagctatatattagatataggatggtgtctgaaggcctacccacgtcctcactcctgaactctggaattctctcatattttctctaacattcccgaaggcagggcgtgatgcactcctttctcaagttttattcctttctttttatttccacatgctgatctcttggaagtctagtttattcttgagtttgtgaccactttccacaactgtacagtaaaacctagctgtatccccatatcggggtagaactactagaactctacttccctagggctgacttctcttgcatgactactgatacccaggtcaccagaagttcttaaaaacataacagctcaacttccacaaaagagagtcctcttaagaatggggcatagctcggtgcagaatactcacttaccatgtaagtcccttcattccatttcggctatacacaaacatactacacagagagtctctaggagttttgcccaaaccaaaatgggattacgatttcagtgaactttcagttcacgctggaagtttgagtgtcttctaaaaactacccttctgaaagaatgatagtgcccaccgtaaacagcaattctgaatacatttctgaggtttgattgtctcttaagacagttttctatgtaatattaatcataatttcaacctgttacttgttgaattttgtgctgttgtattttgcttaaggttattttgactggcagtctttccacatttggggcagttcattctttgcctgtggtacctctgtttgggaattctcaaggaaaccttattgtgccatatagaactagccaagtggtagagtgtatgcccccaaaggggaggaacataatgttttcccaggtgacgaggagaaaactttgctcctggcttagtggcaatatatctcagtattaacgctgttttacttctatacgagcaaagaaaacttcccagatgcatttagtagctcagaacaaactaaagtctcagcatttcaaagtaggatgcattaccccacaaataccttaggtgacctacaaaagcgaccagcttcaaaagttttgtagacattggtgattatacactttccctgtctgagctaaactgtcaagaagattgaaagtgaagaaggaaggaaggagaggatggtggtagttagggaggaaaccagtatagattggtaaactataagagaactatacttttctcaccatttatagacaaaagtggattctcttctgtacatataacctttggaactcccagggactgagattagagagtgcttcaatgtacccactgttcttatccacaatgggccagaaagaaggactcataagatccttcaaagcacacatctcaaaaacgcacagcacaacagtgcccatgtcaaaaggaccaaagagttgctttattttgatttttaaaaatcttttccttttatcatttaaagtgaaaaatatataactacatttatgtagtaaacataaactggccccttgactgcaaggatcagagtgaggatcgaacaccgtgcacacttgctcacacgtctacgatgctttttctgcacttgaagctaaagcacagaaacacttcccatctgtctcccagctcctctccctccttgcacaggaaaatgaggaggccactaagtctgggcttatctttatcgtggtttctagagcagcacagaaatggacactgcagtagcctctctgaactttgcccaagatatgtgagatatacagcccttgggagagcagtcttcaaatgccactgtctacactcagtcttttttttttcctctgcaacagagtgttccataaagacctttgatatccctgtgaggcagatggctaggccagctttattatgctgaagctccactcttcaaaatcactttttaaactcggctgttcaaaatccattctcgctgtcctgtagcagtgagacaaaaataaatatgttaaactcaataaagaaaagagaatcaggaaatgaaacttccaagagatcccactggggtcagtgctgatattactatttagattcggagagttcataagcaatatcacagctcttatctgtagcaaccagttaaactataacccagttgggttctgagatggcctcttgaactgccttgaaagtgtgtggcagagtgaagtggatggagttgagtctaggttctaatagatctaatctctccgtccccagtttacttcatgcaagaccctcactgaactgtctaccttagagcattgcgagctctcctctggcttttccaagcttttttttttcctgaggaaacctaaagccgagatgttccatgttcctttacaacagccctgtggatgtgctgagcttggggggggggggagttctgttgatttatcagactcacacaatgacactgatctcttgacaaaccaccaagtgctagacttttgttgctttgattttggtagcacacaggcagcattggcccagctgacaaatttcattgagaggccacagcaggggaaggtagggctaatccccaatgtggctggagactgagagcttgtctgggaagcagcctgttctagatcagatcccttgggtctctaacaagttagccctgtaggtactcatccagagagaccactgcactgtcagtagctgctgtgtcctcagcacttggcactgctgctatcattcaattgctcttttttttttttttttatcaaatgctccacatgtgtctcatgaaccaaatctgtgcggaacattttattgctgtttcagacagagtcttaaatagcccagactggccttaaattcgatggtatccttgaactccagctcctcctggcatgctctgattacaggcatgcaccaccacacctaagtctgttaaacagttaaagcagctaaataagagtcaatactggtagtagaatgcagtttgaagtgagctctctagtcttccttgtaagcgtgataaatggacagaaagcaagaagatttagacaaaagcagaggaggaaagacagggggtgactggtcctctgcatagagactgtatgtgacttgtcccacacagtagcttccagtgtgaagaaagagtgaaaggcaccatggagaagaataaagacagcaaggataagagatggcaaggatgggggagaggagaggaaagaaaggggcaggactggagagagaggcagggggagaaaggcagggagggaaccaatgaggacatcctacctagagaaggctaagtgttagcactactcctttcctagtggggaaaagttcgtcatattcaatatgtagagaccttactcttatgagatacaaaggctgtaaagactaggacagagtaacagctccataactcagagaggtggctgggactgaggaaggaggcagcttccggagctcaaccagacaagagaaagaggcagagaaaatgagctgtgtgtttggaagtgtttctttggcttctgctccttcttgtcctttcacttccaatccctctgtgaatcctaatttggaagtgctagtccagcgaagaatcggccagcatcctcttgactagacacaagtactcttcacctttattgccttgcacgtacaaatcttcaaaaagaagcacatgaactgaacagcatctaaaacatgtagttacttcctaataaatacaatgaagaggaggacattcatgttcacaagaggcacggacagtgattgcattttccaagaaaagaaagatagcaagggtttccataagggaacccagtgctgggtttttgacggtgttcttgtggaaatctactttcataagatggccggttctgctcttaaggggaacattatttcactggataggccaagtcaacaataatcttttatataataaaaggtgcaaaaacaagcagacagtttgcctgaaagtttcaggggtgaacctcatctgtaggtataccctgagagtgtatccaagtggaggtgcttccatcgttgcgaaaacactagaacaagaagagctggctaaaatcttacttacttccagggtgtcctcaacaaactgctccaggtcagctctgtgccagcaaattcaaaaagcagcaatctgataggaagtaggaaatggggcccatgctgcaggctagagaggagaggtctgctgtgtttgtgaatagaggagagtggtggaaacaaaaacagacgcagcatcagcatatttgactctttctcacctgtgcctcctgaagagactagcctggcacagagaagggattgctggtaagctagtgtcagcagcctccatggaggcaaactccaagagagtcatgttcggctgatcccacaccagagaaggagtagaggccaaaagtgatgcccgtcagccagcagggaggaaaactgcctgtgagggacaccagaaagttcaagtaaagatggtgtttcaaagacagtggttctgggaactcatttggcttcagtgtgctagctacatgtcaagcagtatgtctttattgttattatattgatgataacaattgcagcataattatggaacagtcaaggaagtgagagagggtggagtttgtaaaacatattcaatgttcaaatagttttggttttaaaaactgtaaattaaaaaaaaaagacactgaaagtaaagctgggcaaagttttctttggtatcagtgagggattcgcatacgacagcccaaggaacgtgacgaaagtgtgtctgaaatgcaaccagccctgctttgccatagtctggtgagatatgcgttaaccccctttaaataaggatagagctgatgcagtaggcctcctgcggctcaaggtagcaggctggagttgaagcagaaacctgaggtctgcacctgacagttgaacctttctcttcctctggctgcttctacttgcaacttgagtctctggatggagaaaagttcttgatcacatgtggttatagcttccttcatatgtcttgtcattcatgccagataattccaaatgtttgccaaccgcatcaagcaaagtacaaaggctaaaaacacagtccttggtgttgagcagcctagagattcttgtggatttaaccctgtgttcaggtgcatgggtgctagcttcccatgacactgaggatgcccagatggttcactccctcacggcagcatcctctgtatttcagggcatgaactacctggaagatcggcgtttggtgcaccgtgacttggcagccaggaatgtactggtgaagacaccacagcatgtcaagatcacagattttgggctggccaaactgcttggtgctgaagagaaagaatatcatgccgaggggggcaaagtaagtcctgggagtagatcaggaagcattttcctgacagcccagacccatccccctccctgtcagctgtgggcagcatttgccaaagattctgagtggggtcagagcagctgccaccatgacctgaatctcgtcagggtcattctctactttgtgaatggatttcggtgggagtagtaaggaggaagacctgttcagaggccaaagagccagttcccatctccaggtgactattaacaactatgagttctaatccctcctcaagaaggaaaacacccctcaaaagaccagctgggaaatatgaccacggattcagtagcaccctctactgagactcatattcaacaagctgggttgttctgggagttctggtgagtctatgactcatgccaagactgccagtgagaaaattggctgtcttccctctgtgttgtttttagtcccttcaaagtctctgtcacagcagtgagaggttcacagccttgccggaacccccaaagcccctcagccatccccagctccagccctcctatcatgctgtcagtgtatctctaaatagcactctcaacccccgtgaacttggttattaaaaacatgcccaaagtctgggagccagggctgcagggaaataccacagcctcagttcatcaaaacagttcattgcccaaaatgttctcagctgcagctttcatgaggtaactccagggcccacctgttctctggtaaatttaaccccttccactaccgagagggagcataggcctgaagcatggcagaaaggtcactcgattttcctcattagtcaactgtaattacacctagagtgacagaatgttttagctctaagctaatagtcttcttgctgctttatctcacatcgtcccaaggtgcctatcaagtggatggctttggaatcaattttacaccgaatttatacacaccaaagtgatgtctggagctatggtgagtcaaactctgatgctaatgaatttgtactgaggctaagtcggctcttattatttgttaattgatattatatgctctgataggcaagtgttaccttgcaagacagtgagcgtgtccatctactgaactaagagactctgacaaaggaaataaagcttaactaccacaccaagtatcactagggacagccatgaacacatgctgcagggaaggtcgtggggggaagaggacccaaatgcgagctaagcttctgcctgaagaggtcaaacaaacaaaagctcctgctgtgaacttgatgtgaaccaaaggaagacagcaaaggaggtttcatgggggaagcatttctgatagagaaatgttttcttatgaaatggccaagactgttgtttcatgtggtgcttgatttaatctctctgtgtcaaagagaggagctcggcaaggggatccatgaggataactgtggggaggaagtaagaatgagaaggtagttactgcttgttcccaaggaagaccaccttaccagggcccagctagtctaaatacagcacagccatgcacaggactatgtcttaaccttcccaggatgaccactctagccaagcctcccttgcttgtccttcgcttatcttgagcctattgtggcctaactagcaaagtccttggttcctgtgtcaggcacttggtccttgaatttcccccaggcagttcagggaaaagttagcaaacagtgtgattataaaacacaactctcaccccaaagggggaaagggataattgattctgaaacagacatgggtggtcatcaccaaggaacgcaaattcaggttgccctgaacattttccctcacagaggcagatgcatcagattgtattagctacagagcaaagagtgttatgtatcaaatggtctgcagtttacagccttgctttgtaaggtccttgcttgcactaccttgagtataaggttctcagaacagctgtgcacgtaggcagaccttgttctgtagcaaactcgggctccacagttgtccttgtctttaaggttataactattccacttatcagtcagcaactatatgcctcacatttagctaaacttttttgtataagatcttactacatctttgaagccatgccatgaaacagatgctattatcttacttgataggtaaatcccctcaaaccagtggctcaaggctacagaaacaggttttaaaatacttactaacaataatggctaaggattaggtggtgtgttaagcattaactcacaatgcaatgactttctttgcctgttctatctgcctaggtgtcactgtgtgggaactgatgacctttgggtccaagccttatgatggaatcccagcaagtgacatctcatccatcctagagaaaggagagcgccttccacagccacctatctgcaccatcgatgtctacatgatcatggtcaagtgtgagtgactggggggggggggggcatccacactcatgttgatggtcctggaaggatgtaattgctctgagacaaatagcccaggccctcatttccccgaagaaatagcatcagtcttcgagtcaggctcacagttccagaaacatcataaacacctccagcaagcattctttaggaatcacttgcttgactcatcctgacctcatatttgcccaaatttgcaagcaaataaattaaaactgaagtctttcctaagccattattcccagatattctatgatctgagttgctcaatgaacttacaaagttgtattacattttgagacctgttgctagagaaacttaatgtttcaaaatgcctaacaatgagtaaccatgggagtttgatacaatctttgtttctgctttggcttaaatctttcaaactggatttatgcaaggcctcctgaagtaaagcagttaatcatcttaatcccgacaggagtgtgcattttgataagtgctagtattccacacaaatctgtaattgtgctctgaaagtaatagtacacatgtcatagcattggcatagaaacagcataggaatatgacagagcagtggtcttagtttgcattctgttgctctgataaaacactgaccaaaggcaacttgtggaggaaaggcttttttttggcttacagcttactgtctgtcatcaagggatgctagggaaaaagctcaaatcaggaagctggaggcagaaactgaagcaaagatggaggaactctgcctgtggcttcctcttcctggttcactcagcctgctttcttagacaacagaaaaacaggagccaagggatggcaccgcccacagtgggttgggctctcccacataactcattaatcaacagaatgttgctcacagaccaatctactggaagcattctctcagctaaagttttctcttcccagatgtctctagctcatttccagttgatgaaatctaaccagcaaggctgctttatcataaataacaatgtattctctgaactttggaccagggagttaatctattttcactgctttggtttcagatgaggaagctgaggcctagagaggttgcatgatttgtctaaggtcacatagcagtttagcctaaaatagcttgatgaccagttgaaaaaataaatccaatccctaaaggcacaagtatctagtgcacagtttatcctctccattgctggatctatttttagatcattggtaaagcaatgaacctctgtgactactaaatatagttttacccagaaaatactagttatgacaccctaggttcagtccccagcactggtaaataattgatacatagattgatggatgtatacatgcatacacatatacatcgattcattgatcgatgcatagatacattgttagatggtagatagatagacagatatatatcgcttgtttgcttggttggttggttgattgattgattgattgatctgatgatacacagattcagccttgttaattgcatgaatggtaactgaatggagaatgcaataaggccttgacatttctgtaaattgaatctattttctagcttagaaagctgtggattaggacaaagaaagcacagaggcataccaaagtcagagtagttcagcagtgattgcccacagtaaaaccctgtggtcactgaagatcataatgcaagaatgatgactaaggaaggacaaacgtaaaaccattaccgtatatgttattgttactctgactgaaaactgttctatagggctgggaatgaatccacaaggtattacaacaacttctcatgtacttcaagaactaatcagtgttatctcatgtgccaagcctctcccaaagattatgtgccttcattatccatttgcctagcaagatcacagcatcacttaaagcaatgccctccttgtcatttcttccagggttctaattgctttgctttggcttccttcctttctcaggctggatgatagatgctgatagccgcccaaagttccgagagttgattcttgaattctccaaaatggcccgagacccacagcgctaccttgttatccaggtatcaggccaaagtttgttcttacatggtcaaaatctctccaataggtccagatgccactgtgctgagccaacacagtctgtgaagcatgttcttgataataaatccttttgtgcattggagcctcttccattatgatacaataactgaactacatggggataagtggtgactctcacccaactccaaatcatcattgcatttgagcagtccaacctggacccaatctgttcctcttttgcgagtatcacctcatattttggctgatttgagccatgtctttgctaaacagaggagcaagacttcactgtcaacctacatggcttccttccctgactcccttttcacacctgtgccactttgtacaaccaatcggcttagttctaattctggaagaacaaaaatcaagataatttgtctttgtgaatttaaagcttcagtaaaatgatgtatgaaaagtcattatgcagtggcatagcattgtgtagtgggggttaaatgttcccacggctttcttttctcctctctcttaaactatttttcatatggaggctgtcagactcaggagactttctgtgttttattacattccaaagtatccannnnnnnnnnnnnnnnnnnnttctgtgttttattacattccaaagtatccacacactgagaatggaaaagggacatatatatgagagctaccataggggttatattataactaaactggcaaacccataggcacctattgcttcctatagccaggaagcagagcaagcttcgttgccctttctaatagtatcaaaatctctgcaccagggggatgaaagaatgcatttgccaagccctacagactccaacttttaccgagccctgatggatgaagaggacatggaggatgtagttgatgctgatgagtatcttatcccacagcaaggcttcttcaacagcccgtccacgtcgaggactcccctcttgagttctctggtatgccccccctcttgatttaaattgatttactttccattttccatattttaattagaaaaagagggataaattctaaccaaatagaacctggaatcataatcaacagttaaggattttagttatttaattgcctatgtttttctaaagcagtaatttaagacaaaaattcttctctccaagaaagcattcgacacattaaacgccttaaaatatttttactctatgagacctacctcctgcattcaacagaaatggatgagaaagtgccagtgtacatgaccaacattgctttcttttttttccagagtgcaactagcaacaattccactgtggcttgcattaatagaaatggggtatgtatggacatggtataaaccagaatcaaataagctgcgcagggaaagtgcccaacttagcccacatcgcactggctttccctcctgtacattcttttccataccaaggcttctttgactggaatcagaaggccaacaattagtggtcacttgtcataggacctctcaaagtgtggttcatggtcagacagcttcagcaccacctggaagtgttagaaatgcagatgtttaggtctccaccagacatactagcaggatctgtgggggaaccacagtgttggcactatccttacatgtcacactgaccacgatgaagtacagtgcctcaggctctgcctgcattgtgctgtcaggagccactccatcactaattcaatcttaactaacatgaaataaaatataaaattcaattcctcacacatttcaagtgttcattaaccacatgtagcaatgtgactgccttacgatggaacacagattgtgagcaaaggctgagtattccccactggagtaaacttgcctctcccacccacagagctgccgtgtcaaagaagacgccttcttgcagcggtacagctccgaccccacaggtgctgtaacagaggacaacatagatgacgcattcctccctgtacctggtgagtagcttgctcagaaagcagtcaccagccttggtgtctactgccattttctcaggcacaagtcaattgtgacatccagtgtgcctgaatgaggcacaccccatgcagaggtggagactgtgacaaatttatagacacgatgaaaggaataaaaaggcaaaacagagagagcgtatcatgctatgaggcctgtggcaaatacatgttacagttgggttttctgcagatttgttggcttgaaagcaagtggtgaaagtggccatgtatgtatgtatagtgcgtgcatgcgcgtgtatgtgtgtgtgtgtgtatctgcagataaaagatggatacatgtgtctcctctcttacacacacacacaccacatcatcctttaaacttgcaaaaatcgcttatgcccattgctttgagaagtatagaaagtatcataggttacttggtagtctccatggtgttcccagaacttccttgctcttggatatcggttgtcttgctgaggacacttgcagggcttgcagtgagccacggaattctgcatcaggatcttgggatgaagctttactaattcacatgtgcattcttcttcatttcagaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacctccaagcagcgagtttattggagcatgacaagaaggggcatcataccagctataaaatgtctggactttctagaatcccaggaccaactatggcagcacctccacttctggtagccatgcccacgctgtgtcaaatgtcactcagactggctttaaagcataactctgatgggctttgtcactgagccaagaagtgggcctctctcctgatgcactttgggaagttgaaggtacatcaattgatcttcgaactgtgaagattccacaaaaaaggtatccatcgagaacattgtccattggaacagaagtttgcctcatggtgaggtacatatgggaaaaaaacagacatatggagcttatatttagggaactttgggattcttgtctttattgatttgattgatgcactcttgtagtctggtacacagagttgcctggagccaactgaccagacagttggttccaccagctctgcatcaagacacttccgtggcaagacaactaaatgtataagaagtccatggatgccctgagcaggccacacttgtacagcattaaaccatggcagatacaataggataagccactttgttacttactggggctgggagaagaggaatgacggggtagaattttccctcagacgtactttttatataaatatgtccctggcacctaacacgcgctagtttaccagtgttttctattagacttccttctatgttttctgtttcattgttttgagttgtaaatatgtgttcctgtcttcatttcatgaagtaaacaaacaaacaaaaaacccagtattaagtattatcaaagaacaaccatgattccacattcgaacccattcaaaccatcagtattgtgaccaaaagcctttaactaagaaggagtaaccatgcaaaaatccatagaggaatttaacccaaaattttagtctcagcattgtgtctgctgaggtgtgtatatgagactacgaaagtgaactactcttcaaatccactttgccttcactcctctataccctaaatctagtgtaaaccacacatggaggataacttttttttttaattttaaaagtgtttattagatatgtttttcttcctggtaaactgcagccaaacatcagttaagagccatttttgataaacactatcacaatgatctcgggatccatcctttccgatttaccaagtgatggatagacgtgaactcataaacactacccataagacaaaacaatgagtgccagacaagacatcagccaggcaccagagcacagagcaggactgggcaatctgttggagatatctagaaagttcacaaaggaaacaagattgtccactaccttgtgagatctagcagtcataaataccagggaaatggaaagtgtgtttccttacagcaccaggtcttcgatcttcctaatgctgtgaccctttaatacagtttgccatgttgtggtgacccccaaccataaaattatttttgttgctacttcataactgtaaatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgaaaatagatgtcatccatgaaattaaggagtgagaatattaagcagcatttatagagctcaaaattccatgtcatcaccaggaagtgccatgttgatcacagagaacacagaggagacatatagacagggttttgctcaaaattgggatatagaatgagcctgtcaggtacctatcaggagcggtaatccgtgagagagaaccgttgcaagccactctaactgtagcaatgaaaccctagtatttttgtactttgaaatactttcttataacaaaataaagtagcaaaaaaactgttcagacttgcttttcttcttatttaagtactcagcataaagttgagttgttgtcagggttaagattgtatttgccagtgtgtcctcactgtgtctttgcagggagccgcggggctgtgagtgctgcaaagcatacccttttgcagtagttcccaaccttcctaatgcagttcctgattcagttccccatgttgtggtggcccccaaccaccaaattattttgttgatattttatagttgtaattttcctactgttaggaattgtaatataaatatctgatttgtgtttcaaaggtaccttagcagccactgggggtaaaggaagggtacagagaggggaggcaccatgctgggaccagcattccattacatctctggcagtcttagctcagcttaactcttccatagttaaccagtctcatatacctcctgggcatctttctactaactgcctttcagcccaatcttagataaactttttctatgtcttgaccccaccctggctcttgggcaattcatgggaaaatatatggagctaatgtttactgggcacaaacattacatatacatacatatatatatatatatgatctacaaagagctcctatcattataccctataaaattacttttttagctcatgttgaaaaataataataatctcttaaatgctaaatttgctgccagtccctgctgccatgggctttatagataaaaaccttggcaaagcacaaaatttcattccagctaatgataacacaatgtaggcatttgttggacactttttttttttttttttttgatttagcatcccaccccatccccaaactgtagacataaaaggactttgactacataagcactgaagcactgggctttgggctgggctaccatgagacgtttccagccagtacagtttcaacctgattattcttaagcccatgaacttttcagagtacctccaggatactacaataaacatcaaagtttatttgagagccactgtaaaaggcttgataaggggactgttggcactcactagtggctgcccatctgtggtttgttcttattggtcctttggttgcacttgtataagacaaagctggtacgtgaaaatcatgtaccctcactgccaatgaaaagtacctggatcgcttagaaaggcctccgcagccccttcagtctcaagcagtcaggatcccagaggggcaccccaaccttgattctagtcctcatctgcatcaccatcatccaggaaacaggcctgctactcgactctgtgcacagctggagtagaataaaacccctgcttagggacagactacctgactcacagaaagcataatttgcagtcaccactactcctatgagttgtccacaagtgtagcctttccaaaatcttcctttttttttttttctcaataaaacctttatcctgaaaatggtaaatatctaaatctgggccggggacatcttgctaaagtcctcagacactgtgtgttatctaagaaacaagccataaaaacccaccacttcccacctccccacactgaatgagctgttcccacttaagacgcagcagatgttaaacttttgcttaatctctactttcttttgataagcttgtgcttgtattaaaacataacgatctgtttacatttccttgcttgggggctgtaaaaccataactgagcagaaatcccgcactctttttcccagccacacctatcattccagagacaaaaatcttggtactgttaaagccacatgtagacagagtttgtaaatgtaaatgtatttttgtacttgtctttagtatattgtcctcttcatgtagtactgaactttgtaaagtatatttttttaggaaactcggtatttttttgtttttgttttttagttttttgtttttctaaagaaaactgctttgtaaaaactgcaatagaatgaaaatttgaaattgagatcttcgctgaaaaatggttcaactgaggtgcgaggaaaagtctcttttctcttaggtgaatgtctagcattattacagagctaagctagaccgttacagacagaaaagatgaaaggcatatgagcttagtactgttctgagaagaagctgtggactctggggcaatgtcagcttacagaatgctgcctgtgcataactactagaggaatttaaatgagtgtcattctctgattatctgcagtctgaccttgtaaatgaatgcggttcaatgacacaacactttggtttacatatgctaatacaatagtaacatcaattgttttctttttatagttacaatgtcggtcgttctcttactagtgtgtcctagaaatgtctggaaagttacaataatatttatgtttgtttgggttacttaatatattcctgaaacctaccgcatgcaaacatggtcactctagaggagccttcttcagtcatacgtgcaccataaaatcacctaggttggtttcacaactcttgaaatacagccatacacaagaaacaatcaaatatgagttaccatggggtaaaatttgtgaatttttactttttttattagctatttactcaatttacatttcaaatgttgtcccctttcctggtttcccttcagaaactccctatccctccccttccccttgctcaccaagtcctgagttccttctcatggatagaatcatacatgatttttaaaccctgtttaggattaaaaaaatacaaactcagggattagccctagactcataggtgactctgtagatgtagatggcatctgggcctagagaaccctaagcctgcttgtcagaatcgttctggggagtggggttgtcaggtttccatggcagctacctgggcatttaaagggtctagcccgtggttgagaagctagaaaagtgaacacagacatccccatcatcagttttgtattacctaagcaagctctattaagaatgagtggcgggggcctctcttcccagtgatggccagggaatgccagggccaagaagcgggagtgggtgggtaggggagcagggcggggggagaatatagggaactttcaggatagcatttgaaatttgaaatgtatataaagaaaatatctaataaaaaaaagaatgagtggcaggaaagtaaacgtttttttgctgcttacacatccaacttcactggcaatccaccaacctgtgccaacccatgaacctccgactcccagaaggaaaacctcgacctattattttgactgcagcagacagattgctaaatacttatgtgggttttgtaagaataaaactccaagaagaggaaccttgcattaagaaaaacacacacatacacacacatatgcacacatacctccacctgcacacacaggtacacaggctcatgcatgcacacacttgcatacatacacgcacacatgcactcatacctgcacctgcacacccaggtacacagactctctctcacacacacacacactacacactatactgagataaaacactgaagcagtaatccagagttttccatacgcatagtgatcttcctgtcttacctgaattaccagcaaaattgttgtcattacctcacagcagcagaaaaatataggaaaagatttgagtttatgcatcttacatgaactttttatttggaaaatataatgccaatgctgtactctcttgatttggatacaaagtgttgttactgtataatacgaaggcatcgaaatgatgacaccccaggatataatgactgtttctagatgtgatgacatgactaaccacagacagcagtaatcttgtgttagtttcactcatgcaatagctttacagcttcttatatggtacattttaactttgtaaagtcatgcagttatgaaagcaatatttgtacaaatgcaaagcaagatctctcttacatactgttgataagaacatgttgattgtacattaagtattaaaaattggattatgttcttccttgcttgctactcctaagaacttaatgatttttgcattctttgttaacagtgcagtgtgctttctgttattattcatatctgactatagatactttcttgactttttcttgttttcaaatttattttgacttaacttgctgattttgtggtgctgtgtggaccaatgagctgtattccccaccccaactgaaaacatttttaaaaaattaataaaccttattttcagagaagatttggaatcgtagcaaaatagaaaagaaagcacaggaaagccccatatgcttcctgtccccacacgtgtggcctctccatcacatctacccttatcgtagtagctgaatatcttactctgcagaaaaaaacctacaaaccagttcagacacttactggattccacttcctagattctgtttagattcttcagatacaatatgatctttacaagactttcatatgcttgacaaattggtagagatagcaaaacaaacaaacaaaacacccaaaacaaaaacaaaaacaaaaacaaaaaccaacctggcaaagcatccatctagtgaagcaatttgcatggtaggaaagaacaacttccagcaacccagacacaggggctgagcagcactggggatctaggtcatcctgcctggcctgtatagggtatgaaggggaggctaagtcatcagtttgatggggaggttgagatcaatatctgtagtcagtgcccctggcccaacgagtggtctatggggctttaagttcgtgactctacagtaggttctgactccagagaataagtcaaacccttcattccacaactttccctccaccagctgctcccacacaatgccctaccttctttcttttacatgggaggacggagcacaggaagctgggctctgcctgctccagcagcccaaaagagcttacactgctgcctctgaatcatttccagagaagatgcagttttatctctgtgtttttcattctgaataccatcagtcacgagtgtgggcttagtccatgtagaaggaggactcccagacggctaggttcatgtacaataagcacatggggagcatctcagctctatctctgggcctagaatctaatgtgggagtttaccactctccctgctccctgaccttccacccactgtttggctgtatccccatcctctgcatgtgggcccttgggaaagaaagatctggaaggctccagagcacatttcaccaagaatctaaacctccaattaaggagtttagttcctctgcagagaagagcaacttacagcaaactgtgtaaaggtaggaatgttctggggccctggatttctctgcccattaagcgaaagtcatggctcacagtctcaaatggacagccttaacctttggtcagacctctggcattatgatctctgatgcctgtattctagctgaaggagagagcatttcagcctaaagagagtttgcctttgggagaataatctcttactttaactcagtctttgagagaaacgattccctattaatgaagtctaggagagaggaacagcttaccctacatgctttgcttactcatgctccccaccatctgtgcttcactgtatcttcagtttccctccatccactagggtctttctgtcccttggaaaaagaacactggagaacttggagggagaagcagtgaaaatccatgtgtcctttccaccactctcctaatggaaacaatgtgataggaccttgtggttacccatttgttaattgtaattatgtgactttggggaccttccatccttctgttgactgccaatgactctaaaagctcctggagacacaaaccttccgtagatagtggggccaagccctaagcgtctgatacagcttctgccttgtgttcctaactctgtgtctggtcactagctatgtagcttaggtgctatgtccaagaggaactagaaacattactgtggttccaactctggaagtctcccctgctaatgccaaacaagaggcattcctagcttcagccccataacacaacatgaatattaacatccagagtcaaaacagagcctgcagtgccatctctcatctttcaactatggttcaactgagattgtactctgagtctagagatctctaccatgtatgatttaataagtatctccaggtcccagaaaccaatcatgacccatatagtaagagcaggtgccaagtggtaagctctttattccagcttcccattcctagagaaagatgggaagagtttatgaatgggaaaacccttattgaggacaaaattgttgccagtgcttggaactgaaggtggcccagcccaagctgactgatcactgagtacaatctctccagagcaaatggcccatttagtattctacatgcacaacctctttcctgaagcaacagggcaataattctctaagagaaagtgtttactgaggaaggaacacccacccttttgcttctccaagactatatgaggctgcttcttatctgatgcttttatcttgatggagattgctgccttaaacctttccattttcccagaattctctgcatctgtttgcctctctgcatctctatgctgttatgctctcattcagctgaactctccccatatgcacaaacataagtgagaagcccaagacaagctgtagtagtcgatcacaaagtgtggggatttgtgaaagcaggaggtgttttcgtacacatcaataaaatgaagaagttgaaaaggtgaaggcccagaactggaaatatctactagatgcaaaactgtacgtgtgtgtgtgtgtgtgtgtgtgtgtgtgtgtgtgtgtgtgtgtgtgttatacacatgtgagcgcagaagccagaggatgtggtcctcttgctctattactttctgctttatttccttgagaaagggtatctcactgaaacttcatccatatagcaaccaacaagacacagcaatcaatccttttgtctccatccttccacaccactgaagtaacaagcatgtagccatatctggccatttacacattagggatttgaactcgggtccttatatttgcatagaatgtgtacttggctactaagccttacagatgacttttgaatgacctggcaaagcttcaaatagtattattgaagtgttttggaaaatagaaaaagatgagaagagtcttcccaattcaatctacaaacagattactacaaaaggaggaaggaaaggaggtaaggaatgaacaaaccaacaaaaagattcattcgagggtatttctcaatgagatacagaaaactgaatcattgattccagaaacttagggttgctcacacagacattttgcttatttacaggagacatgataacgaaagtactggcaggtgctcctgaagcattagataaaatgcaatcacacttaatgacttatgaatggataacaacattgttaagtagataactatgtctaccaaaaaacccctgacactttgagtaggaaccaggcaggatccatcatcactatttgtaccacttgaaactgttcagctattcagtgttctagaaacaagtagcttagctttctgtcactactttttaaaaataaaaattacccaaggtaaattacttgacgaaacaaagttctatcttggcttgtggttttaagcattttggacaatgaaaaactggtctggttgctgtgggcctgtggtgaggcagagcatcatgttagagctgtagggctgagctaatgcactcaccacctagcctgtaaggaaagagaaagtggagagggagaaagaaaagagaggggggagagaaggaaaggaaagagatgaaaagagagtgggataagagaaaggagtaagagcaagggagcacaatgccctaaaaggacacaccccaacccactgagccctacctccaatcacaccatcctaggcactaagtctttaacacacatttttttaaaaacacatcctggtctttgagcaacattatcattgagattttacaggtgccacttccctatcaagtctagaagacactgcctcaaaagggtatactggtcctctggctcttgcaaccttttcaacctgactgttctctgagccttcagtgtaagaagtgtgttctaaatgtatcgattggagttgggaacaccatggttaatttctctgcattttgaccaatcgtctcttgtaataatcctcgtgagctgctgaaagaagtttctttgataaggggtgaacctttattgccttccagaacttgccagtaagaccctattactaaagatgccacccacgtcagtcactagacttggaagaactgagctagaattgacctggaagccttcttctccctgaggactagcttttgtaatatctgcatgtgctaggtgagcagtcaagagagaagagtgattaatagttctacccaattgtcccacctgcaagccacaacaaggatgagtatagtaagccatccagagtggtacaatagtgacattttaaaaaatatttttagaaagaccaacagctatctgatcagatttaaggcccactcaataggaagcaatgtaaataaaattaatcattctatctagcctataaaaaagacacataatctagctattttatttacaaggtgtaagccctacctttggcaagttttgagctattctaacttatttcccaactataatgtcccttgttacttgctgcttttcctggccatgtgctatggttcatctcctctcatgagaactcctccatctcctgtgtcctttcttcttcttttgctcgaccaataaaccctcactcaatctttaagccccacctttctccctctactgcccaagagcagactcttcccttttattgaccaattgaattgggagcaagggttacatagcaccatttggtgtatatgaggatccgctcatcacaggcaaacagatcttgagagccaatattttgcattagaatacaagtagcatcagcccaacccactacaaggcacttcatggctggtactgtaaacctagccaactaccagtgttagaaagggcatggagcctaaaggataactcagcactgacatcttcttaaatgaataaaatgccttacagcattgtaaatagttattcctatacatacagaaaaataaatcttctaaaaacgaaataactaaatgagagttttggtaggaattaacatgaacatgcagaggctggagagatagctcgttggttatgagcactttttgcttttccagaggacctgagtttgacttcaaattcaatgcagtttacctgtagcctcagttttaatggatgcaatgtcatcttctggtttctggtgcaacagacacgtatatggtacacacatacatgaaggcaaagcattcatacacataaaataaaatagaaaattttaaatgcatggataaacttcaagactaaaacataaaagctacaaaatttgatcaagcataaaagaaactttaaagaatatattgcatttgtaagtgaaagaatattataaagatgccaattatccttaaatattacatgaatgcaatgctattcaaagggaaatttcaatggttattttgggaagcatgagatttagaacttggaatcaaaaacagaaaatgtatcaaaataggcaaaaatatttgggaaacaattgagtaggaatagcagtgttataaaaatacaccacgcatataataattcaagttatataatgcaaatgtattctgaaaaatagtgaatagaaaactacaatttaggaaattgacacatataaatggaaatgtagcataaaataaaaattgatatttccagatattagaggaataagagatttctaaaaatagctttagagaaattttctacacatttagaaacctatttcacaggttattaaaaaaacaaattcttgatggtctgataatcaaaaatcaaaacgaaatattatatagcacgttcatgattttgtgt

SEQ ID NO: 70 - DNA, 5895 bp, Mus musculus
ccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggccaaagataccatctattgccactgggattgtgggtggcctcctcttcatagtggtggtggcccttgggattggcctattcatgcgaagacgtcacattgttcgaaagcgtacactacgccgcctgcttcaagagagagagctcgtggaacctctcacacccagcggagaagctccaaaccaagcccacttgaggatattaaaggaaacagaattcaaaaagatcaaagttctgggttcgggagcatttggcacagtgtataagggtctctggatcccagaaggtgagaaagtaaaaatcccggtggccatcaaggagttaagagaagccacatctccaaaagccaacaaagaaatccttgacgaagcctatgtgatggctagtgtggacaaccctcatgtatgccgcctcctgggcatctgtctgacctccactgtccagctcattacacagctcatgccctacggttgcctcctggactacgtccgagaacacaaggacaacattggctcccagtacctcctcaactggtgtgtgcagattgcaaagggcatgaactacctggaagatcggcgtttggtgcaccgtgacttggcagccaggaatgtactggtgaagacaccacagcatgtcaagatcacagattttgggctggccaaactgcttggtgctgaagagaaagaatatcatgccgaggggggcaaagtgcctatcaagtggatggctttggaatcaattttacaccgaatttatacacaccaaagtgatgtctggagctatggtgtcactgtgtgggaactgatgacctttgggtccaagccttatgatggaatcccagcaagtgacatctcatccatcctagagaaaggagagcgccttccacagccacctatctgcaccatcgatgtctacatgatcatggtcaagtgctggatgatagatgctgatagccgcccaaagttccgagagttgattcttgaattctccaaaatggcccgagacccacagcgctaccttgttatccagggggatgaaagaatgcatttgccaagccctacagactccaacttttaccgagccctgatggatgaagaggacatggaggatgtagttgatgctgatgagtatcttatcccacagcaaggcttcttcaacagcccgtccacgtcgaggactcccctcttgagttctctgagtgcaactagcaacaattccactgtggcttgcattaatagaaatgggagctgccgtgtcaaagaagacgccttcttgcagcggtacagctccgaccccacaggtgctgtaacagaggacaacatagatgacgcattcctccctgtacctgaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacctccaagcagcgagtttattggagcatgacaagaaggggcatcataccagctataaaatgtctggactttctagaatcccaggaccaactatggcagcacctccacttctggtagccatgcccacgctgtgtcaaatgtcactcagactggctttaaagcataactctgatgggctttgtcactgagccaagaagtgggcctctctcctgatgcactttgggaagttgaaggtacatcaattgatcttcgaactgtgaagattccacaaaaaaggtatccatcgagaacattgtccattggaacagaagtttgcctcatggtgaggtacatatgggaaaaaaacagacatatggagcttatatttagggaactttgggattcttgtctttattgatttgattgatgcactcttgtagtctggtacacagagttgcctggagccaactgaccagacagttggttccaccagctctgcatcaagacacttccgtggcaagacaactaaatgtataagaagtccatggatgccctgagcaggccacacttgtacagcattaaaccatggcagatacaataggataagccactttgttacttactggggctgggagaagaggaatgacggggtagaattttccctcagacgtactttttatataaatatgtccctggcacctaacacgcgctagtttaccagtgttttctattagacttccttctatgttttctgtttcattgttttgagttgtaaatatgtgttcctgtcttcatttcatgaagtaaacaaacaaacaaaaaacccagtattaagtattatcaaagaacaaccatgattccacattcgaacccattcaaaccatcagtattgtgaccaaaagcctttaactaagaaggagtaaccatgcaaaaatccatagaggaatttaacccaaaattttagtctcagcattgtgtctgctgaggtgtgtatatgagactacgaaagtgaactactcttcaaatccactttgccttcactcctctataccctaaatctagtgtaaaccacacatggaggataacttttttttttaattttaaaagtgtttattagatatgtttttcttcctggtaaactgcagccaaacatcagttaagagccatttttgataaacactatcacaatgatctcgggatccatcctttccgatttaccaagtgatggatagacgtgaactcataaacactacccataagacaaaacaatgagtgccagacaagacatcagccaggcaccagagcacagagcaggactgggcaatctgttggagatatctagaaagttcacaaaggaaacaagattgtccactaccttgtgagatctagcagtcataaataccagggaaatggaaagtgtgtttccttacagcaccaggtcttcgatcttcctaatgctgtgaccctttaatacagtttgccatgttgtggtgacccccaaccataaaattatttttgttgctacttcataactgtaaatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgaaaatagatgtcatccatgaaattaaggagtgagaatattaagcagcatttatagagctcaaaattccatgtcatcaccaggaagtgccatgttgatcacagagaacacagaggagacatatagacagggttttgctcaaaattgggatatagaatgagcctgtcaggtacctatcaggagcggtaatccgtgagagagaaccgttgcaagccactctaactgtagcaatgaaaccctagtatttttgtactttgaaatactttcttataacaaaataaagtagcaaaaaaact

SEQ ID NO: 71 - protein, 1198 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVQITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNIGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGPKIPSIATGIVGGLLFIVVVGIGLFMRRRHIVRKRTLRRLLQERELVEPLTPSGEAPNQAHLRILKETEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASDISSIKGERLPQPPICTIDVYMIMVKCWMIDADSRPKFRELIFSKMARDPQRYLVIQGDERMHLPSPTDSNFYRALMDEEDMEDVVDADEYLIPQQGFFNSPSTSRTPLLSSLSATSNNSTVACINRNGSCRVKEDAFLQRYSSDPTGAVTEDNIDDAFLPVPEYVNQSVPKRPAGSVQNPVYHNQPLHPAPGRDLHYQNPHSNAVGNPEYLNTAQPTCLSSGFNSPALWIQKGSHQMSLDNPDYQQDFFPKETKPNGIFKGPTAENAEYLRVAPPSSEFIGA

SEQ ID NO: 72 - DNA, 2986 bp, Mus musculus
agtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggtacgttcaatggcagtggatcttaaagaccttttggatctaagaccagaagccatctctgactcccctctcaccttccagtttcttccaaatcctctgggccagccagaggtctcagattctgccctcttgccctgtgcccaccttgttgaccactggacagcatatgtgatggctactgctagtgccagcttcacaagaggttaacactacggactagccattcttcctatgtatctgtttctgcaaatacagccgctttacttaagtctcagcacttcttagtctcctcttttcctctcagtagcccaaggggtcatgtcacaaacatggtgtgaagggctactttgtcaaatgaaaaggtctatcttggggggcatttttttcttttctttttttcttgaaacacattgcccagcaaagccaataaatttctctcatcattttgtttctgataaattcttactattgattgaaatgcttccctgaggaacattaaattatgtatgaatttccattcaaagtcatcatgcagcagtggtatcaagcaggcagcatctagtgcagaactgagattgtctacagaatgcctgcttgatgctcagccttatatcccagttacggacatgtctacaaatagcccttctcttaccatctctcccttaacttcatgatgtggtagctgattccttctgccatcaactgaaatggcaaaataaaggaaagcctgaatcctgtctcccctcttagtttccaaggacacttgcccagaaaaatgcgcccccccc

SEQ ID NO: 73 - protein, 649 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVQITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNIGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGYVQWQWILKTFWI

SEQ ID NO: 74 - DNA, 209083 bp, Homo sapiens
caaacatgcagtcatgtttttttattgttgttgttaattcataaactttatttttagagcagttttagtttcacaaaaaagttgtgctaaaaatatagagagtttttgtatacccctgtgcacacacatacatagcatccccccaaaagtggtgtctttttacgactgattaccaacattgacacatcattatcacccaaagtccatagtttatgttagggttccctcttggtgttgtacattcaatgggtttttacaaatgtaaaatgacaggtatccaccactgaaatatggtatagaatagtttatcagccctaaaaatcctctatgttctgcctattcatctctccttcccgccaaccactggcagccactgatcaccttaccgtctccatagatttgccttttccagaatgtcatatatagtcatgcatcacttaacaatgaaaatatgatctgagatgtgtgtcattaggtgaatttgtcattgtatggtcataacagagtgaacttacacaagccaaaatgatatagcctactatacatctaagttatatggtatagtctatttttcctaggctacagacctatctgacatgttactgtactgaatactgtaggcaattataacatagtggtaaatatttgtgtatttaaacatagaaaaagtacagtaaaattatggtattataatcttatgaaaccactattgtatatgggtgccattgttgactgaaatgtcattacgtggcacatgactgcagcaggaatcataaagtatgtagccttttcagattggcttctttcacttagcaacatgcacataagtgtcctccatgtcagttcatggcttgatagcatatttctttttagcacagaataacaatccattgtccacatgtaccatggtttatttatccactcatccacatgaagacatcttagttgattctaagttagggaagttatgaataaagctgttataaatattcatgagcagatttatgtggacaacagtgttcaactcatttgggtaagtatcaaggagagaaatcattggatcatatggtaagagtatgtacacttttataggaaactgctaagctgcattcctaagtggctgtaccattgtgccttcccatcagcaatgaatgagacttcctattgttccacatcctcatcagaatttggtgttgtcactgatctgaattttttccattgtaacagatgtgtagtggtatctcactgttgttttaatttgcaatttcctaatgacatatgatgttgaacatctttttatatgcttacttgccatcagtgtatcctctgatgaggtgtttgtgtagggctttggcccatttttaaatcaggttatttatcctcttattattaacttttaagagtttagttctttgcatattttggataacaatcctttatcacatatttcttttgcaaatttttctccagtatatggcttgtcttcttctcctggcattgtccttctcagagcagaagtttttaattttaataaactccagcttataaattatttatttcatggattgtgcctttggttttgtacttaaaaagtcattgtcatacctaaggtcatctaggttttctcctacgttatctcctaggtgttttatagttttgcattttacatttatatgtatgatcagttttgagttaatttttatgaagtgtgtaaggtttgtatctacattcattttttgcatgtggatgtccatttgttccagcaatatttgttgaaaagactatacttgctctattgtattgtgtttcttttttgtcaaagatcaattgactaaatttatgtgcgtcagtttctgatctctctggtccattgatatatttgtctattctttcaccaataccacatagtctagactactgtagttgtatatgtcttgaagtcaggtagtgttgatcctccaattttgttctccaatattgagttggctattgtgggtcttttgcttgcccatagaatcaattagtcaatatttacaaaataacttgctcgaactttgactgggattagtctataaatcaagttgggaataagtgacattttgacattatggagtctttctgaccatgaacacaaactattgatccatttatttagttatttgatatctttcaccagagtttttttgtttttttcttatagatcttatacatattttcttatattcatacctcagtattccatttcagggtgttaatgtaaatggtaatgtgtttttaatttcaaattcccttagttctttgctggtatataggaaagtgattggcttttgtatgttaacgttgtatcctgctcacttgctataactgcttattagttccaggagcttttttattgtttcttttggattttctaagagacaattacattatcagtgaacaaacacgatttatttcttccctcccaatcagtattcattttatttatttattgtgtgttattgcattagctaggacttctaatacaatgttgaaaagcattggtgaaaggaaacatccttgctttgttcctgattttagctataggtttttgtagctgttctttattaagttgaggatatccttctctattcttagtttgctgagaatttttatcatgaataggtgtaggattttgcctaatgttttcttctgtatctattgatatgatcatgtaatttttctttatctattgatatgatctgttgatgtgatgaactacattaattgagttttcaaatgttgaaccagtcttgcatatctggaataaatcggagttggtcatcatgtataactttgttacactttgttgcatttgattttgtaatattttcttgagaatttttacatctatgttcataaaagatatcggtctacagttttctttcctttcttgtaatatctctgtctggttttgctattaaggtaattctggcttcacaaaattaattatggagtcttccctctacttctagtttctggaagagattgtagagaatggatgtaatttctttcttaaatgtttgacgaaaatcagcactgatctcatctgggcttggtgctttctgttttggaaggttattaattatttattcaatttctatagtggatataggcctatattgattggcaatttcttcttgtatgacttttggtacattctatttcaaggaattggttcatttcatgtaggttgttaaattcgtgggtatagctgttcataatattcatttattatcctttcaatgttcatgagatcagtagtgatgttccttctttcatttctgatattcataatttgtgtattctctctttgtttcttagcctggtgagaggcttataaattttattgattttttgaagaatcactttttggttttgctgattttcttgctgggattataggcgtgagccaccacactcttgctcattttttctatttttgttttccacactttttctgcctctgtggattttacacagcattttgtataattcgatttcctctttttagcatagcaattattttagtctttaactttttaaaatcagttgccctagatttttttctcccaacattttgggaggccaaggggggaggatcacttcaagccaggagtttgagaccagcctgagcaacatagcaaggcactatctatacaaacataattttaaaaagtccaggcattagctaggactgtgcctgtagtcccagctactcaggaggctgagatgagaagatcaccggagcctagaaatttgaggctgcagtgggctgtgatcatgtcacttcactcctgcctagaagacagttagaccctgcctctaaaataaacaagcaaataaataaaaagaaaggaagaaaagaagagcaagggcagcaaatagaaaatagtaataaatatggtagctattaatccaactatgtcaataattaccttaaatgttagtggtctaaatatactgcaatggactgaatgtttatgtctcctcaaaatgtatatgatgaaatgtaagctcccaaaatgatgttatcaggggagagtgtttttgggaggggattatgtcatgagggtggaggccttacaaatggggttagtgctataaaagagaccacagagagctgccttggtccttctgccatgtgagggcactgtgaaattatggccatctatgaagaagtgggcccttattagacatcaaatctgcaaataccttgatcttgaatttcccagcctccagaactatgggaaataaatttctgttgtttacaagtaaatcattttatgttattttgttacagaagcccaaaaagatgaagacatacaccagatcactccattctcttcttgcttgcatggtttctgaggatacgttggatgtaattctaatattctctataggtattttctttatggctcctctacaggtaaggtgttttttccctttggcttcatttaagaatttttcgttaacctttgattttctgaagtgtgaatatgttatgcctaggtatcatttgtttgtttgggttttcttggcatatatcttcctgatgttctctgaacttccagaatctgtgatttgttgtctgacattaatttggaggaatttttggtattattgctttaaatattgcttctgctcctttttctctttctttgacttacagtattcccattacatgtaattatctcacagttcttgaaagttttgttttgttctttttgttagtcgtttttctttctgtttttcagttttggcagtttctgtttacgtatcttcaatctcagaaattctttcctcaagcatgttcagcccactaatgtgtacttcaaaagtattctacatttcttttacagtgtttttgatctctagaatttttaaattctttcttaaaactttcatctctcaggaattcaagactagcctgggcaacatagtgaaactctatctctacaaaacattagccaggtatggtgatgcatgcctgtagtcagagctactcaggaggctaaggtgggaggatcacctgagcctgggaagttgaggttgcagtgagccaaggtcacgccactgcactctggattgggcaacagagccagaccctgtctcaagaaaaagaaaaattccatggctctgcttacattatccatctgatcttacatgttgcctattttttccattaaaactcctagcctattaatcatagtttttttataattaatactccgatgtgataatgtcttagtccaattactgtggttataacagaatgccacaaactgggtgatttataaacaaaagaagctgatttaggctgatttagaggctggggagtccaagagcttggtgctagcatctgatgagtgtcttcttgcttcatcataacatgggagagggcatcacgtgtgaagagagcttactcttataacatagccactcccacaagaattaacccaccgccatgagagccatgtgaattcattcatgaggacagcgggttaagtttccaatatatggacttttcggggacacattcaaaccacagcagttagttgtaacgttcgtgtcatgtctcattctggttctgatgcttgtgcagtctcttcaaactgcgtctttgccttttagtgtgccttgcaatgtggaaatgatgtactgggtaagaggagctgtagtaaagaggcttctagtgacgtagtgacaagctgtggggagagggagtgttgcacagtcctgccgcatgtcacagtcttccagtgagcctgtgtccctggactgtgaacttcatgcttgcttctcagcttccccagccccttagatggtacagaactgttggaggggggtggagttgtatatttcccttgctctgggtaggtcaccctctgataaaacaccaggttaggcctctggtgaaataatttctcctgagggcagaccttctattaataatagaatgttccaacctatttcaaaatggttcctcttctccttccactgccagaagcataatgagattttccccctaatattcgtggtaaggacctagcagagctccaggaggtaacactctcaagtgtctcatactaccctgcaccatgactgggctctgctggagttcttaatttgcagaactgcccacactgagcctcccgcaatttctcaattacagggcaaactttcccagccggcactgggtccttggaggtttctgtctgctggtttcttcctctggaggttgtgcttctgtgtttgcctgtctctccaatttggggggcagtggtttgcccaatgacctcaattctctgaaagagctaagaagaggtgttaatttttcggtttgctcagctttctacttgttgctagaatggagcgccaatagtgcctcctatagtgacatgtaaccctcaactctagagatgatgaagcatactaatgacaaaggagaaatgcttcagcagttttctgtcagcacattaccccttgaaaaagctgcttcttccacattctgcaagagatggtctcaactcagagctcaaggcaaatgacttccttcaaggagaaggaataaacagtctcagaaaccatgaaagcctgctcccaggagtgtccctgaacctcagcaggggccacacttaccttgcagaaataggtgaggcatgctcctggtacaaaatcccaatggtacagaaggacaaattgaaaaacaagtctccctctaaacccctgaccccgagctacctagttctcctccctagaggcaaagctgttaccagattcttgtatctccttaacatatatccttagaagagctgtcaagtgaacacatgtttaagtgaaaacctattttagaagtgcattttcttaaggaactttagggttggaaggaacctgtgtcagtccttaattcacaacctccattagtacttattgttcttgcacaaaaatctttctcaaaaaagccctttccactctgacatagcttattctacttttacttagctccaataacttataaaacatatttttgaaagtctaaaatctgccactatgtttttttttcctaatcaatctttactttgacctctaagccagagaaaacaggtggtcaaatgccttttgcctaagatggaacttagaatatttgaagacctcagatcttcaccctgccaaataacgtgtttctcctcccctttcacagagcatttggttttaggaaattcagagccacattccttatagacaagactaaactcttattcaacatactcagaaacttcttctaagaggataaccactcatcagaggaaaaaagtttctcatgtacagctggcaaagggatggaaccatctgtgttattaaaattgacagacgcttatgagatttattaagggaaatactagagtcttagtacatacttgctaatatagcatacatgaaggctttatctataatttttttggccaagcagaaattttggtattactcaccctaacaaatttccaagacattatgaaatagaattttaggtcctgacatcaccatttgtctcaggttttgaagcgttgctggacaagaggggtaaaacacggctctgccttggattcaaagttggcctctcatactagcaagtataccttggtatcctggtcacttctcccggccacagcatcacattgctataaaaggcagatacaagtattaaccagctcacaggttatcagataagcttagtctgaccaatgcttaacacagcaactgggccactattgtcattcctgtggtggtggcacacacacccagcctctgtccgggccatggtctaggaccaccctccacagaggctgtgagctagagccctaactgtgcagggccctaactatgccaggctacttatctctcttaagaggacttcattagtgcctgctcggccatacagttttttacttaccaagtaacacagttatcagcacactccaggtactagccaaggactacaaaatcaacgtgaatgtcagcttttgtatcaaaagctcaaaggagaaactcaaactttacatagatgtcccatgaagatgttcagcaaacccattcttctctgttccctggaatccatcccagtattgtgctatgtgtgtgtctagtaattctttacaaaaagctctgtttcttgtgatgctatcagatcacattgaagaatatacaagccgtactatgaaggctgttgtctcatatagtcctaacgtagtgagaactgatgttcttacatgctgtctttttgggcactcaaagaaattcctgtacagtcttacaaatcagttgtagcttaaattgatttgtgttgtgacttgtacacacaggtcacattcccttgacagaaaatatagtttaaaaccaaatttgcagcccttgttaagtgaatgcacaggactttattgtattcaggtcttttattgtaagactcactcctgtcttcattttatgttccactgttgtgcttcccatttgcctttctctagttttgttttctgtgtttctacggactgctctcagcccaggtgtgcaggaagcacacacatgcctgcagagccttcatggcctctgcattcagggcatgacttcaacgcacagtggctgtactgatttgttaaaacaaaggaacagattacttctcctaattcacagggaagttccaggttgtgcgggcagtgagcagacctgtgtctgtctgcgcttgccctggtgaaaaaccccaccgttcaggctgcagggtgcgagacccaggcacaaacattttgctggatgaggaggaaagatgtaaggttgctccccttcagagacagcaaagggcaggtctgtagcttcacttacttcaggattgtgatttttgacagagccgagagatcagggttgttgaaccaggcctgaaggtcctagtgaatctcgtgaagagaggaggggtctggctgtaacatggacctagaggacatttttactgcaggagaaggaacagtggggatggggtggacttgccaaaggaatatagctcaagttcctgcagcccaaaaaagctcagtttcttttggccaaagcttccgcgagtttccctggcatttctcctgcgggagctacaggggcagtgggacacttagcctctctaaaagcacctccacggctgtttgtgtcaagcctttattccaagagcttcacttttgcgaagtaatgtgcttcacacattggcttcaaagtacccatggctggttgcaataaacattaaggaggcctgtctctgcacccggagttgggtgccctcatttcagatgatttcgagggtgcttgacaagatctgaaggaccctcggactttagagcaccacctcggacgcctggcacccctgccgcgcgggcacggcgacctcctcagctgccaggccagcctctgatccccgcgagggtcccgtagtgctgcaggggaggtggggacccgaataaaggagcagtttccccgtcggtgccattatccgacgctggctctaaggctcggccagtctgtctaaagctggtacaagtttgctttgtaaaacaaaagaagggaaagggggaaggggaccctggcacagatttggctcgacctggacataggctgggcctgcaagtccgcggggaccgggtccagaggggcagtgctgggaacgcccctctcggaaattaactcctcagggcacccgctcccctcccatgcgccgccccactcccgccggagactaggtcccgcgggggccaccgctgtccaccgcctccggcggccgctggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcctcgttggcaaaaggcaggtggggtccgacccgccccttgggcgcagaccccggccgctcgcctcgcccggtgcgccctcgtcttgcctatccaagagtgccccccacctcccggggaccccagctccctcctgggcgcccgcgccgaaagccccaggctctccttcgatggccgcctcgcggagacgtccgggtctgctccacctgcagcccttcggtcgcgcctgggcttcgcggtggagcgggacgcggctgtccggccactgcagggggggatcgcgggactcttgagcggaagccccggaagcagagctcatcctggccaacaccatggtgtttcaaaatggggctcacagcaaacttctcctcaaaacccggagactttctttcttggatgtctctttttgctgtttgaagaatttgagccaaccaaaatattaaacctgtcttacacacacacacacacacacacacacacacacacaccggattgctgtccctggttcaagtgtgccaagtgtgcagacagaacatgagcgagtctggcttcgtgactaccgaccataaacccacttgacaggggaaacatgccttggaaggtttaattgcacaattccaaccttgagctgcgcgggttccaagagccaggcccgtacttgctgttgatgtcattggcttggggagttggggtttggtgcccagcgcggtcgttgggggaggggcaaggcatagaacagtggttcccagaccttgctgcacattggaattacctgggattaaaaaaaaaaaaatcaaaacaaaaaccagtgtctggctcccgcccccagacattctgatttaattggcatggggcaagacctggacttgggattttttttaatgctcttcatgtgatctgttgggcagccagatttggggatcactagacggaagaaggattgttaaagtctccggagatgttacttgccaatgctaagagctctttgaggacatctggaattgttacaatattgccaaatataggaaagagggaaaaggtagagtgtgattccaataataaaggattccgcttttcattgaaggaactggtggaaaggtttcttctctgctgagcctgcaggcccgtcctgcctgcctggggtgcccgggagacgcgggcctgctccggagactgctgactgccggtcctgttagtcaggtgtcagccctgtctctgccgaagagactcttctctttattttaaattaaaccctcagagcaccaccaaagcatcacttttctccctccattggtgttctcattctttgatgttacttgtttgaacaccactattagtagttggagatttgttcctgagaaaaatataaataccacttaatttgcctgtttgtcccgcattcactcaaaacagaatgctcctgaagacaagagagagagtaggagaacagacgctattccattacagtaacataaaagactggattttcaggggcaaattattaaaataggagatgagctcttttaacagaaatttgtttaaggcctgtgtctatcaaattcagtggattttattcaagatgcactttgtttagtgggagttttgtttggttctgggacatgctaacttctagacttgctgctcttagaggttatgactgccagacaccatttcatgagtcctaatccccacattaagcataagaggtgcacactctcctcctatgggggaaactgaggtacgaagaactaaagtgactttcccacagctggtgggaggcagacgggaaattcacaccaggggcttccaactccagatccctctctcaacttccaaactccactgccttgtccgagttctggtttcaggagatccaaatcaggtgtgtgcaaatgtctaatgtcagagctggcaaggggaaagggcccagggagccggctcatgacgatgagcctgtctgaagcttcaacgcgggctgtccggcagtctgcattcctgccgagttcctcagccctctgttgggtcaccttccatagaggcagcttagtcctcagttcagtgagcatggagtggagactgcttgaggggtgctgagcaaagccctgcctcttacaggatgaaggtgctctccagaagggacactggaaagtattccaaggcgagtcgaattcccaactgagggagctttgtggaaataagcccgcccagccccacttctggagacgttcccattcagtaggtccgagctgtcttaaagagaaaccaaagtggggatattaatggtatccaaagtgagatctaccccaccctccctcctcaaaggaggtcagatcaagaaagcccaagcccggcctggcaattgggacctttcttctcactccagcccagggtgaaggtggacaagtcactttgacccttcaggcttctgagctgttgtttctgaattcagtgaatatttactgagtgcatagaatatgctagatattctgggctaaaggttgaagggggggtgagttttaagggtttctgctcttgcttccagattgctttcaaatctggaaaggacaccagtggtttgtgcgttagacccacactgccgtagcacagaatacaagaaactggctgagagctccaataggcttttaacagtaatttctggcttcacgtatttagtttcataactcatgatttttcaaaaacttctggtttgaagacaccgattgccgaaagtccattgtgctgcataattacacttggtccacgtgacagcactaacatgttctgaaatgtttttagaagtagtctcagcaaagatgaaggattcctccctgtttgaaaagaaaatattctttgttttttctttgatctaagctctaagactagcagctagcatctgaaacttttttgacgagagtgacaaaccaactctaatattaaaggcaattgatgattatgggcactgaagggaaggtaaccccaggctggtgccccggaatagggatgggtcacaatgttgaggacatttcgcctgttgcagaacccacctgcaacacagtgtggcccttgccatgtgacttgtgtgtgtgcctgtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagctactcaggaggctgaggcaggagaattgcttgaacccaggaggcagaggttgcagtgagccaagatcgcaccattgcactccagcctgcgcgacagtgtgagactccatctcaaaaaaaaaaaaaaaaaaaacagattctgttcctcagatccattccatttttgttttcctttatcacttatggacatttgaaattatggtaataaacattgttagtctcagttaattattactggtttattcttgaaccactaatccatagagaatagagtgtaaatcttaacttgttcctgtaggccatccccattaaacatcatagtgttttctcattcgttctttttcgttttcctcctacaggaatgaattttctaagaaaattccagcagttggctctttggacgacatctctagattgtcctccattgggcccataggcacaagctggccagtttgaatttgggcaagaatccaggcattggaacttattcaaataactagtttgcctgtaattttcactttttcagagtcatctgataaagctttcttgctacacatttagatagatacactcaatccagttgtctagaaagttccctgagccagctgggagcaggaggggtagttggggccaggaatattgggggtgtgtttactgagcccctagaaagtaagtgctagatttgacatttcaatccctgaaggccctgaagttcagtatcaaatgactggtcctgtggactgagcatctgtgaattgcatatgcttagagtaaattttactcctaccagtttcagcagcttgctttagcaagcagtatggaaacactaacatgggggagtagaatttctctctctgatccaagttttatctcattctggtgggttttcaaggagagactcggagtccaagtgtcctttctgaatatatctggaacttctcattaacaaaagactcaagttataatttaggggacaaggcacccaatgagaatgccttgcaggcagccctaagtacacctgcaattacaccattactagcgcggcagcacacatggccctgacttagtttaaataattacgtaagtcaaccatgattgtttgccctttgcatagaagggcaagtattggtacctgttacaacttaggcttttttttctttatgtttgagccatgatgagtgatttacactgttgcatccatatgttgagatgtaagaataaattagacttggtaattgcccttaagtgtctggaagtcaactggggaaagagagctagagataataagtgtgaaacaatgtcacagaatcaatgacggaactcttcccaggacaaaggatgacttttgagttcagtctttgcctttaattctacatggggaggagagcacgtttagccacaaatggaagggattactcatttgagctatttggttatatgattatttccccagagaataggatgtgcagggcattacacaagcagtgccaatagcagcaaagttcttgagagtgctagtaattcaaatggcaggaagagaaggaataaatggtaaggctacctacagttcacagagagctccatcctcactgtggctttggattttgtcctgtgtgaaagagaagtgactgtgaactgacatgctgtgtttggtgttttagaaagatggctgcagcagcggtttggggaatggactgcaggagtggcattggaaacaggaaggttcatgactattgccagagacagaggatgaagcaggagcaaggaagattcaggacaggggactccggggctgatcaggaggcagaactggttgataagtatatgtagcagcataagaaagaaagaatcccagattgacacccaggcttctcacttggaagcctggatagatactgaatgcaatcacaaaggctgggaagtcaatgggactgcagggaagggaagggaagggaggagaagaggaagggcaggagggtccaatatcaatattcagcttttagatgtgttgagcttgaagtgctcagatggagaagtccaggaggcagtagaatacggtggtccagagcacaggagagcaatgtggcttgagttgtcatttgctcacatatttccgtgtcagttacttgtcttagatcacagaacaagttctcctctcacagtttcctggctccacctgtctcatgctcaccgtcagcatcgaaattgagccacaccaggggttctggataccagcttctctctaggtgaggctgctatagtcagcagctgattagttgcagttatcagcaactggtaatataatatattgtgcatataagtgtaccagaagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaagatgccagtctcgggataacctctctctggccggaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctgaggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaaggtaaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaatatatatatatatatatatatatatatatatatatatacacacacacacacatatggaggtaaagaccactgcttgctttgcagttgttttaagagcattcatgaaggattttattttataagcagaaatgtgatatctgacgattttaccactacatgcttgcaggccagtgcacagcagatgacgtcatgattgttttagcagtcctatcgttttacttatgatgtcattacaaccctttgctaaaatttctttcctttactccaggttttggataaaattgatgcattgcacatagtctctctgataagacaaactggcatttgtatgtgaaaaactgtgcatgttttagtgtctctgctgatactcaaattatccattattttagtgctggaataaaaacaaaccacttagtgaatttgtgcaggtccttaaggacaggcaaaggtgtcctgagattttctgatcattgtataccaaattttagaaactttttcaaaaacatttttttaatttcaaaaacctggttttgtttatttaccagcaatcattgaatacctgaaagctttcaggagattttattacaatggtttctattcacttacaaaattatctcctagttcattctcatacactgtaagccattgtaaatgcttcaaattgtgccgaacaagataaactagacaaactattttaagtttgttctagtgctaacttgcaagatctaatggctccaactagatttttaaaataaagtatattttaatatattattagaaagttaagcaattatctgtttataggtaacaaaaaccctggaaccccaatgtcagatgtcatccacttttgattaagtccaaacatatgacagataaacaaaagatggttggctgggctcagtggctcatgcctgtaatctcagcactttcagaggccgaggcgggcggatcacaaggtcaggagtttgagacttgcctgaccaacatggtgaaacccgcctctactaaaaatacaaaaaaaacagctgggtgcggtggcacgtgcctgtagtcccagctactcaggaggctgaggcaggagaatcacttaaacctggaaggcaggggttgcagtgagctgagatcacaccactacactccagcctaggcgacagagcaagactcagtcaaaaaacaaaaaaaaagtggtcattggagaattattgtgtcacctgttgttttttaatgtactaattttgagaggcttttaaatagagtgcactatagaactttttcttggcttcaatttgctacaatgttaatagagaatcagaaaccttatccttatagatgtttcttgatttttttaatttctggtgacatttatgagtgagaatagtgtattgccctgttttctttcttactcccctttcttcttccttccttgctttctttcttcttcccttccttctttctcttcctcgctccttcttttttacaagctgttatgaattagccttcacagagaaagaaaaatttttataaataactggaaatgaaactttgcaaaggactgcagatgaaaaactttgtcaaatgactgtaaaaatatactatataattttcaaaagttagaaagtaccaaacacactcagtattcatggttatacaagtatgcatacacatgtattgctccctgaaaagtggtgttgttaagggagtttttcttagtacgcggcttaacatatttttttctgtaatttgttgttagttataatggggagagaaaacaggttagagtctcccctctcagtttcaccttccataaaacagctaaactagacgatcgtcagactccttccagctgaaaacatctgtaaaattaaaaacaaatctaaatgtatgcaagatatgtatttaaacatgctggtaataagtgtgctgtccctataatttagatgctaaaacattgatgtcataataataacaacacctcgcatttgtacagcacctcatagtttacacaatgccttaacattcttctctctcagcctcctacaaccccacaggattgggatagctttccagattgggaggtgagggacccaggctcagagcgattctgctgttgtccgtaatcaccaggctggtgatcagtgggcactgggtgctctcctgctacacagcactgtctctcaacatgcaggtcaaggttacttattcctccttcaagacgtcattgggttttttagctatggatgccccatcacttttagttctatttgtgaatcaaaggctaaataaagtattcctcaaaatttgttatacttctgttactaatgcttaatgtccctcacaatttctgtatatttctgtgtatttctgctctgttttggttcctttcccaggtttcttttttgttatgaagtagtttttagactcaagtctcttctgtatgtgttataactgcccattccataagatacagggcagtgaatttgtgagccttgaaaatatttactttagaaatgagaagtatgacttttcaacgttgtgtcatcaacttctgtaaattttccagacctataaatacttgcagaaaaaaaatgaaaggagaaggcaacttgatttagcagttgggtcagttagcaatgcctatggcaagctgtagtaattcccttacatagatttgtaagactcatttctatgatttaaatgaaggcatacacttaacctctttagggtgtgaaacagcttttacaaaaagagacaaacttaagaaacagtgtggccctccaagagtgttcattttccatatcataccatttgtaataagctattctggctgggatttacttgcaagcattggcttttaagaagagatggtttcacacatcaaattattcacttggaggcactttctgggttgaaggaatggaatggagagtgcggcagtgagtagatctctcagtgacggtgatgtgcctctcccagaagaaatttcaaaatgcagtgttcattttcctccacaagaaaggaagaaactgttttgttattgtttattcctaacatagtggaaacttttcagtactctggcagaaatttcccaaaagcaattttctatttcatgattataaagtagcaaaggaaaaagtcctgcactccagctgagcaatggatctccagttgttatctaggtgctgcaggtttagagaggattgccaggagaacacatcgatttttcaggcctgtgatgacgtatctcttgttgaataagtaaacccttccagtaaacagacagttagtatattgatttcagggtggctttagccactgaacctgtaagtcttgcaaaggttacttgggcaaaagcatcattattttaccttcagtcaacaaaaatctacctggccaaggcagaacagaaagttcagcaatttgatgaagtgggacaacatgaagaatcaggtgagttgcctactttttcacttcactttccacctttagagattcttgtttagatgcagagtagtgacgtgcctggtgtcagggagagagagttgaatgagaaaagtcccagaagggcagaagacttgggtgattatctgagtccatctttccttatcacatgacagagttcttgaagtcttggctaggaattctaggcttttagattctttgggcaatggctactaaatgttcataatgttgctcagttgcaaaaacaagacattcaaactatagccagggagataagtagtcacgaactcaaggcctaaattctgctgatggagccgatgagaattgggtgctaaggcaaagagagttgccaatattatattcttcggggttttttgtttttattcgcattttggaaaaggaaaatattagcattcctctgacttaatattgagaagacattgggcactctttttcctcccacacttgtcttctttcactaggtgacaagggaagaggtagcatgaggtggtggtcacaggtgagaggggctgttgtgagcacaggcatgttgactgcacattggtcacctagtagaagttttgcaggcttggtgacttctgaacactgttttcaaggttgatttttagttgagagaacctctaggtaccacgtaatgttattaacagtagtactgatctcacaatcgccctatgtcccattcacaagatgttctgccaagccataaaaggcccagttaagtttaagagaagtctcaaaagtaacagatgataactaattaatacccagtgattttgaaatgtagacatcaaacataccaattcagtggtatcatccttagaggcagacagaggatgattaaatcattcagcccatctctgtctgaggacgcagcttagcacagcatggtggaggctaaatgggccttaagggaaaaaatgatatctgaagatgcaatttatttcaaaaagagtttgctcccgtgaattttcactctctatgtagaacggcaccagcacacacttttcctgagcctttgcatgtgtggcaggcagcggcctggcatcctggggaactgaatgaggacgcagatgacccggacgtgttcacagtttgacacatctgactcccagatcagggacagctagctttgctggctggttaagttgatgattccatctttgcctggttctctgactgtctcatgctttctgttattactattttgcagcagatatttctgctcatttttcaatcatatatgcatcctggatggcatagagttgattctcctaacaaatcagtgtccctttgtatttttttctggccataagatagaatatatatgtcatttattaaaaatggagaaaatgttcaggagtttcttgactcagagagggaaaagggatactcagggcactttttcagccaggaatttactacctttgcagggtaaaggggactcaccacgctggaagtcaaaataagccaccagtgccaagtgttcaaagcccttagaatcacaatgctcttaaagcaaagtcttcaacaatgcttgaaaacttccactggttctcagtatgtccaaaattgtcatgtctatgaatgattttctcaatctgaaaatttttatagcaggctaaagaatgagataggtcagtgtgattctagaactaatcattaacattcaatagatgactattttattctagaaaaagcagcaactttctatttactctctattttgagggtaaattctctgtaagtagaaaaagcaaaatgtggacatgggactaacatatgaatatacaaagcaaatgtaccgaaaaaatcttaagacctgccttgtggtgttttttgttttgttttgttttcattaaagtgacttgttagcctcttgctccctgtgaagcacagggaggtgacgtgatgtgcacagggcagactctgccatatgccctggccttgaactcagggccccctggggactgcaggggatgctggccatgctgagcaatgcctgtgggtgtcagtttcctcatctgcagaatgagggtaggcctggtgcttatttcatagggtcgcagaggggattcagtgacagggtggtgtagaggctggagcgtgccccatgtgtgcacgacagccttccaactaggggaggcgggcctgggctctcaccagagagcctgtgttctccatggctacatgactttgccccagacgtccttcccgtggtctggaccctgggaagtcgccaagagccagacaggagaaaggctccacttggctctcctctttggtgaccatcccttgcctccatggcgggactctcaggtgacatcccaccaaccctcactttccttccctggtgggtctcactttccctcaagagtgttgcttttttgtttcctgcatagtcctgggccagttttgataaccctcttcatttcacttcagaaaccctgatgatttcttcctgtgctctttttaccttaggacttttactatgacgactgtgactggcccatttcttgttttttttctcttgctctgctttctcccccatcatcactaaagcagacatggcaatgatggccatgcacactttccaagggtccagctgtagatcttcatggttccccaggtgcctggaccatcttgtgaggagggaggcaaacacaccctgcctggagcacttggccctttcggcaatgttttggcttcctcaagtgagaaaagaatggatttgtattccccctctgcattattgtttttgttttgtttgtttgttttgttttgtattgagacagagtctcacttttttccccaggctggagtgcagtggcccgacctcggctcactgcaacctccaccttccgggttcaagtgattctcctgtctcagccccctgagtagctgggactacaggtgcccgccaccacacctgactaatttttgtatgttttgtagagacagggtttcaccatgttggccaggtgcccattattatttgatctggaattaactgagctactgcaggaattgcttgattcactgatgactggtgttgagccagtacacacccacacccaaggactgtgactgtcttctgaggtccatcctcagaaattcctgtctcttcacctagtgtgtaataaggcctgcgcgtgttatatggaactgtaaaaaatgcgccaaccatctgtccttcctctttatctgattacttatcattgttctctaagttgcaagttaatagactgatcataaattaatgcatgctggagacttgctgtttcctactagcagcatataaaagttatttttaaagttgttttaaatctgtgagtaaaaataaattgctttgctgcaagaaacaccaaacatggaaaagctaacggttcaaagttaataatttatcttatggacatcactagtggcatagttgctttaaacagtgagaggatttaatagatatttgatttgcaagtgggatgaagggtggtctaacctttgtcctgtgtttaccttccatgagatcctagaggttgtacagcacagtagtggcatgtgacacacttgagagtgcctgttctgtttggaaacctggaaactatgaagggaagtggccttcgagcttaacacataagacttgggaggcaaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggacttaatattttgatcttattttttcaatttcttttaatttaacagacaggatgagtttttttatagttgtattacttagaaattatactaaaaatggccgagtgtggtggctcacacctgtaatcccagcactttgggaggccaaggcaggtggatcacttggatcacttgaggttgggagttcaagaccagcctggccaacatagcaaaaccccgtcttcactaaaaaaaaaaaacaaaaaaaaaactagccacgcatggtggcaggtgtgcctgtaaccctatctactagggagactgagacataagaatcacttgaatccaggaagcagaggttgcagtgagcagagattgcaccactgcacttcagcctgggtgacagagcaagactctgtctcggaaaaaaaaaaaaaaaaggataaagaaatcatactaaaaacaaaacagaatgctgaccaccttatagaaatagaaatagtggtttgctgtgatagcaaattttcttgttaactttttatttttaaagaattgcacattcacaggaagttgcaaaaaatctactgggaggtcctatcccccttcccccaacctcctccagtagtaacatcttagtagcaaagttttgtatatttattttgatatcattatctaagtttgacatcattatctaatattaacctaagccaaaagcccactattttaattatctagtgatgcagtgttatagaactcatagcctttcacagcattatttggaagttaattttcttaagtgaaatgtttttggtctttaaggtttggaggccatggaggcatgaggagaaatgggatgagggagagagagctaagatagataaagacagagatggggagatccactgattcgttgaacaaaccagatacttccttatagtttttggattaacttacatgagctaagtttatattctgttcagatcacaagtggtcaagtttgtgtgtgtgtgggggggggggggtgggtgtgtgtgtgtaccactctacccatcctatatttattgtcctgtatttggtctgttctgccttctttattttcaggataggtgtcctaaatgagggtctttggaaagctggtgaggccatgttgcccgtttcaggtgttccgtgctcaaatgtattcatttcttgaaaaattcagggagtgcacacttttgtacattttcctatgtgtatatgataccattatataaatcttaaaaatatatatggttcacctgaatccccagccatttggtagagaagatagaaaacctacagaggaggctaagattttattagaaaattcagcttctcgacggaggtattggctttaaagtcaaggcaatgcatctattctttcttttgatataactagctaaaagatctcttaaattcaaagtggccctcatcttactgttactgcaatttactcttaattacaaattatataaaaataggttttgaaatactgtagcgacaaagtaacatacctctgctccattacacagataaaacctctaaggaacacctcctctcttaacaggcattaaccaactgcagaaactgcagaaggacagggctatttgggaataacacagctcccttccttgtctgttccctcccattgtcaggcttctgtggagccatattcagagcaacatagggagggggaagagaaaatcaaccccttggtgaaggaaagctcccaattcacagagcaaacatgggtactcttgtttgtgggagctcccagggcctcccagctcaccgagcattctgagccctgatccttacactaattgtattatgcaaccataaatgatgtctgctgtaccagcggggacagtttattttaatagattggtataacttggcagaatcttatctgcatgtttcatcttggatttttagctcaattcaactcaataggcatgtgtcaaatgtctactgcagactgagcactgaaaagctgctgggtacagggttacatggatagaaaacgtagcctctgacccctaaggagcctgtaatccagatccccattctttccatcccattctcccaagcaagaatttacctaatgtggtttgcgagaatttaagagctggaaaggtggtcacgagaagccggaatgggttcgctaaaatgtgtctatatgattaagcataacgtagctttgcagcactcttcacagcttcctcagagccttccgcacgcggtgtctcatttgaatacttgtgtgaggatagcctcatacccctcagtgagctcttcatggagtgatgcagtagacagcaagcctcacacttctatgctcacggaagaccaaatttgccttgaaaaatctttatagtctcttcacatttctaagttgacatcaaaaatcggttaccataaaatcctaatagttgaagagatgtaatttcaattatttggtaaacctgaccttcattgtcaaagcaattagtcaactcagatttactttctcccagataatagattctgacttctttttttctgattaaaaaacttaacaccttcctcaggagatctatctcagttctgaatgctgattctaactaagaaggatatttggctacatgctgggaagaggggtactgaggcacgccgcgattccactccagcatttccagttagtcgggtgcctctgcactcccggtgttccggcgcccagttagttgtgtactctgggctgtccctatactggagtcctaaaacacttacgactgcagatagggggaggtttttcaaaaccttggtctgaaaagccatagaagggagataggaaagcgggggggtggagccacagtacattcaggtggatccgtttttggaaatagtacaaactggaggtgaaaccctggaaattgatctgtcgttcacatgcttcatgccgagtccttgtggacccacagagacacactcgccccagtttgaaggctgctaacttgattctgaggacaccagtgaggtggtagtgtgcaaatgatgtgtgaggaaactttggaggagtctcaccctgcctggagcacgtggcccctaaaacagcgcagcctcccaaagacagaagatgtggactagtgagaagccaggtatggtgactgctgctggatgaagcttgtcccaccagaggctcgcttgtttcattgagcacctactgtgtgcttgtgggatgcaaacacacgtgtggtccctgccctcaggttaataggcaggggtggaacagttatgaaactgctctaaagtcattttctcaaactgggagtgacaaatgtatccacttggaaaagattgagaattttataagatttttaaatttttgtttattcacattgaggagaatctaaattcttttgaacttatgtatagatttcaccattttatagtaataaatcagtcctcctgtgtgtgtgtgtgtatgtgtgtgtgtgtgtatgtaaacctcaccttgcaatattattattttaaatagccacttgcatcttaaggaaattaagaggacaaaagaaaagctgctgttttgtatgtatccacatatttaccagctgcttccctgccggcaggtgctctggttctgcactgcctgttgtcccttgcctgaaaatggttgcctccaatattttgctcagttttctgattgtttacagtggcagaggagggtagatctggtaccagttagtaattgccagaggtggaagtctgtggatgaaatttgtataacatggaacgttagttccacagttaatgctactcaattggaacccatggaaattattttttggtgaaaagggcccatgcgttatgaaatttgagatccatcactttaagtgaatgtaggccctggatacagtgggagctcagaagagcaaatcagttggtcaccttgctcaacgtattttactaagggcatcagtaaggctttctatgacctgctccttcaatgcttggttgacatttggggagcaaagataaactaaggattctaagttctgtcctgtgatgctgtaaggggaatctcaaacctctaggtggaggagtgcagagatgaccaggatggtggaagcctgcaggagagctgaacacctgaagacacccagtgggaagaccaggacctttaacgcccatatctgctgctcaagactggcagagagaagagggtttgtgatgagaaaaggtggtgaaaggcacaaggaggcacagagcatgtcaggtcccatatcccaaaaggaatgtgcttgggtgagggagagctcctccatggctggaggcattcagagaccaggcagtcgcttgtgggtttgtgattagagtgaggttcttttataaagggagtgagaagagaaggtctgtggatacttgagtgtatcggtaattaagaaataaattgtgtacatcccatttctttccacattttcctgggctgtcacagtggctgcaaagaaagcagtccgtgaactgaactgtgatcccagacaggcaagcacaccaggaatctcttctcagctgttgataatgagggagcgctggggagagaaatggggtcctctttgagtttcctctgtgccgatacctttctctttgttaaaacagctaattaaacactgaagcagtatagctctcttactatacactggtagtcatagttctcttactgttctcttcactgacagttctcttactatacactgatggtgacgcagaaattcagaattccccgcatgtgtcccggtttgaaagccactgtgctttgctgtggattaggatcagacagttgagtcttgttccaacaaggaaagttgcttattggaaagttttgctgcagggagccttgagttctgcatcaggcttggaagtgggctctgtggaggtcagaaggaggatcccccacccgcagcctcaagaaaaatatgaaaagtggattatgcctctgtagctatattgcctataaactttctgcagaatgacagtattcatatcctacattttttcaaagcgatattaatcctgagacctgcagctaaagtcaagtagaatttagggataattaataggaggaaggtggggttggaagatctgcatgattatagtcctctgatataactggaaaattctttccattagcaaggagctttggttaatataaaatggacagattaaacctaggcaatttattttactcattgctgtatttttatttcagagctggttgaaaatattacaaagtaatattttaaagtgcttatctaaactcttactctgcattttatcattgggttatgaaatgactggggaaagacttttcttgcttttatttctcagtgtctacttataaacatgttttttgaactactgtttttgtgacaacatgcctttttcccagaaaatctcaggttaacattaaataggcactggatgtttatctgatcttgtttatagaaacacaagaaaattttaaccttgtatatactttactcaattaactaggtaagaggtcattgaaacatttagaattccactctacatttcaataattatcaggtgaaagctactgcatctacatcagaagatgtttgtaatttatttaagaataaaattagctatgcaagaaatagtatgtggagtcctatgtggaaatcacagaaaccctgacaacttgatgatctttccgcaagctaaaaatatcactctggatcacagcagtagaggactctgtaaatttaatctgtgtgtctcctgtaaataagtgcattagcagtacacaggtggtgtcagagtcagtgatgatggatagaaattctacataaaatccaggcgcagtggctcatgcctttaatcccagcactttgggagtctgaggcgggtggatcacctgaggtcaggagttcgagaccagcctggccaacatggcaaaacctcgtctctactaaaaatacaaaaattagctggatgatggcacatgcctgtaatcccagctactcgggaggcggaggcaggagaatctcttgaacctgggaggtagaggttgcagtgagccgagatcacgccattgcactccagcctgggcaaaagagcgacactccatcgcaaaaaaaaaagaagtaagaagttttacataaaaacgtggagtgagcccaaggtgccatttatccagcccatacacatcgtaccatgtacagagtggacaccagataaatacattgactgcatgccacaaacatatatatgtaggcaccgttgcattcaaatacacatctgcagccctaacacatctttatttgctaacgagcatcaatgtatttaaaaacaaacatgtttaaactagtgaatgattagattataatgatcttaattcataagttttctcattggccttttgtatacttcaattgtaatacctagaaaaacagttatgtccaaaggagtgaataggccttatctgaaacaggtgagcgtgacaagtgttttcttacttattttacttttcagataattcatccttaaagtacattagtttaaaagtactgtttaaggaaacagtacttggattaaaacttgaatcattgttaaggaaaactataccttaacttcatgtaatcacaattaaacctcttcatatagaaggatctaagaattttctgcagcattcaccagcaccaaaaagctcagagacatatatttctttctctgtatatgtattttaaattcaagttagtataaattgacaggcaggtcagagtaatatatgatcttctgagtccccttagtaattaaaagaaatgattatttttgcatgaaatatgataaagtgattttaagtgcctgataaaaagtcttaaccatgacaaccattaaagattacatcaaagaaaaataagtttgactttcatttaccttggaaacagctattaactggtaacctcaagaaacaccatgaagagtcagtttgctccacacatgtcttgtaaaagtcaaataactggtggttatccagtaatgacaagaggtagaagttacatccttgctgtctgattgaaccttcccagagctggcacaaggctgggaagaccataggtgctaaatgaggaactacttaaagaaagaaaatggaatttcacggacaagaaaatccatgtccatttggttctgtgacccacatcctttgtatcctatgcttttttacacttggtacatggttgcaagattgcccctgttttctacttatagttccatgcagcatggatgtgggaaaaagtctcctctgcaaagggggttaatgcaggtcactctacgtatgtgcacgaggtcgttataaagctcgaaaatatgggctcaccaaccaggtgatttttttaattatccaaccagaagacataacatataggggaatcaaaagaaatctctgagtaaaataatgataacaggtcaaactttgcggtcccacgtgaggctggagatgcgtattgtcttgactttgcatctacaagtttaacaaatgatgctttctcagtttacctctggaaatggaaattagcattgcaaatgacttcatgaggaggtagaagctatctgtgaatttcctttcgctgtgtttacgatagactctcacgtctagatgtgtcatgtattatgttaaattggtatgtcttgaagttataaagcacagccctctataagtatatatattccacctctttcaaatcggatggtacctatccttcaaactgctatttaatgactgtctgctatgttcaaggcactgctctcaatgttaatacttgatgagatcgggcgcgttcaaggtggcatggccgtagactcaatgttagtatctgaaatatggcctacgagctgagttgtgaatcaagttaatagattttcggaatgttaaggtctaaaccagtagctcttaactgagacaatcctgtcctcatctcacctgggagacatctggcaatgtttggagaaccttttggttgtcacactggggcatctagtgagtagaggtcagggatggtggtaaacaagtttttttgtttgtttgttttgtttttgagacagagtctcactttgtcacccaggctggagtgcagtggtgtgatctcagctcactgcaacctctgcctcctaggttcaagcaattcttatgcctcagcctcccaagtagtagctgggattacaggtgtgcaccactacactcagctaatttttgcatttttagtagagacggggttttgccatgttggctaggttggtctcgaactcctggcctcaagagaaccgcccccttcttggcctcccaatatgccgggattacaggtgtgagccaccgtgcccaggctaacattctttaatgcataggacagcccccaccatacagaggaatccccagcccagaatgttaatagttctaaggttgagaaacccaaggttaagccaagtcaacttatctatcttctttaaaattgcataagaatgcagtcctgttcttcattcctcttgctttgcagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtggggccctggccttagaaactggctccttcactgctgtagaaacaacataaatttaacataaaacacgtgcttttcttttttcttcttactttttcctgtcttggcaatgcaaggatgccattaggtaaagaaatccttcaccacactaatcctgcagagccagaagagaaaccagcttgttctaacccagctttgtcatggagagaaggcagctgctccagtctgaactattctttcttttggtagcagcctgcccaagggtgaaagtgtgtttaatagtttgaattacacaagtgaacagtaaatgtatgcctgtttctgctttatgggactttgaaataatgttgtttgtgccaaggttttagattactatacctaacaacctagaaaaagaaatgaaaaggaagccttctgccaggcagaggtcactacgggcctggagctgggcacctgactcagcagctgcccagatccccagagctgagaagtcaccatgcatttgtggtgcttcgagcgagttaccagagtcctggaacagagcagcacacctgcggggtgtccccttggcatttgggcagggcaggtgaccaagggtcttgttggaactgaagtccagcttgaaaagcaaatctggttgtgagctagagtccagtaacacttgtttcccgccgccccccgcataactcgtgtgtcctaaaatacaataatttcttgaacttcagtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaatagtgaaatcaacattttcaaatctttgacttcactaagatttaataaagtttattaatcatatattatgagttattgctctctctttatgtctgtaatgcagttgctcctctctgtataaattaataagttttagagatccaaaatgagaattttaaaataaattacgtatattttaatcaagtttaatttgactatatccagctaaacaattgattgaacttcacttgcttttctatgacaggttttttgttcttagtaaaagaccccagttttctcacttgtgaacagaaggggttagacttcatgacagctaaggttccttccgtctctaacaaaagtggcctgaagagaggcttctagactatactcacggtgggttcttgggacctcagagtcagctccatcacttaagtggctgtgtgattgagtggagacacctcaatctctttgtgcctcagtttcctcacctgtcgagtgtcaacatgatggcacctaaagctgttgagacttcagaaaggtaatgtgtgaaaagtgaaaagtgcctggcatccaggaagtactcaataaataccaactattttattgctgcagctgttcttatagatgtgatttctagaacattgccttctaatagggtagccatgggccacaattgttggctgttcggtgtttcacatatggttagtccaaactaagatgtgttgtgagtctcaaatacacactggattgtgaagacttaggacaaggaaaacaatgttaataaaatctcattgataacttttaaattaattacatgttgaaatgaaaatatttgggacatattgagttaaataaaacaggagattaatttcttctgtttctttctactttttttattagtgtggctactcaaaaatgtgacattatgtatgcatctcgtattacatttctattggacagcagcgctctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaaaaaaaaaaaaaaacagcattctgaggtcaaacatgctcagaaagcttggaatctgcactacgcttctcgtacacatttcatattaaagattttggaaagtcctgcaatacagagccctgtctaatattgccacaacccacaattgctcaaatgtaaatagatttgagtttattcacattcagatcacctcttaaggccccacctcccaatgctgtcacaatggcaattagatttccacatgagttttggaagggacattcagaccacagcaggggaaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaaccagctctgagcctcatggctgcaggcaaggtctgcaggttcctggtcctgattgcaggccatttgctgccttgagtggtggttacacaaggccagccctgggggtatcacccagaacacctagtacacgaatttcagtttagaggacgaagcattactggagtattgttatgcaggaaaactttttcctaaaaatgccctgaaaagagagtagcctaatgcattcaatcaaaatgtttttaagtggaaaacatattgtgtgtacttgatctggcctgctgcttttaaaagattaaaactgggactgggcatggtggctcacacctgtaatcccagcactttgggaggcagaggcaggtggatcacctgaggtcaagagttggagaccagcctgaccaagatggtgaaaccccatgcctactaaaaatgcaaaaagttagccaggcttggtggcgcatgccggtaatcccagctagttgaggggctgaggcaggggaatcacttgaacctgggagccggaggttgcagtgagctgagatcgcatcattgtactccagcctgggcaacaagagtgaaactccatctcgaaaacaaacaaacaaacaaaaaaacactggggccaaagaactctgtgtgctgtatcacctaaccacatttcatgacacggctagagaagaatcatgcaaataaaaatttccaacatgttcgtaaactgggaaagtatttcactggggagtgagcagaaaagtaatactataacctctatatctagacaaatgtgaattcagtttcacatataaatatataagtgaaaaaatatataaatataaataatatgaaataatggttatctcaccactttctacatcttttgtgaatattttatagtgctcaaatatattagtgcactagtatatgtacattacattaaataactaatcatttattaggaggatgtgcttgttttttgctaataaagatgataataaaaaaatccttagaccccccctcggtttgttttcagttaggaattagggatatttataagaatatctttaaatgacacatgccttgctctgggacgaggcatctgcatgggtgacacatatgtgttgtgtgtacaggctcccagcatttccagggccctgctcagaatgtaggccttactgattcttacagagttacaagcgctggtgaggttggcgaagtttaggtaaacacagctgggaatgccccatggcctctgggtgactttggacatcactgaactttacccttagagatgcatacctgcatcttttttaccctgatagggccttccatgatgctttcaaagtgtttttgtctgcttttcggttaatagactttcacagtagccaattgaatatattggttaaatgcatctctttatacacagactggattcaaactgaggttgtgtctctccctggctgtgtgacgttgggtatgatccaagtgtcagattactcaacttcaaaatgaggacagagcctttcccttctagggctgccaggaacattgaatgagagagtgctggcagcttagtacaggtgttcattgctcttgtatggtactgtctgtggcacggctagataaaatacagtagccactgattcaaatttcaactgaggagtaaaataaactgaataacttagaaaagttttcttcttttgaatgactctaagaatttaaggagcatgtgagtgttgatggctctaaaagggtaacagagcccaactagctcagttctcagcatgaaaatagtcatatggcacagactcagtggagtgggtgcacttcaataactggaagcacagatgccctacagcagcatcaaagatggcactctaaactactttcaatcctttaaaataaatggaaacgcacatttagtatgcatatgacaacacgaaggacttcgattttgctgatgcaatacagttttacaggattttttatactcaaattagtaaaattctgtattgcatccaaattataaattataatatcatctagattggacataggaataacgaccactggtatctgcccagaaagctctaccgcctgtttataagctcctgcaggagacacaaaaagaagagaatttgaatataacttgaaatgaccgtaatctcctgccccaactcatttcattaccaaaccgcctctttcttcattatttctcctgaagcacaaatctatagagaactcagctgccagtctctcccactgcactcagcagtgaaagggttaggcctaggcttttcaaacagaccagtgcttgtatcagcccttaaacatctctggagaaggaaatgggatccttctttggtaattcatttttgacagttggggattaggtgttctgtatctggggggccttgctgtcttctctcctcctcctcccactgcagaccctctcctcccctcccctctccagctctctgatgactgcttcatgctccttccacctgaggactgccagcacagcctattgcaggaacagccaatgaggggctggctgtgctcttttatttataaaattataaactcaagcaaaatctagactatgtgtccccaagatcagaggagcacaaatcccttgcttacagattgcatggggggcacattctttaaaattggtccctgatctagactctagcctgagaatcatctttaagttcagaatttccactcatgacctcacatctgtgggctcccacattgtcttccaaaacacacatggcatctggcatcaccttcacccccaccctcagagcctcatctccctgcaggtagatagtcaaggcaacctcttcactcttctgccaagcctcctctcctcagctcttcccttcctctctctttttgaaaatatttttaattgtggcaaaatatacacaacataaaatttaccatcttaatcatgtataaaagtggagttcagtggcattaaatacattcacgttgttctatagccataaacaccattcatctccagagctcctttcatcttgcaaagctgaaactctgtccccattaagcaatggctctgttttcctccgttcccccagcccctggccaccatcctcagttttctgtctctgtgagtttgattactctaagcacctcttataagtggatcatacaatgtatctgtctttttgtgactggcttgtttcactttccataatgtcttcaaggttcatccacgttgcagcatatggcagaacatctgtccatttccaggctgaatggtactcttttgtacgtgtggaccacatttcatttatccattcatccacgggagggcacttgggttgcttctgctttttagctattgtgaataacgctgctatgaacatagctgtatgcctttgtcttttaaagcccaaatctgatcaagtcactccccagcttaaaaccttccactgctccccagcagtgggataaaggccagtctcccctgtaggtctctcccgccagccctgctcagtcttcttgcttgtcatccttggctaggccttgcattgccatagccctctgcctctgttcacgctctctcatcttggagcatgagccttccatcatctctaccagatgaactctcatttcttctttcaaaaaataaaaaacccaaaaaacccagagatcccaactgtcctggtgtctgcatagtctgcagcacacgccccctccatggcccttcctccataagcagaatcactcctcactgttcctgcagcacctcctgtgtgcccacacagctgtcctgcggtgggctgtgtgtgtgagtgtgccccctctaggacctgagctccttctggagggtgggcacagcatccattcattctgggaatcctggtcggcaccatgctagaacttctgcaagtgagtgcctttggtgctggcccatgggagagctgttggtaaggcatacttttgcagattccagttgctgctgaggttgttgctctttgcacaagtttcttctagtcaccagtgaagtgacatgtgtggcaggcatggcccagggaggctttttcataaagaagaggttgaatctttggggctgtggtttgaatatgtccctcaagcttatgtgttggaaacttaatcccaaatgcaatagtgttaggaggtggggcctaatcacaggtgattaggtcataaggctctgccctcatggatggcttaacatgtttagtgaggcagtgggttagctattgtgagagtgggcttgttagaaaattgagtgcagccccctcttgcttgctggctaccatgctctcttgcttttctgccttctgccgtgggtgacacagcaagaagaccctccccagatgctggcaccatgccctgggactttccagccttcagaaccacgagccagacaaatttcttttctttataaattacccagtctgtggtattctgttatagaaacacaaaatggactaagacaatcttctttcatcaagttagggtaccaacctttaaagactgccagtccaaggttaaaggaaacttttcaagagcagtccaaacatgatctggccctcagctactctccagggtcatgccaccctatcacccactggctcacacagacgctgaccactgcttagtttctcaaactgaagttttcctcctcagagcttttgcaaaaccttttctttgcctggaaaactccccccacaaatctttagttgtaggttccttctcatcttgcagaattattagtttgctcttcaaatagtctctccagctagactatcaactccaggagggcagagttcttcttcgcttccttcacccatgtgcccactgagtccagaactgtatagcagtttgattgaaaaaatccacagggtggaggatgagaggaccctggatcccagcctcacagcctcttacttcacctgtgtgattttggtcaagtcctttattcttcctgggctttagttttcccttatctaaaatatgagaaaagttcccctctcctgggtattctgggagactcatgtaaaaggcactgagccagtgcagcacatctatgaccaggaagggtcagcttcctgccttgcatgagacacacattcccttcttcatgcacagttattcatgagttaaatatgtattgagaagtgggttctcaggagatgatgcatccacagcattgtttgtatgcctctgtctttgatgtccctgcctgagtcgcccactttagagcccttctgttcttcagaaaccagacttttctttcaatagtttcagtaatcaatcgatcaatcaatcaaccaatcaacagtgataataatcatgagtgagcccctgcccgtgctggctgtgtcctgctgaaggcacactaagtgctgcccttcccagaagcctcaggaagcttgcgaagctcaggtgcatggatgcctggtggaatgaggaagggatgcagccaggtagagaaatgccctgccatcacttgcatcagcatctgtgaagagctggccaggcttttgctcacagtggttgacacagtcaaggagcaagggccccgtaggagaggggagtcaagggctccgggtgggaatggagctgggggctgatgctggcttctggagcactgtaatgtgactgagaaaggtgaaggagccgttctgaaaaagaagaaggcaggagctcgcacagctcttgactcatcttgacttctttttcctgcttcatccaagcaggtcgactctctcgtgatctcagagacagagtgaagtcatgagtgggaggggagcacagaaaataagaccttgattcccagcattgggagactccctgctcccctgagtctcggaaaatagcacccttcaaatgttttagggatccagatttgatgaagagatgttattttggcttttagattcttaggagagatttgtctttctcaggtcaggaagaaaatgctgcccgctgcacattcttcgggacagactcttttaattattactagtttaatgtatgttttgcttagttaaggaaaacccctgtggtttcttgacgtgcttcagtattctaactcacagctgattcagttcagggggctggggagatgtcctcgacctctggaaaggagggtgcatctctagaaataaggctaagtatgccactgacactgtctgcataaacgtgtgtgatctcaggtccaaaggatggggcctggtctaagccagggacgtgggaaatcattttcctgtggcaacttgtgaagaccattctgtgaccttggtgtctctgggccttctcttagattttctaagttggctagtcagtggagctgccatccctcctttgcccatgttctactcccagagttcctccaagaaattgcggagcaatgcctgtttcatgagagctgagtttgctgtgtcttccacttagaaacaacactgtggaccaggaggacacacagctcccagggccatcaccacacaaagtgaaggctggtgaatccgaggcttctagcccttgccgggccaggcccgcagcactccgctccccaacccagccgctgctttgtcgcaggaacctcagcagggcagggtgtttcctaggaggacatccgattcccagccattcctttcagtgaatcacctgagctcacattcttttttcttttatttttgaagctcttagccaatctgcttcgcgatgaaccagttttgcttgaagcagacaaacccgattgtcaggagacagtgatgatttcttcagtctctgaggaagagttttcattttccccaattcgcaaaaaaagtcaggtccctccctccctccctctccgtagaatattttccatgtgtgttaacaatggctgagcgtggtagatgccaggaatttctgtcaaccctcaaagaggaaagccctgcctaatggtctgcccgttcttgttcactccctgccccaggctccccacccgccttctttctggaaggtataaaggctcctgcttatacctggcactgcacgcttcgctccctctgatctcctgactgtcatgcccagtgtctcagcctatcattctacctctaactcgaccttgagtgaccttgagcaagtttctcaggattccacctccaagtcactctccctttgggatatgcagcactaagttaagcttgcctggaaaacatcacttgaagctggaaaaccacttttaacacagcgggaaaagctatttgttcagacaggagtggggtgggtctgggcagagcactgctctaacttggccatgccgtggcagcagctcctttaatgccactttttcctggcgcgcccgcggggcctggagctcagaaagaggggaacgctccctcgtctctcaacagttgctccagacaggtcagcaaacatggaattcagaatgttcattaaacactggctgtgtcttttgtgttcaaaagcaagacactctctctgaaccatggccccacagagagtgcagaatgtgtgaaacctgccgggaaggtctggaccccttgcggggcagtgggcagcaccgtgcctccgttcacaccactcacatggctgtgcctctgcttccttctggcatggctgcttcttcctcaggtctcaaccatctccctcagatgctctttcccatgtttgtggctacaggtccccgtgacctgcagaggcagagcactcaccagcagcccagcctcgttgcgcacccatgtttgcatttgcaggccctagaaccactccaagctccgtgtggcgagatgcaccctcctgcccttcactggggagctgccctcctgttcacagcggcacctgagtcacacatctggagccatcctggactgcctcatttccccgatggggggtttccctgacttcatccatcctgtcttttgggtccccataataactgacatgggtcggcccgtaccagcccctgtgagaagggctttaactgccttcccaccccctgctcatcttagagtctctctatagtgctgctgaaagaatctctaaatcagtggttctcaacctcagccgcacattgagaatcacctgggacccttaaaaaaatcttaactcttggtccaagaattctattacaatcggtctgggatggggccctacaggtatttttttaaagctctccagttggtaatgcatagctagagttgagtatcgctgttctaacgtgcagatctggtcatgttaccagccttttaggtggtcttctttggctttctctatctaaagttcaaaaccgaacatgtgcgcattcagtgcacccattttcaactgtgcattaacacattcagcccaccagcaagatttatgaaccattttctgctgttgtatataacatatcatatgcataatggcataggttattgttttcttcaaaatatatgagatgtgagtccttctacgaactgactcacactgattgcccaacttcctctctcgaggtctcatcctctttccctgcagccgtctccctcttgcacgcacacacacacacacacaccacacacacacacacacaccacacacaccagggtcgatgccatctaccctggacttcatcttgaactccttcgagtgtgagtcattactcctttgtgcacctctgctttctcttctcaagatgttcacctgcttgaggtcagttccttgagcgtcttccacttgccatgttcaccacagtgctcaacatgcctgaatgcatggatggcgacttctcagatcctcagtctcctcatctgggtaataaggcattgggttggcgggtccatctggtttcttccagctctgagagtgcatttgctctgtgattcattcgttccacaacacttcaccaattaaagagagggtacaaaaggtgaacatccttggctcccagcagatgctcctcaaaacctgaaaaatcagataggtgagggaagattgaatgaaaggcctcttatgattctgcagcaattttggtggtttaagaactctatggaaaaatcatcagtatttctggaattgaagtaaaatggatagtgagcctctgtgtatgtgaaggcccgcatctggaacatgaaagaacctgtctgatgtgttctagtcaggaaagcaggtagccaatactatttatagaatttacagaaactgaagattttgtttctactgattttcaaaatagtattatgtctgatttttttcctcagaaatatacttcctgctcttctcaacaaactcatttgaaaatatgattagaacatgatagaattttactcatttgccaactgcggttcccatttcacatattgttagaattctgcatggtggctttgccctttaaccactaactgataaatgatgtagttagcttttaaatgtgtggaaaaatataatttcaggttcaaccataggtcagaagtacacgtgttttgttagtctatttgtctctcagtcatctcatggaaaattctcagcttttggtatggaaataattttcttgaaggcaatatttgttgagtgactgacggaatgaaaaacgccagttgcgtaagtgtgaaaaagatctgggtgttttcattggatccaaattccacatgagccaacaacagcgtggtgtggaggctggagcacattaataagaacagtgtcctaaattcaggaggtaatgctctgcccatgccctgtgcagctcagacggtgtgtgcagtgcagtatgtaacccagggcacatttcaggggcccacagggagctgcagcttgtaaggtggagtgcagccaacagagcagagagtcggaatccccgcagagcggttgaaggcacaaggatgcgcagcaaggaagacagacttataggtggtgcgactgccatcctctggtactgaaggtgctatcatggagggagggaagtagattgaccctcctggctccagagtacggaactcagacaaacggtcagaagcttacagggaggccaattttggatcaactttaagaagaattttttaaaagctagagcaatcctaaaatggaatttgctctttataaagttgcgaatgcctcaccctggaattgcttaagcaaagttgggacgggcagttgtgagtaatctcctttccaatccatacccgcaatcaccagaaacgtggacttccctgacactgagcacctcttaattaagcatctcataagtgaacaaaacccagcccttcaaagaagtcactttatttatgtgtgggtctgcagcttggatttcttgataatgttaaataaaactccatctactcttccacaaacacttcaagaaacctaagacttttggccagagtaacaccgaggtttgagagaaaggatatgtgtgtgagaggtgtggtttcattagaacatattatttgacttcatgttgaatcaacacttttgtgcaaaatgcagttttaccagcctctttccttgttttggtcacataatttaacttaacattctcggtacttgattttctaacataaaatgggattgagaggggaattttgaagttcccatggtctgtcctctacattctgacagctcattatctctgcggtattgttctcacatttaagtgaggttagcggaggcagaggcctctcaggcctgaagatagcctctgttttcagggaaatactagactgtgagatctgtgacactgaagcactaagttcatctcacaaaagcaacgtgctctttttaaatggttgatcaaagttactttcaaaaggaagtgttagtttttgttattagccgaaacaagagctgctttaatgtagtatatttaaaatcatatctcaattaagatgttattcaaatactatttgacccaccaatctcattactggatatatacccaaaggaatagaaatcattctattataaaaacacatggctgggcacagtggctcacgcctgtaatcccagcattttgggaggccgaggcgggtggatcacgaggtcaggagttcaagaccagcctggccaagatggtgaaacctcatctctactaaaaatacaaaaattagccaggcgcggtggcaggcacctgtaatcccagctactcggaaggctgaggcaggagaattgcttgaacgcgggaggcggagtttgcagtgaacagagatgaagccactgcactttagcctaggtgacagagcgagactctgtctcaaaaaaaaaaaaagaaccacttgcatatacactattcacaatagcaaagacgtggaatcaacctaaatgcccatcggtgatagactgcataaagaaaatgtggtacatatataccacgaaatactatgcagccataaaaaagaacaagatcatgtcctttgcggggacatggatggaactgcaggtcattatccttagcaaacgaataagaaaagaaaacaaaataccgcatgttatcacttataagtgggaggtaaatgatgagaacacaaggatacactggggcctacttgagggtagagggttgaagggagagaagcagaaaaaataactattggggtactaggcttagtaccagggtgacaaaataatctgtacaacaaactactatgacacaagtttacctgtttaacatacctgcacatgtacccctgaacttaaaaaaatttttaaaaagatgctatgcaataaaattctcaattaagaatttaacttggtaaatgttcatttaatgatctaaaaatatgtgtctggatggctctagcaaaaaaataaataataagtttctcagagatggtaaggctgaaataaatggggaaaaatctgaattgtaatcctttttctgttggacctggtgttggggtttcacacttgtgggtgaatgtgggcctcctgtgagcaccagcacaaaagactaaactgaacaaaagattaaatgtcacctctaaaattctgtgcaacaagacttccagccacagaatgtgcaactcagatttccaagtaaaaacacaccaggaagcagatcttagatctctgttatctccttggcaccagctggtattcatcctcaatgctagctagagttgaaataaagagtgaaagaactttctcttttattacttaataaactttcttttttgagctgttttaggcttacagaaaaattgagtggcagtttcagggagttccagcacggcccctgtttctttctcatggtccctgcaggtttcccctattattaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctccttccccacctgctcactcctccttcccaccctccccaaactgtggcaaccatttaacttttgactgaatggatttattcttattctgccttattgtatgtacaccatattttaataagataaaataatagtctatagtagacttctgtaaatactcaatgaataaatacttgcatgaatgcaggaaaaatcaatcagtcttgcaggatttcttatgcgttacatcgtccttataagaaagcagtcattctcaccgagatgtgctgagcagatactggacatgttctgacccagataagggctgggtggaagtagggctggagacacagagacccagtgccaacttccaggacctcggaagaactgaaggcagagaggtcctctcagtgtggactgggcctctgctggcagccaccagcgggcacagagctgatgtgtgttatgccacgtggggaaaacctacagacgattctgagaaaggcgcacagggacaccctctgcccctaaaagaacaatttaactctaatttatttctgtcactctgcattttctgacctttcccaagtgtacagttttatatgcatttaactgccaaattgtcatgtgagattatatggttatatttcattaatatattctagtttgttcagctgttcttactgggtgaatttgtgtggtttcctgacatttttgtttttagtagtgcctcagtagttttatacataattacgtttcccttctggattatttccttagtatctagttcaagaagtgaaatcgctggattcttgtggtaaatttttgaatttcacagtataatgctgattttctcaaagtctcacattctaagaaagtataatgaggcaaaacaaacaacaaacatcttaagttgattttttcctagcgtcttttccttccatctttgcttgtagaatctagactatttcatgaacccaagatataatcagtatccttcttcagtatggccaaagtgagtttctcattattttacctccccttcaggaaatgacttttcatcttgtgttttgggagccatagatggttctgggcaggaaactggctttggatagacccagcatgtagatggctatttggccttgctcccagtataacgatgcagttccctgtgaaagggtatgagtaggttttggggctctggataccgtgtggcctgaagagacaagggctcaatgccaactctgcctgtttccaactgtgtaaccatgtgagcgtcaaaaatcatggacgtgctctggttaacactgagtgggagctcaacaaattattatttttaattgttacttggacatggccaagttgactacactttatgttctgctacctgccagtctgaaagtgacgccacagaaggtgaaccgcatgttgggagatgctcttcatctgcttagatgaggtgcaaacacagcccatgcgcctgctcttcatgactgtatctgtaccagcaatatttgtattggcaaatcacatgccccagtgggaactacttaaggggaattcaatggatttcattccttttatgtaattggccacttagtaatagacgtgtaggtctcttgtgtggataaggattctgccttttatgtaagatatgtgttgcaattcagctttcaggtcccagccccgggaaggctccaggccttcacaaactggcccacccacgagaaggaaagcaattgtccaaatgtgggtagcttttcttcccactgttgtcagctgcttccaattagcccccatatacataatcccagtttgtgtctgtatcagtacaattctcccatgtcaatgtgaattttaagccacagagggaaaggggacagagaatatgctttcattcagctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaacttagctaaaagatgggaaaggtagactgactctgacttaatctacttaacctaccaggcaatttataacttgatggcctaatttttgcagcacccagaagcaagcctgtttcagcacggcaaaggctcagctgctaagtgggcagcattgttggaggtgagcagcttaggctgactgttcatcaaaggaccaagcgcttgaggttcgctcatcgctggaggccagagtggggagggccatttaactgctcaaggccatggaactctactgtcagtttcagggaaatttgggaccctggagcacaaaccaaaactccaattaaccaggagaggaactcgatccccaggagataagtgaagagtaagaagtctatctttagaaacaagagatgtccaaggctagaaagatggggaaggagggtggaactgttctggaagtgggtctcaatctcagcaccagcagctctcaagactttctagagaaggaaacttcatttctgaattaaaattagtcttcaatgacatggcagggatttcggcacactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgcactcatggaaaaagttctcttcccatgaggttctcgcaaagcattttaccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaaacttgtaaacctaagagaacctctatttttgatatacaaaataatacatttccttaaactatgatcttgatactagaattttaattaaaaaatacctgcagtttatatgcaaagttatagattaatgcttaaaaataggttgtatgtagtatccacaggtcatgtttgactgtcaaatagatgtaattttaattcataataattgtgtcgtgttcttccccactagaagccaattatgcaagcttcaccattcacacatggaaaataatttaatggagtactcattgcaatttcacttatccagaattggctgttgttctcagagcagcttgtgttgccttgttaaggagaatatgttagtatccagacatccagaaaggatcctttactgtttcagagtccattttccccacttttgaaatacacacacaaacacccattcatgcaaaccaaacagagattgtaaagtgattccactgacatttatgcacttcttttttctctttggttcttcaaactctcagtcagtgcgcatttactcttaatttagatacggtttaaacctaattagaaaccagaagctcttgtatttccacaaaggattatgacagccccaagaaaagatagtgaaaccattatataacaagataaaggcttcttaacaatacaaggatggattttctcattgatcttagccttctgaattttagaaattgccatttcaaagtctaaaacaaaggaaaatcagggaataaaagaatggtaagtagacacaaacctactggctccatcatttctgttttagcaaataacctgccacatataccaatagcccaagagatgggcatgtccctgcatttcctggtcaaggtgacaacactgcgtcctcctggaagaggtctgccactcaccataccacaaaccaaatataataaaatcagaaggcacactatagtgaattttttagaggcatgtattgaaaagcatctcaaaaagcattctcgaagcttccagaagtcaactcaagttatctgaaaagtgacacttttgatgattgctcgcttaatactgggagagccagatgaagattcctccccacttcctcagatgtgcaactctggaatttcttagtgttactggagattcctgctgcattctgggcctttaatgcataaacactgagatgttctaaggaaattactccctagggaggagaggggtggacgaggagtaagctttgctggtgactcatgcgctgtgtggaaactccctgcacaagtgagctgcgcagggtgagtctaaagggttaatgcactttcaaaagcctctaatttgttattccagaagagtaatttactcactagaagtatctgggtggctactaacacatttgtgtctttaaaaagatcagttttattttaagattaaaaatataaagcaagagctggaaagtcactaaaaactgacagccagtttcccattttcaagagtatttattaaaaggttctggttgcagaaggaataagaaatggcttgagatcatgacacagtgaatcatgttgtaaacatgttagctatggctgtgaattcaaccagcgatgagatcaagcgtccccagaaggtgttgggggaattagggacatggctgtgtttccccagagaaaagtggccattttactttccctcttcactaacatgcttttgacatgcatggcagagctgaaggcaaggggaaggggacaacatagtaagtgactaagtggcttttttttttttttttttgccaagtgaagctgagtcatatggcctctgtcattccaaaactattctctacggctgcattcctttcgctcttgccttcctttagaaccctggagaaggcctcctgaagcctggccctattatgtatcctgacaaagataaacttttccaaaaagctgcatgttgtttctagcacagtttttcctcgcagtgactacgtgatgaaagtaccatgcagaggaggtgtctgactgaggcgttcgtggtgtgtgacagagtcccctgcacaggacagccgcactcccctcttgcgtcctttcctcccatgtttgcaaagcctctttccctgtcagcagggggtgttctggcagttgacatttctgaaaactacagcctacatttttaaaaaatccagtaagtgaaaactaaaaaattaataccgtggtcataatagtgtggcatttgataactaatgaggcactgtcgtgccagctattattttcagacatttacagtccttttttaaatacaaagaaatatttggtgtgaaatgttccccgggagctggtgcaagcagaggcgacagggcaagggagcttgggttgtagcctcgaattcctccggccagggctaccgtcagcctgcggcacacaagtaaatcaaatataaaaccaaaatttctgtaagcaaatcagtttctaactcactgtaacgaattatctttcgcacatcacagaggcatctcttttcactgtcgagtttggtttgcttggttacaaaaagggcagttcaaaagctttggttgctattgtgaaagtcagctgaattccttccaccgtgctggggtggggtggggttcacgcaggttctcttttgtcaccaggggtgctgtggattcacaagtaagcaagaggctcctcaggtcaagcctctggctgctccctgaggtcagctgcctagcttctcctcctctgagatagacgggaacaaagtctttgatgtgtgcatttctcaagcttgacaatgatacagctacataaaaacccatgatttcatatagatattccaaaacgtaaaagtaaaccatgcatccacagagacatggaattacagaactggatgctgagctggtcacttgggaggcaggcgtccttgccattggtttatgcctcagccccaccatgcagtggctggccaggtgacctaggccagtcctgcatcctcggctcctcacctgcctggtgggacagtgacatctctcctgcagcactgctgtcagggtgagggaggtagggcgcggtttcagaaaaccattgggctgcacctgcgtgagcacagctgcaggagcaaaggtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcagaatgactgggaaagccccaacaagttacctactggtaaatgaggtgagaagcttaaagtgagaaccccattgctgcctctttttcactttaaaaacatttaagttttgaattatggtaaaatacacgtaagatttactactgtaaccatttttaagtgtacggttcagtagtgttaagtatattcacattgctaaggaaccaatctgctacttttgtttattaattttttcctgaggggaaatatttttaaattttaaaatatttaattgacaaataaaaattgtgtatattcaaggtgtagaacatgatttcatatgcacgtacattgtatactcattaccacaatcaaagaaattaacacatctaacccacccatagttgccattgtgtgtgcgcggatgtgcgtgtatgtgtgtgtatgtgtgcacgtgtgcgcctgtgtgtgtctgtgtgtctctgtgtatacgtgtgtgtacatgtgtgtacgtgtgtgttcctgtgtatgtgtgtctgcgcacgtgtgtatgcatgtatatgggtatgtgtgtacgtgtgtacgtgtgtgtgcatgtgtgtatatgtgtgtctgtgggcacaggtgtgcctgtgtgtatgtgtatatgtgtatgtgtgtacatgtatgtacgcgtgtgcatacgtgtgtgtgtgtgcacaggtgtgtatgtgtgtgcctgtgtgtgtgtgtgcatgtgtggtggggacactaaaaatctctcatcacctttttagtcaaaagaacagttgttttggtttggctcttctgttttaaaatatcagaacaataataatttcccacagacaaaatcctcaatcctcaccatccttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaatgctccagtgaccgggaggcaatagtctgtccacatctaagaacacacttggaataaccttagagaagagagagagagagagaatgcatggttagtaggttatcaaactcctatgacttttcacaggaaaagccctcatccacaccaactttaggaatgtgtagaaagaagggtcagggacaggggtgagtggtgggcagagcagttggagggcacagggaaaaggcatctggtcatgtatttggagtaggaggtcttgctttactattgaattgcagggacactttgggaacagtgttcacttctttttgcaaccatttcttcagagaaaagtcatgatactcaagtcttcttacaaagcagtttgaggctttgagtaccagactgattacagagatgagtatgaagcattattgtagtatttttaagtgaaattcactaaatgcaaataaacctagcaaatgctctatggttaatttttttctaaaattcagataattaagacaattcattctcctgaaactgctgttcatgtaaaaaggaattttatcgaggtggcccttgagtgccaaacagcctgtcctcagctgcaaaatgagtcgttgatgatcctccagcaagggatactttttagctcgtgtggtgattgctgcacacgggatatgtgcagcaagtatctgctgagctaataataaacagcctcagacagaaagacagtgggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcagagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaaaatatagtgaggtcattcatcttcggacaaattgccccaactacggtgggaaaagaaccaatgtgttggactatttatctaatttttgtttagttcggggatacaaataaatgcatagatacatacaaacatgcgtacataatagcagcagcagcctgtgaaacattgacaagacctggagttggaagaggactttgccatcctccagtccaacagttgcctgtcacagattagacgactgggatgtgcgcaggcgattatttgcaaacggccctgagtcccccagtttatgtcttaattcgcagccagggctgattgtagaagcaaatttgcaaacatgtgcaagaagaaatcacacatcctagagcttggatttcctcgtttcttgctatttctatccgtagacagaaccattgctgagctgttaaatttgtctccttcccctataccagtcttgaaaaaggaaaggaagtggagcaaagaaaaagaaattaataaagccggcagatcctaggagaatcttatttaatccaagctttgtaaagttttgctttattccatggcaacatgggtatacacatcccaccggctgtttcagtggctcagagcaggtaaggcctgtgccaaacgccgctagcaggaggaacaacgtggagacagccccagaggtggaacgttggcccttctgtggctccggtgtctcaggacctccctaaagcccagccctgacactgagcaagtttccaccactgttaggaagaagtagaaaggaatttggagggttggtgttactgttcaagagctggaaggcttctgcccccattcccattccattaattgcgtgaggtagagaactcatagaagataggaacacatatgctgatttccaaaattgcctttgtatattttcacgtgaagactttaggggcaaaagaaaagaagcaagcattttgaatatgtgtttcaatttgccttctgttatataaaattgtattttgcctattcttttttcattattcggaaccttcaagaaataaattaagttctctcaaaaatgtgttttttgaaaagaggactaaaacagatggcctggctgtgttaaacacagggaccagaccagcacccacctctccacctgccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttgagagagaaagaatagaacaaaatttattttacaaaaatactcagtacatttagggcatatacaaagatgttccagaatgtagcttatctctttaaagacaattaacacagtttctgggcaaggcaaggcaaaatattcagtaacttagcaacaccaacagaagacagccaatattgcagcacatttttctcttggattgggtcagagagtactgcagagaaaatggagtagagagacctgaaatactttcgcacacactgtggtcagtgcagcgtccagtgtgtgccacagtaatactagaaactccctggttaggccttggaatccagctctcatttcgtatgtgacctgcagggaagtaagttaaatgcacacgttttatcaagttcaaatgcaaacttaattttaaatgtatgcaacatcagtttaagcgttgtagctattactagcaattgtacctattactagtctgtactctgcacaactttggagtatactgcctactcaaggtggattttagagctctatttgtggcattatatcacggacaaaagcacgttcatcagagtcagaggaatgtggtgcaaatcccagctgtcccacttaccagctgtgggacttgagtaagctcctgaagcagctgcacctgcattttctggtgggcaccatggagctgtcagcagtgctttcctcagagggctgcgggctggatgaggtttgctggtgcatgtgaagtgtcaatcattgctctcatgagtggtgatgctgatgccgttcccttttttagggaagtgattttcccttacaaagttaccaacagtttcatgttggcccatttttctattaattgtttccactaataggaccaacagtggtagtcccatcattttattactgcttgtcgtagcacaagcagttgcttcattgtgtttagataaatattgacggctgcttttaacagtctgctgttttgtctccttttgaggtccttaaagtaatccttaaaaagatagtgcagatggaaagatgtctggagtcagtgaacctgccttctttcctgtgtgcttgtcagtttctaaaatgccatacacaaaggactttcatgatttctttttaggtacatgattacagttcaattcacttcactgtctggaaaatttccttataatcaggatgaaatttctcatgttagcctttcacatttcactacttttagataaggaattctcaggctttgctatatctgactgctcttggaggctgagcttttggctaactacctgactactttgtcgtttctcttcccttggaatgaagcaaatatctaacttctcactcattgtttctgctattttaccatttagtcatctgtgatttttctaaatactgaaagacttccctcaattcaaactatgtgccggatcaaggaaagggcagttggatattgcagacagcatagtgcaattgtgaagagtgtctgcttaccagccacgctgccttgcacaagttatcaagcctctcaacccacttcctcaatctgtaaaataggtatgagtgtaggaccttcccaggggatttttttgtgactatagaatgattctcagaagactttcaggcagtatgtgggtgaggcacatgctggaaaggcttctgcaggtgcagtgatcaatgcttttctcagtgtgtacatcccataatacagacacgttaccagaaactccctagccaggactttgattgcagctcacattttgtatatggcccatagggaaatgaagtgtgtattttttataaagttcaagtgttaacttaatttggaatttactatcaaatctcagttgttatgggcatttatagctattaatacttcgtcccatgtgtcccatgaggaaaccaaggaacagaaattaaagttctttctggagtcccctgaatctcgttcctgttcttttgcaccctgttaattacatagagacattcacagctcttctgaccttatcagcgttaaggaaaacagaaaaccagcgtgctatttgttctgtcccttagtcaagccttctcaacatatatttttcttccaagattttgcatgtgcacagggatgcctatcctctacaagaaacacattttaggcaaattataattaaaatgctgtttacatctcttcacctttagaatttaaagaatgatcatttcttagattgcatctcagacacacccttcccctagtctggagagggcgaggcccatgggtactgcaaacagcctgacgttgtcaggggcggtctcaacggctcattcaccacatctgcctcgcgaaggctaagccatgtgctgttacccctgctgcgctctggctcattctaaggtacacgctattaaccttgtgagaaaacaaagaggccagccccacccttcctgctcactctgagtcatggtgaaaatgtttcaggatctcgggttcgaccatgagtcctgtccaggtccaggaggaaattcggaaggaccacatgttcactctgagatcccactttcatttccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataatatgaatttttaaaaaatacctaattattttaaatatcgtcttgcttgctccccaaatacctactgttttcaacttggatatacgacatgattaaagaatatctaatatttgggaatgcatactttaaccttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcacattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagctaaaaaaaaaaaaaaaaatgtttcaaataattccaccaaccagaggatactacctaggacagtttgggcctaacttatctgtgaaggcctccagcttcctccacaccggtggccacttttcattcactctgaacccttctttgtatggaggtcattttattaattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccgaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaagcggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagtttcattggttggaaaaaaaatcctgataagcactgttaggcatattaactttaatgattacaacttttaggacactctgtggcctagacttagaaacacaactaatgtccagaaaaagattcctctttttattccatcatctgataggcctatttttacacatacacaccaaccaaaagtagccaagcaaacaaaacaacatactcacaccccttcgcctattatcatctaggtgattttcaatgctcattgcaatgaaacctacttattgtgcatggcacccacccccactgaggaatactgtagtttctttccctttgaacttcattagtagagcacatggttcattcactcctgaagagttcttcgtatgtcagaatatatatactacaacataatttccatcagagctctgaccacccgcttatctattttcataatgcctgccactccatcattagctgttgtcatgtaggctatcaataaatatatgacaaataaaacagttagggaatgagggaaattgactagcagccaaagacctaagccatcctctgcttggacattagaaaactgagttcactacagtcataagatacacaaaggcagaatgtaagccatacaaaaatccatgtcaatcccaatatgtgagtacaactattgaacaccatgtactaatggatgagttggtaaatcattcaatgtcttcatgaggtcaattacagattattatttagaccccaaagattccaaagatggtatttcggtcagatcttcatcctttgtaagcctagcagaaaatatggcagttttattgactactattctttgctgggtgtggtatttttaaactgagacatcagtgtgcctagcacagggcctcaagcacacagaaaaattccttgataataattaaataaaatttcagcaaaaaatatcatcttaaggctgtgaaattatcttcctgtgtggctaaaatagtgaataaaattcagcgcaatataaatcatagtacaatttcatcactaaattttctgatcttgatcttgtcattttacattggaagtaaaaatgtgtcctcctttttttctctgacagtgaaaagtgtgtgtgtgttgtgtgcccttttgcacaccctgcctcacacttgctggtctaattccttccagcatgattatgatataattaaatgacagaaatgtttacttccaagtggaactaagccagggtaactcagggtagggcagctgcttgcaccgaaagaccaagactgctagagaactaggaaacaggcggtgcaagaactccaggctctcatggaagagcgggaggcttctatggggctgcagaaactctttggtgcttggggaaaaaatgggttaaatgctcttaaaaaagaaacctgggagaggtagtttccagatgcaggcccgtcttttcttttaaacagaggcagctccgaagagctggacattgaaccctgagcaggaactggaggccgtcagcgcagctttgtttggcgagcggagctttgcaagggtgtaatgctgcaccagggagacgctatctgcagggaccggtgacgccgtgggtgtggagggggaggcagtggctggccctcttggggtaaggtacgcccaggaacagtttagaataacgtgcgcgagtcaaagggaagaagaagctcctgcagaccttctgggcactgtgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgtgctgctgaagatgcaggagctgcggcctgctctgtgcgtgctgaaggtgtggtgagaagcacttacaaaaagaaatggactgtgttaggattgcacattttactttgtttctcccaaatacgtgttctttgaatttttttccttccagggccaggactggagtgatggttgagacaggcacgcactgggtcttgtctgcatttacattttgagattttgttcagcatggattttatggcgtttttttgtttgtttgtttgttcgttttcaaaatactgcacggtttatcgtgaagacagggtcctttgctgccgtcttaagttttgggcccaagaacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaaaaaaaaaaaaagaaggaaatcctgtcatttgcatacctggaggacattatgttaagtgaaataagccaggcaccaaaagaaaaacattgcatgatctcactccttcatggaatctaaaaaattgtattcagagaagcagagagtggaatggtggttaccaggggctgggaaggtgtgagcttggggagatttggtgaaaggacatagaatctcagttagacaggaggaataagttaaagagatctattgcacatcatggtaactgtagttagtgacaatgtattgtatacatgaaaattgctaagagagtagattttaagtgttctcaccacaccaaaaaaaggtatgtgcagtaatacagtcattaattagcttgatgtagccattccacaatggatacatatatcaaaacatcatgttgtataccataaatatatactgtctctttatgtaaatttaaaaataagataaaataaatgttattcacttgtcgtggatgtggtggggacaggtgtgggatagccctccctgtacaactaggacccaggggtgatctagtgacactagccatttatcaggacgtatgggtgccagtcaggatgataaagcttccttttggccactatactacttagaaatgccctgcaaaaggtgcacatcaaagattgaaagctcaatcctggattttaagtgcttcaaaagtgcacttaattgccacatttttgtcaaacattttcccaggtagtatttttcctcatgtaaaacaacagcaatttaatttgaacagaaagcattttgaaacatacttttggcagggttccttgcagatcagaatggaaatgattaacagggcaattatcaatcatggacttttggcggcagaaggaactgtattgtttggtacagtctgggccagggccacacaccgtaacggagatactctattctgtggacggttggagggggctgtgctgagcagggtaactgcatcttttcctagactgttcacactgctgccacgaaggagtcttgtttagactggacctggctttcttcttcgcaatgagtgttgcagactcccgacaaaggccaggtggtaaagtgtggtgtctgtgagcgagagcctgagatgcctgagctgacctgtcctcagccacctgccatcgtgcagaggtgagagcagcccctgaattctgcccctcggtctctccatagctaaagcaaaaccatccttccgtgctcccaggacaagcaggctattaccaaatcacccactaaccctgggcgaggaggggccatcactgcacaattcatcagtgtctgtgacaggaagagattgttttagactggtttttttttttttatttgcaagcttttttctctctccaaaacgtgctgtcagtgtgttctaatttactctgtaaggaattctggagctaatcataggctcacaaaaagcagcacaggaaagtttcccagataacatctatttcagtggctttcaaacatttttgaccttaccaaagtaagaaatacattttaatatcatggcacacatacagctgtatctaaactttcataatactgcctttacgatatcactctgatattgtctattcttttctgtttatttttctttttgttccttgttatgctggttgtgacccactccagtgatttcacaatgcaggctgggtggtgtcccacagtttgaaatcccaatctagggccttcctctcactgtacaaagtaggtaactggggacattagtggatcagtgatcaaaccaaagttatttgatcttaccaagtgatatcaggatgagaaagctgttagagtgtcagatatgtgaaggaacttgggtcattcctgatacctcaaagagaaaaaaggtagtccttgaacacctcctacttgtaaaggatgcacaatcctacatgcccctccctttcctttcctcccctctgtaccccacccctgcccacattttcttcataagcagctttggtgttttggcttgtttgtttcccttgtctcctacctgtgactttatagccttttggagactcacagcaatagttgtatttaaactcagtgggtggcatccaaggctaaaaaggagattgcctagacacaaaaccacccaagggagaaagcaggacagcatcttactatgattgtttcttgtttcttcctgtctcataaggattattacccagggttttcatttttttcatttcatggttcattttcgctccagtgtagacatacaatagaccactcgtccctgtggctccgggcagcagcctcatctgagaccctcctgagacatctcgtgcagggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctcatttcaactccattacatcttcaaaaaccccattctcaaataaggttacttcacaagtgctggaggttaggacttgaacataccttattgaacaatccaactgatgacacatagtaatttatgcactcgttcttggagacgttgactttatttagtagcattaaccatggcaatgtcaccagcatcgctgacagcctgaagcatatgatctccagaatgtatttcaatcatcatgttcacttccttggtattctttagacaataactcagccttgaactccagtaaagggtttccctgggattttcttcttgactcactccactgtggcctccctcatccaggactgtaacagacgcctgacgtcagtggtctagacctctctgctgaatgtcatctttggtgaatgtcttatgagaaaacacatggttggtcactcttagaagggcatgaaagcctgtctgcagtataaccaaaacaggcacatggcgaggcacactgtgcgcatgtgtgtacaattaatatcatggttttaaattattttcaggccaaggggagatctttgctgcatctactgaagaaagcgaatctttttcttcctgaaaaaaaatggctacttattagtcgaatttgtgttttaaaaatatgtgaactaatataatgcagacatgcattaatgtttaaatatactggaagtttttggtaaaatgaaacccattgtctctgttgattactttgatgagtcaagaagtaacatcctgggaatgattggccagtttaaatgagtgcctcaggtttttggaatacaagaaatcaagaggaagggattagaacatataggttagcaagattgggatcctaaaatacagacccaaatgaatggaacaaaatcagggaatttattaataacagggtcaaggccaaatcagtaacaaatatcctgagtggaagaaaggtggtttaacaaatgcccctatgaaagatagagattggcttaccatgatgagatgtaagcccaagttatgaggttggcacacaaaaccacaaatgtcatagcttaaaacaacacacacttcttatctctgtttctgtgggtcagggtctgggttctcagggactcacaaagtatgttttcatctggagctccaggtcctcttccaggctcataagggttcttggcagaattcagtttcttgaggctgtaggactgaggtcctggctcctagaggccaccctctccataagcagttcttagcatggccgcctgcttctccaggcccagtgggaaagcatgtgcctccaggagggctcagtccattcttcatggcttttacctggttaagtcaggcccactcaggataacttcattttgtattaaatcaaaaccagctgatttgggatgttaattacatctgcacaacttcaactttgccatataacctaaccatgggactgatatttatcatgcatttgggtcaagttgcattaagagatataataaagctggacaagcttctgttgattagaagagttcagttacaaggctacacttgggaggaatgtttacaaactggaatggtcagaggatggggaagacacttgagaaaagtcaagtgacggatgaaggcaaatgtggatatttatctgggagaaaactaagaggagttataatagctgtcttcaaatatttaaagggcttttattaggaagaggaatttggcatattggattttgccttcagagaagtggagtcctgagatgctcttagccattcattccagcctccagggctcacctgctgtcttctgtccaggttctcggtagcagggcagtacagccccatccgtgatcttccatagtcaggcatattgtcacactcagtgagcggagagtcaaccgggaggaaggcacagtttctctggaatgacctacggaatggtacgctcaaatgcaaattctccttcccttccccagtccttgtccttcagatggtaatttaggagctgaaggtcagggcaccagcagcctttggaagcctacaggacaacagtcagcctggctagaaaaaaaaacaatgtcacaggcatgttgtgtttaatcacatgaaggatatttgcattgttttccaactgatgccagcagacacattgtcagtggtatcatgcctggggtatcagagttgacattgggttgccccttctctgaggcattcatgtaaatccttttaagtttataaaacctccatgtggctcctgcatgcttcatcatttgcatgtgtctctttttccaggggaggcagcatggggagcaggatgctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccgctgtggaggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacgctctgcatctctcattgcaagcttgcatttttttgcacacaacactatcctaatatttctcttttctgcaggcaggaaatgagaagtcatttttcagggtcattcaggaagtcatccagagttataatggcccattatctaatggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaaaaaaaaaaaaaaaaaaaaaaaaaaacctgtactctgaggatatgcttataatcccatagctaacccagaatttcttagagaactgatcaacatcagcagtggcacttactgaaaatgcacattctcaggccctgcgtagggcctactgagttagaatattagagagcaggtctcagaaacattctatccggcagtcttattctatgcacccgaagggataagagccatgctttcatgaaacatgggttgtgtgtaaaatgtttaaaaggtatggcaaaatgtgtttgattggcaccaaggatttctggttcctcctagaatcattaatcaaactttgaaggagaaataagagagtcggcattttcttgcacattctttgtgatgttgtgatgagttggaaacttcccgattgggtttattagagcatgaacacccaggcacccagcttctagccagccctgtcaggcagagtctcctcgaagatgtggaaaggactgaccaacagctgaggcctacaggaacctgagcaggcaaggggagaggcaccccggaaccaggagcaatggccttcccaccctccctcgtcctctcctcttctccttttggagttgcaggccacagaaaggaagtgacatgagtcactttgggccttcttaattccttcatcaaaggcagcacaggtgtgtatgtgtgttggtggctaattgaggtaggcccacagaggagataacagatggacatactatttcctttcttccattctgatataattcagggtataaacacacacacacacacacacacacattctcacttctttggcatctaccacacctgccccagtgcccatttctctcccacctgaataaaaagcccccacaaagcctgaggtacatggaaaggagcagtggtctggctcccaggagtgtgagaagcagccatgttttcagaggctgtattccacttggacttggccctacgctgaaggtaggagcggatgggggaggcccccttcgcacaaagagccccatgaaagagtgcacagtccagtctataaaacagacgcagaaaatgtgtgtaggacttcttcctgaaaaagagcgtggtgcgtccagtacctccatgttcatggaacttcccagtctgcagtttacccttttgtgcaactcccttttggtaaagccctggtcacacttctggttgttcagattatacagggataattccagagtgattttaaagtcaactgccaggcatccgcacttgcaaattagatgcctggcacatgcttgtgttaaggtaataattcattacaatacaaattacaggggagttcctctgggcatgcgacctttcccgtcatttggctttccctgtgattatcaggggagcttccatcgtgctgctaatgggaccttaaccatgtgtcaacccatggctgtaatgctgacactgttttctttctggaatgaaaggccttcgcaattgaaaccaaaatgttatccaactcagtcctgtccctttgacgatgaaaacatcaagttctggagactggccatccagcctccctgcctcatctcccacgccctccatcattttttgtctctacttacttatttatttggctgtattttacgtacatcatgcaaaaatattcctctttgtaaaaagtataatgatttcaggaaattagagggtaaaaagcaagaaccatgctttcactccactgtcaagagttgtggaagaatccttccagcattttttctgtgtattttacatacatacaaatatatgtacaaataaaggtcgatcatttaggttttgtttatatttttgatatatgagcttatgtcattcatacatattgttttgcctcttgcttttttttaacttaattttactttgcttgagagctttttgaactgaagtacgtgtaagtcagcctatgcatgtaatggctccctcatcttctgtgaggctgtcactaaaaaggggatttagcttgttctgggctttgcagcccgtacactgggcactgttcatacgtacttctctgtgcacgcaaaggagggcttgctagggaggcctggcagagggtgccattcaaataggattttcaatggaggaatttttaaattttcagttatttgaataagttttaatatatatccagaaccccaaatcatcaagtttgttttcttccacatctgtccttccatttctgaactattttaaggccagtcatgtctcatccaagaaatcccatcctttcacacaacactatctccgtttcatggttatgaatctctaaaagcatgatttttaaaacataatcacaatgctgtcatcgaacttaaaaattagccataaatctcttatgttacccaacaaccagcctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaaggactcattcagttcaaattcacctatgtgagcctaggtgatgctacttatttatttatttatttatttatttatttatttatttattttgagatggagtctcactctgttgcccaggctggagttcagtggcataatctgggctcactgcaagctctgcctcccgggttcaagtgattctcctgcctcagcctcctcagtagctgagattacaggcacgtgccaccacgcccagctaatttttatagttttagtagagacagggtttcaccatgttggtcaggttggtctcaaactcctgacctcgtgatccacccacctcggcttcccaaagtgcttcatgttttcaggagctgtacgtgcatttttagttttgatgaccaggtcctttttctgttttttaaagaacttcaaatgatctccagggtacacagcgcttgtgtgctgatgaaaaagctggcagtacaaaggccaccagccaaggtcacacagccaaaaagcccctgacctcgggccccttcccagaccctgggtcttttgctgccacatgaatcttcttcaaggtcctatgtgtagattttcttgacttggccatattatttaggattcagatataataacaaaatagatgttaaagcataacatgaaggcatttaaaagggtagaaagcacatgatttactaaaaccataaatcttatgacctgaaagtttcacctaatctcttaaaaaataccgtactaaaccctgattgaaaatcagagctcagacatacagcctgagatgccaaaaaatggccaggcttgtctgttgagaaagccatatgtaactaactgtttggaaattcaaaatatatcttatcattttaaaaacatctttcttctaaagacaatcatcttggcttcaggaatgaggctagtaaaaagtgaaatactcctacttgtggaagaaatcctcattttaaccatgaagaactgaaaaatgcattctgatgttgatggacccaacctatatttgggtattttatgatgtacacaatatacttttgtatatgagattgttattaaatgtgactttgctttttcaagacatacaatgttcctccgggggtcaggcactgtgtttagcactttgtcctgacctcatctgacttctcagctgtccctgagaggtaccagtgtgcaagatcgctgagttggcaagtgatagtgacaatattttcaccccaatttctaatttaaagaccccgatttctagttttgttttgtattggatttgcacaatttcacgttctgaaagaggatgccctcaactttgcaaaatgggccttttgaatgaaaaggatcagtcatgtcaggaaaagcgctacaatgatgaaatatgataaataagtcagtctttcatctgtaattatctactatggggtaaaaagtgatgaaaactaccatcttgaaaggttctggtgatagtggttcctaatgcagtgaaagatgtgtaagtcaaagatttgtaaccagccagggaatgagaggcgaagccatagctggtggcgggggccacatctgggtgtggggaggccacagttgggttgggggtggggcctgcagttatccacacccctcccacctcccttcgacagtacaggcttcctggttaccttccagagagtaaggccagggagagttgaataagttgagaaatgtcatgtcgaagctattggtggaaagagttccattaattgacaatacaagtccctactacattctaaaatctggtcctgactagtggcaagccgggcccaggagtagcacttaaacaatggcaggcttgtgttgctggcaggatacttcagcctcagaggagctgtgtgcagctggggagactcacactcagaggatttcaaagcagagggcatctcgtagagcaacttatccaaaccctgacccactgtaaacacacacacacacacacacacacacacacacacacacacacaccctgagagagagaaagagagagagataactaaagagagagaactaaagtttggcaaaataatacatgctctaatgaaggtttattaatgattaatctactcctagcatttcctagtccactctatctccttaaaaaaaaaattctggttgcagcccactaacttgattgtacagctgcttaatggatagcaggctgtaattttcagagaactgtttaatgcgggctacctctgttcttccatgctgcttgtggttcctgctctgctcaggacagaatggggaggaaaacaggctctgcggcacaatattggcaagtgaaattttgtaaaccggccctcccttccttttgcatttggtctgaaaattcaattagatgctgagtcctacaatgtatttgaggagcccaggagtgccctagaggatgagactgggtggctccctgtcaggttgaacatttgccttaattactttggcaagatttgcatcagtggtattagtccctgcctcacttggaggcctgcacttaagtggccacattcaggctccaatttcctggtgatttcatagtgtagggcatttgcaatcaaaactaggcttaaagcccaaccctcttacattttacccacccccacaaatgcagcaaataaaatgactctgattttcattccctagacctcttttctatatttattacattattgttaagacagtttttgaagaaagctgttttatttaacaaaatagctttatggaatcaacttcatatatcttctccgccagatcaaaacaagctcgtagtattagatgtcaccgagcaccatgacaggcagatgaacatcatccctgtgcccggctaatgatagctcggcctgccccggcgtcagccgctcctggcagggccagcgggcggtgtgggaccggcaccgtatctccagcaattcgcagataacaaatgtggttctgatgatgttactaaagatctgtccctttcaagattggattagacattaggaatttggagggctttttattgctagcatttttaagaataaccaattagagtattgattctaaagtctgaaagccacatggacagagttcatgtaattggctactttatgtgcctcttcctagattgccctgcattttcaaaacaagagcctttctattttaatcaaaagaatccagaatgaaatgaggctttgaaaactcagcctatgtttgtcttgatttccttaactgacatctagaagaaaatatgagctcaggggtccgctgggttccttccagcgcctaagcctgtaagctcttcctgctggaaccaagctttaaatgcacttgtcagtcatgtcccatgagaatagatactgccttccatgtttttttgttctgatttccgtgtttgaaatgacgaaaatcatttttctgtgctttttaaaaatggaattgcttttgtgttgggaattgtgctgctcatttttactctacctcgttttggaatcactaatgtggccaatttatagccaaaaatcagtatcgtagagtgagcaatgaatggcatggtgactgtgtaagcgaattcacgccctccctccccaccgctcgccccgcgtctcagtcctcagtgatggtaaacagaatgaggaccttctcccgaccgtgatgcgcctcagccctacttcccttgtcctttcctatcataaaatcttctttcatagaaatggtcatttctgttcatatctgtggactgtaaataacaaggaagtcatttttgaggtgaaaactgcacttagactcattccaattttgatggaaacttttagctggtggatggcattttgttttgtcttagttttgcaaggagttatcttaatttagggagatgaaactagtctgtgatccgaggtctcacttccatacatttctctcgggcagtgtggctgcctgaatcatgcctggatgccacaggtgcttagccagctggtcctgtcgtaactgtcactggtagctcagggagtgcagaggtgccagcagacactatgaaattggcctcgtaaagcatcagttatgttgtgatggtggcaaagctgcaggcgagatgggaagtgcagccactgagaactcacagtagagcgtgtgtaacgtaaaaagatgaaacccattgtacacagctgtgtactgcctccttgaagtcaaatttcccccattaccaaggaaaagttttttctgaagggggctgcttgacaggatgacatctggtgatatcatttattcctttggaaatcaatctgtggaagtgagtttccactgactgatgaggagaaaaatgaattggcttcacccagcatccagcttcttatcctgggagagatagctcttggtctgtcatccacgcagctgcctggtgcaagagccaagtttgtgcagcctgcagagcactcttcctgagctgtgggctgccaggtcggggggcagggggggcctcactgtgcagcctcctgccacccactgatcatctggggagactggcctatcctgtcaggagacgcagttgcccagacgttttcaagggcctaagatgtaggcagttgatccacagatttttggagagtccttgagttggagattacaggtgacctcagaggagggagtgagaacatctgggtcatgggtttctactaggagtccacagtgaaaacaagaagaggaatttacgacaaggcagtccagcaacttcctttctaacttctcccttcacatatgctggatactccaagactttgcatttacatggacatcacagatccactttgagagaagtagggtaaaaagaaataaatacatagtgctttaggtgtatttctatacatcttaattgatatgggattacattttcacttgtgtttactgtacagactctagacagatcctgctcttttgcaggtaaaacaaatatttcttaaaacctagaaagacccaaaacaatttaacagaaacattttggaccattttggaccttggcagttaggccccagtgcagcagcggcaaccataaacctctccataggtgctgaacccaggtgatccctggcaccggcagccttatgtcagggctctcttatcgctggtttttatttctcctaataaaagtgattaaaagattcatcttttaaagaaagcaaggacacagaggtggattctccctgacgctagcacagctcatgcccaagccactcctgcagggctctggtctaagtgcaaaagctggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattatttgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacacacagacacacgcacacagcacacagagatacacacagacacacacacacacacacacagacatacgcacagatgggcacacacagagacacactcacagagacacacagatacacacaggcacacacacagagagacatacacacagcccacagggatacacacagacacacagagacatacctacaacacacagagatacacacagtcacacacagagagacatacatacaatacacagagatacacacagagacacagatacagacacagacagacatacacacagacacgggcacacacagagacacacagacacacacaggcacacacgtgcagataaggtaatattagctagttgaggaggagaaagagataaagataaagtaatattagctagttcaggaggagtgaaagaagccttgtttttctccactttttatagaagagaaagtgaagattcgatttgaggtgagttcagcacaaaagcgtatcccaggccctctggctccaactgcagccctttctacctcattcccagaccccacctaagccttttctcttcaaaatcttctcaggcacactgatacacatacctcagatttttaattctccggttgtgttcaccaggtgcttggtcatgattaagaattccgtgatgtgtaccccatgtgtttaaatttgctgctgagttaactttgtggcggcctgtggactagacctctgcacatgcaatgcagaacggcagggccagatttgaaatcctgctatcttttcggctgccttgtaaaaataacatcaggcgatggggatacgatgccagaggtcacctgtgataagttctgtttatggccattttacttctaggaagacaggaagtgtcaggatctcagggatctaggaagccaaaatgtttttccactctgaaataaagtgactgaccaggagttcccggccacgcagccctgtgggaactgccgcacggccacttttatgaagtggacacgtgttggtcccactgaaaagaaactccccacccatggctccctcacgctgcagcagaggccctgccacagcacctgtcagcccctgccagcttgcaggggcgcaggcgcagagcggtttgtgcccttgctggagccagggaagggcacagggtccctcctggagtcatgggaggtgcagccgaggttctatattaaaatacagaggctagcacatgtgcttggggaatgcagctacagtagtggaatgaaagtgctgtccgttccttacccccccagctcctcacctgtcctccacacgcatatccctggctccctttccctagtaaggagactgaattgaaattgtggcttgcccgaggctgcatacctgtgctctttctgaagcccaagtcactggctctagaattctaacctgtgaggaagccactgaggatgtttgtcaaaatacatatttctgtgccttgccccagttccacggcccaggaatctgcagttttcacaagcacccccaggtgattctggtggtgtctttgcacttcttcaaggcagtactgcctggaacgcagaatcccagcctcctctatcctccttgcctaatggcctggatgctctcagatctacaggggaagggaaggtcacacagtcatcgcaatagtaacctcagctgataaatcctcccccataaaacttattccccagtgttttttaataggaaacaataaaactgtaaccagcccaaatatccatcaaagagaaaatggagaagtaaatcatcgcacattcacctggaccagatctattgtaaagccaataatactgaagccccttccaaggccctgggagtcctaacagtgcactggcagtgtctataatttatattatgaaatttgcataaggaaaacattttgtctcatttgtgcaatttctccttctaaatatacgtgtcactttgtacctgatttctataagacccaggacctacaaaccctgtgtctgcccctgcagccacccagggaaggactgcacagcagcaagacagattgccatggagcatgttgtgcccaactagggacagcgcagatagattctgtaatttgcctaacaatgtctataggatgatcccatttgtcaaaaaaaaaaaagaactgggctttattgatgtcacctaaatgcacctaaacttcttttttgccccatgctcttctgtactcttgatctttccccaaatttttaaaaacatgacactcattcccttatttttcctacttagaaaagtgtagatggttttatcataggaagttcaaaaaaattaaaatataatgaaaaatactcaaatagtgcctcacaacagtaactactgctaacataaataaaatccatatttcctctcatacagaccccagagttgctttgcctgacagtgtagttgatggagaaaataatctttatccttagcctccatctggttgcagaccataaagacagggaaaaaatgagggtgttggtagcttcgttagaaactgaaagctcactgattttttcaaaacctaaatagcctgtgtttctccaaataactaatttgcagccttcggcagccaggactggcagggatggggctagggggactggggagaactgctctctcctgagggtggtctgacccgacagcacgcatgaccttcccacagtcaggaactgctcagagacgtgatggcaactccatagaatgaaatactcttcagccagtaaaatgtatttttggataaatatttgctttaaaaaactttactatatgttgttaaatgaaaaaaaaaccttaaggcatcagaaattatgtgcagtaaaatctcacttttgtaaataaatatacctgtttactacgtatgcataaaaagaatcctgagaaatataagtactgtatgcatattgttgttaagtattttttctgtttgcttatctataattctaattttgcttcaaagaacaagttactccggcaatataaaaataaaataactaatttgtcttgtcatcaaacagatagtaagaacaggcaaacctggccctccacactgccagccttttgtgattcaaggcttcagtttcctccacttgttaaaaagattcaacaaagtagttgaaatagtatgtgaaccagtaaaccctaaaaggtgtccagtgttgtctgtgagctaattaagtgatttgattctgactccccgagtcttctgatttcgaagcagtggggagtcagacaggagcctcaggtggcctctcctgagaggccctggaaagtgatgagaacctggcctctggcagctcttcataaacgtccatgttttccctctactctctcactcttttcccagggcctcaaacagaagatgaaaatcaatttctaaaacagccctctgtgtgctctctcgtatctctccttttcacacatcgtggtggtggctttctctgtgttcctctgttgattcagtctctggaattaacggatcaggattccatgcccagaatgctacaaagactgtgcttgagttctcccacatctcactcaattacacagaagtttcagattatgtaacagatgctgtgctgggttaggcagagccatctgacttgttttgctttattttagaccatgagatgggtgagtttttctttttaatgccacattcttttaagaattaaaaacctccacttggctgtcagcattggaaatcagagtgatggtgcaagccctgatgaggacaatgtccttgtctatgaaaaggtgaaatcattgcttgaaatcgctaagcaggacatgcagtcccagatggaggggggaattcgggagctggttggaaaagagtatttggcactttgcagccttgagaggtgcagaagagacaccgaggggttcaccaccagagccaccattgtcagagaggcgtccagctgtgtccacctgggactctgccttcagggcttcttgcctggctgggagctgcacaggcagactcctgggacggtgtgccgacagctctgggcacccccttctaggatctgattcctgaggaatcacaatgtggatttcacaatcacttccagtgtcttttgccaacctctgtgaacagatgtgcaattaaaaaaaaaaaaagaaaggggcccaattctcaacactgtaagtggaaactttttaatggaaaaggataggctaatgaattgaatttgaaatctgagacagaaccgatgcatcaaatgtgctggtgtttacagataatacaaggggggctgcatcttatggtttcaatccttttttaaatttttgttctgagagacccagccagcagactgccgccagtcttgtcagagatgtcagtggtggccactctgaatggaaagcagcatctctcagcatctctgaggcactgctcctcagcggagactgtggtggctttgcctttcagcacgcatcctttctacgatgcctgacagtgcccagggaatgggcagagctgggagctctgaagccctttcacctaaaccaccctgggtcacctgacctagttttcctcccaattttaattatgtcaggcacttcacaaaggcctccttggggacaccatgagctcactgtcatcagattgctccaatcacagctgtggcttgcacacaaccgccatctctgccccagcagatgctgtgtgtaaacagttgtattaattacatctcaaaaacatggttcttgccagatcctcaggatttgggtgcagcctctgaggtgggtgggaggccctcgagggagaaatgtctgcaggaaattcttcccctacgagaggtctgttttctaagttatctaagagctactgcagctgtttactgcagagtgaccctgctcaaagctgtggtcacccaaggctttgaaaggggacctccacttccgccctgggtggagcaccgtgctggagacccacgcctgccaaggcctcattgtcatctccacacgccgtccttggggtgggccactcctgggacacgcagacaggaagccggccacctgagccactcggaggctctatccagagtcagctgccaagcctcacgtcacacatcactgttagtcttggagggctggcggggccctgaagtcaattgaacacttggatgacagggaacttgccactgccagaggcaatatgctccatttttttgacagttccaacaatttttctttaaactgtcataaaaaattgctgctgtgaataccagtgtcggcgtccctgcctcacctttacctggtgcttttccaccacacaaaactgtttctcctcgtgctggccttgggcttgcagacagctgattcttctcctcccgcggctgagcagcctcctccgagcaaccctctgacaactctgctccttctgacaacctctgcaagggctgccagatgtgaacaaggggcccgggcagaaggtatccaggaagactggaaactcgaggaagcctgccctgtcctgtccaccagactttacgcttgcgtcactgggctttgggacctaagtcctcgtcatttgttccttttgcagttcctactgttctcagcacttccttccagcttactgaggtacactcagatgtgatatgccatcggtacagacacagttctgctccagcatttccccgtgttctttctgtcgctctatttactgaattaccgtgaggatgtggagcgaggctgagttctgtattttaacaccattttaattctcacctactgagaaatccatcctcttatcactgtgctttttttaacctgtcacgaatccatgaaatcctatcagccagcctgcatacttccttttaaggtgcagttgaatcaggagaaacttgccgcacatgctgcgtccgggcacagcattggctgaggctgctgccctgacctgtccgctttgtagtactgcccagctatgaaacaggttagccacacatgacctgcatttaggagtaacaagtctgtctgtacatgcacatacagcaacttttttaaactgtctatattttttcctgagataggtatttataatatctccatcttctttcccattttgaaacttagaacaagtttgcctgtcaacagttctccacagcatactgtgtattctaggattttctaaggttgagcaacggaggttcagcaattttgacttaatttcttcccatcccttttccacgcagcccagaagccttggatcacgtggtgaggggaagaggttgtgctatgtcgggaaactctgtatcgaagctcggctcagatcatgacattctcttgactaaaaccctcagtttccatcaaacttgtcactctggcattaaagcctgtcactgtgtggctctgaaaacctctctgaacgtgttccctgcctctgccctgcaggtccctgtgctccacagaagcccacttatgtgacccacccccactcatcaccaccttccctcacccagagcctcagctccccactcccacctgtaagacccctactggaaagattcccacctgcccctcaagattaatctccaaggacatttccaaattcctctccccatctctcagccagatggctttgctccctccaggaaccccagccaccttcgacctccagcagggcactccactccacattctcctggtctgtctggctcatcttacctgagccatgctctccaggtgaaggactatgtctaactcaactctgctttaaaagcagctaacacattgctctttgcatattgttcactcactaagttgaactggacttggacatgcacactgaactgcagcgtctgctgcttcttggtggcccagctcgtcaaaagaataagatttcagcaaaacaatgtaacaattttttttaccaaaagtaatgttaacaatatatggttttcccctgatgtttgcgtcaaaatgctttttggaaaaaacatttttcaactctttagggtcagaattaagcaatgaaatttatataccacatgtataatgtgtatgtttatctaagtatctgttcatttatatatcttaaatagaaattttaaaaatttttttaaaactcctgataaacattctcaggaggcacactatgtaactgttggttgatatacctagctagatggtgaaatcagattttgtttaaagcatggaggagtgggaaaaattaaatcttgcagattctgcagtccttaacatctttgaaagaggaacatttcagacaatgtaataagaaggccacgtgctttgacttctgtagattttaaaaatacttctgtatagtttcttcttcctttgaagaagtttggggagtttgggaagatggagaaagatataagaatagactccccatatgggtcatgaattatctttttgcatcagaactcttagtgcagtttcagtattttcttcctcaggagggtgagctgcttccgaatgtcctccccttctttgaggcatcctctgttggtgaactttgagagcatccatttatgaagttgatgacctttcccagtctctgcaagcccttcagtgtgtgtcctctctgagcaaatctgaattgtgtgcttaatacatggaaagggatttgggagggttgctttttaaactgatttcttaattaatattatggtttagttaactagacagtctcattgcagaagtgcataaccataatatgtcttcaaatatatctcccttcctaacaccctgtaatatacttttgtaaagatacccttacagaatgtgatccaccatttatgaacctgcagcattgcattcagagactaagtgaaaagctggcagattttcatttaaagcacaagctaaggaagaaagctggtctagaaggagctacagaagggtaatgcttagggagggaatgatgtgcctgtgggtggtggtagttaaatctaaccaaagaatgatgtcgtgggtgtttggatattggatggtccacattgggccacattctttcaaacataagagtctgtagaaatatgacctgtaaaagactcttaaatattctggaaactgtttcttccttgtcacatccttatatatacttgaacctatgcctaccagacatgacatgtgactattcatacagatttcatcatctctggtttaagaataaaggatgctgcatagaaggctcacatcttttaattcacaagactgaaactgttctgaaatgacattgtttctaaaaattcattacttgcattatattcatttttatttttccatgccagaagggtagaagttcctgtgctcatattaagaaacagcaatgtcaatcgaggcccaactcaaatccaatttataggagttataaagggcgtgtgcctgttttgtctagaagcagtgttgggcagcactgagtaggatagaccacctgttgctaccgataaaggagcagcttctcgaatgctcctgtctggtaggcactatcccgagtgctttggcccctcatccacaatctgtgtggcaaaaggcattgcaggcaattcagtgaggagaccgaggcatggagagcaagtgccatggaattccctaaggccgtgcagggagcaggttgccaagctgggttgaaaccgtcctccgtaggctcccaactccgccgtcgctgctactgtgctggatgatgcctggtagatgcagatgtggagccccatggattctgagacaggccgggtttcagtcctgccctagctgcctattggctggatgaccttggcaagttgactttcgtgagcctcatttgtctcatctctcaattaagaaaacctagagcctatctgtgggggttatctgaaggattccagggatgcatatggcactgtctaccgcatgcggtaactgtttcacaaatgatgaggagcgatttatgttcttagtggaaatatgtcggcgtgtgaagtcccaaagctctgccctgcctggcttgatccagtgcctaggcactgcccctcttcccctctctcccaacccactgtaagaggctaggctgcctcagtaactctgaggggcattgactcttttcatccaaaaattcatgttactgccccacattttttctgttgttttacaacgcagtaggaagtgggcagactgtcaggaaaagtgatttatagtcatgtattgcttgtgctttggcttcatttgatccaatgcagatcagctgcactcagaaaactactcaagtgaaagagaaaaagtaactgaagggggaaatctggatgagtaagaattccagggataggaatattaatagcaagctttttgcctgatatagtcactttatgctgcaggggtgcccctttataaagtgcttgtacaatggatgtttgcttttgattttggatttggagtctaatgaatgttctaaattattattagaggagcttgcggttgttacatgtctgcctttattgcttatttttagccatctcccctgatgtcaaatgctcaggcaagaatgatacattcatttataatgtggctccttcagaaatataccacataccttttggtgtggtttgtggctgagaagagtggggaatgcacaagtggaaaactgcagaaagattatgccttcatcacttcaagtatttgagatgaaactagatcatttgctgttgctttttattctcattctaagtgcttttcaaagtcagcgctaagattttaaaatggttttctgttgttggcagagagggaattactctattactttctgataaaacagagtctttcatgatcaaagagaaccaggctctagtagttccagtatcctaacgtggacactaattgtttccctccttttcttcatgaaaacagcttctgcacaaatgatagccttgtgaactagccatgggcacaactggagaagcatttagggagctttagtgcaaattgagaccacctacacatctgactctacagggtttgacaacatccagggtgaatcacaaaacatcagtctaatcagggcttatatagaaagagtgaaagaactctgatttcatcctaaagattatttatattaaccattgttccaaatgcattaactattttaatttagttgttttgattgttaaaaaaaacacatctgtttggtagataagacataatttaagacaaatgttctatttgataagcttttagaaacaacttatttttattctttcctgtgagataactcagatgtggagaatgtgacaaaattttaagcataacatgagaagggctgagacacatagatttctgtgtgcttacttgaaaacaacaaaatttaagaatttggtataggagttgtatcaggtagtgcagagtccccaggagacctagagacccaggtctgggagcctagcggcaagggctgaatgtgggatgacatcagcagaaactcacagccactgctattccaaaaacccagcagcagctcagtgcagggcagtgctgatagtacagtgcctgcaatcctggagtggatttggatgtgtcaggtacgcacacgctcactgctcccccagcagtacgttgaacagtgtgcgtccaggtgtctgtagggcccctcgccctaactcacaaaaccattctgggtcagaagccaccaatattgtcatcatcctcccttttctgagaaccctagtaagtccctccagtggggcaagcccaccttttcccttcattctgtggcaatatgccttcatttcctaatcagttttgccctgctcattcaatgcaaaatggatctgctttccttgggcaccaatatgtccagggattgtttatcaatcttcagttctgtttcctttacatatccctccaaaaatcaggcctgcactgcctgtgcactccacaatccacaggcctgaaggaaatgttatctttgatgtagagacttaaagtaaaactattcaaattaattatttcatgcaaaaggctagtcctgactctaattctaagacatgtctcctaaactctggaagtctgatgtatcctattatcaacatttatccttaatgtgatggtttatcatttatcctcaaagctgcattgtaaaatgtacactgtaaagtgtacattttaaagtcggttttaaaaaatcatatttagagatcctggtaaaaatctatcaagtcaagacattaccttattacccatggaattgtcttcaactcttacagttcaaatattcctgaattggctttcacaataaacatcctaaatatgtaagtagaaacatatatattgccaactttgtgccttcccaagcaaaattaaaatacaggaaaagtcagtttgttttgcccataaataaatatatgtgtgtgtgtatgtgtgtgtatacacatacacactcagaaaagatagaagcagcagcatattttggcagcatctggtttattggaactcaaacgttctgattgtgcatacagactagttaatgtggtaacaattatgtatttcttccctgctccttgccttctttccctccccagtttttttcttcctgatagtaggtgtgtacttttttcctatttccattggcaagccacatgacaagcaaaacgatcactcgaagaatattgttccctcaatcaagaaaaatgcccattgggttttgttatttgatgttatttgatgacagagacctattgtttttccatttttctttttttgttttccgtggcacctatggaattaagcaatataaaaaatctattatttcagatgttcacgtctaatgaatttcatgtgaaatactggcagtataaccccaaatagaggaaatttgtgaagagtggatgctgcagggcatgagacatctgcacagagttcatctcttccagcatcttgcatgtcccaagcactgccctgccaggcagagaatgctgcagatcacggcagtgaattccagttgttcagagcacatttgacttccaaattctcaaggccacagatttgaggacagaacaatatttgcatttgaaattggaagattattttttgcacaagtgcctatatgctatatagagtttgcccactctgcattatcttccccctgttcccccgttatctggcacaagctattcaaaagacacgcctacttgtaaaataaatggtttgcaaactaaggaaaatacttaaatctcatgtaaatggtactatactatgtataaaaatgtgaagaaacacagaacagctcatgaacacctccactgctgtataaaagaaccatcttttttctggctcctattggatgccttagaaaaatctgtatttcctctttagttattgtgtttgaaagatgaagttgagacaaaagttctattctttttaagttggcagaacttctgaaaggtgatttttagctgcagtgtgactcattccaaatgcagaaatctctgaccctgagttagtctatttgtcatgcaagagcctagaaaagccctgagtgataagaaatggccataggccattcccacagaattttcaacaaaaatagaatcatgcttatgttctagtcatgacttagaacttataactcatgttcggaactgtccatgttcacgcacaggggccgtatcactccgccagagctgccctgggtgccggtgtgcagaggggtccgagagtgactgtctcttcctctgttgtcgaatgtgtgggttatctccataaatggctgccatgagcatccttgttcacacatttttaggtacttgagtgagtgtctgtggaataattttgggaagtgaaatctgtggtcagaggtttgtgagttttacatgctacattttcagaagttgagaaatagcagtaggctgaaggcaagtcgccatgcctggaattcatgaacactagttgaaagaactggcgtgagttagtcatgacaggagagatggggaagggagttgcaggtaggagggccatcttcaaattctcaaagtatagtcactccaaaccaaaattcgatttaatctgtaggactccattctcaaagcacagtcactccaaaccgaaattcgatttaatctgtaggactccaggtggcagaataagaggcaatggatgggtggaagcgaaacagggccaaagtttgacttcatgtgcaacttcctaaggagtgatttgaactccacaaacatgaactaagcacctcaacacaggctgggcaagttgctgttcttttggagcttacatcttagtggggaaagagaaatgcctatgtaaacatataaatcagcaggatacattgtgaggacggtcattgctcagtgagactgcaatagagtgatacgctggagggggctgcaagggagaaggtgggagggacagcatttagcagaatgagcagcacagtcccataggaagaagaatttattgcctccttaggcaaataaattcccaaaccttgaacatcagaaaggaaatagattaatgtgcacagaggattaaattatgtgatctgcaaagtcatttaaaatctatttccacataaaacatattaatgcaacctaaacaaaaggggtctggataccctcatcttcttcccaagcatcaagtctttctatagttaaactgagatgcttttattcttggaaaattttaaggactatctacagcaatggaagaatcgggtgttgggatgtgttcccaggtaataatgactgcaggctgatttggcccttgaggtgtggcctcatggccctctccaaaaaaaatcaaggacctgctacaaagcacaaagccgactgcaatgcttgctgcttactggttagggcagctcctctttgccagcgaccaagcagaaagcaagacaagacaggttctgaagcagtaattcaaagccttcctcgctttcccatgtgagtcattgctagtcagaatattacctttgcagagaggcttaattccaaatttgctcttaaagggatatcctctcctggtttaggtataaacttttgactcacaggacaaattctatcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaagtaagaaagtacatgaggaggcacagaaagaaaaatgtgagagataacagcataaacacacagtgtatgttgttatgaggcatcacatgatgagatactgctggggagggaagaagtgaggagattcctaggaatcttatgagaatttccagagacaacaagttttgagcttttttttaatttagaaaatttaccttatttttaaaagaatatgtaacatatcccatgctataaaattctagacatagtagatttaaaacagcataatggaaaatataaatatctattttcttttcctatttatgtattctgtgccagtaggaatgtagccaaaaagagagaaaaggggtctctgcagacatggatgtctctgtgacttgatcactgctaacccaagaagataataaagcagaagcatgtatccaggttgctgcagccaagcctgcccggtctgcggggcgtcctcacacatggggcagctctcccaccccacacactgggaaaggcggacagaggctgggcaaagcccccaattttcgttggcactgaccccgatgatttataggcctttgtttcccatgttaaatgtcttacgatcattaaattatttatagctcaattagcatgtgtccaaaaccaggaagttcataggagactgtgtgactgggaattaaggagcaaagcaactttccagtctgtgatttactgggtttccattctgtttcctgttcggatccggaagtagaatttcaaatattgcttttcatgctttatttgggaccgattttagccccgctctcctttctcttgccattcgctggccattagccaccagcctctgcacaatgaccagctggcccctggcagatcttgggcccaggtgtgaagtcgctggagaagcatttcagggccaagatgggagtgatttcattttccattgacactatgcagaaatgaaggggattcaagtgccttcagaaaagcttccttccagcgaatggagttttgggggttttccagacttgcaactgcttttattcttggaagcatcattgttgctttttccccccttccatttatatcccaggaactgattcagaaaccatagaaattggatttggaatcgctgaatgctagcagacagctgactgcactcttcccaagaaaccctgccagctgggttcgggtatcgcgcggtgtgtgctctctctgcctggcccgctgagtcctctaactctaatggattccttcttacaccaaagtgcactagaactaaagtgttttgcttcattctttagacattttgtggtttagggctcaatcagccagggtatgatttgcaatccacagtaaccggtttcagagcagctgcccagcgaggcaggtttcatctcgcttgctagacgttttgtttttttttttttctaaacctcacaccttttatttattagacttggattccagtttcctgagcctgtttgtgccactgattagacaggcttgaagcagaacccaccaggcttcctgaataaaatgcagcagtgattgtattaggggtttttaaattgctcaaaatactgtctaaaaaacactaaaaatcatgttactttctagattgaataaaatcctatagaaatgaattcctggacttgatatgtagcaagctggcattggctcgggagtgagtgggctcagttaagtgagctaagatgagatggtgcacaggcgagcacccacctgaggagtgtgtggatgttatgatagccagctcctctgtaaagacctgtccttctatgtcagcagcccagcagataaatgacgtgtaaataccacatttaggagggcttatgatgatgccaattaatggagacctttttgaaacaggaaggaggtgaaacatattcctttgcttctacatcactgtgtgccaggcactgtttacagcatctcgtttaaccagcagtcaccacctgacggatggctgatgtggggtggggtcccagggtgggattgcgtgatgggcttggggtctctggctgatgggtgccagagctgggactggaactcctggcgtgactgaggcagacacctgggctacccagcctcacccacgacgccctcactaagtgacccacaggactcaccggaagcagggcagcaaggtccccctacagaggtccccactgcaaaccgatacccagcttagacagcagttctgcagtcggcgtctcaccccttcgggtctcattgtgactcactttgatagccacacgatttaagggtggttcagtagtgatttgatgagtgctgtggctcagggtcattcccctgcccaagcatttcaaattccagaagttcatgccctgcatggtgggtgaaaagtctcaggccaaccatgagcacacagcagccaggcgactgaggcagctgcccggggtggcacgttgctcaaacccatcatttggagtcaaaacaaacagatgattagctggggtggtcactttcaatcaagagttttcacatcgcctagacatggcctcagaatcaggcctggtgtggccaggggctgatctcacagtagacaggaagtgtggcccgagggccatggctgccccctcagaaggccctgtggagtggctggccgagcctcagcagcctcctgtgaagcgaggaagggtcttcctgccggcctctggagatcagtatgggaatgcacaagtaggaaacgctggatgggaatccctctgccctgtgataccaaggcagtgagtttgtagactatggaattgctgtcggagggctctgtaaccggccaaggtcacacaggtagccattggtagagcagggactggaatcccagacccccaacttccaggactgtgcacctttctttatcccatacagccttacagtcaagtgccagtgcaacacctgattcccaggttccagcctttgtcttttataatgggaatcaaccttatcttgacgatccagagatagtcatcaaggaagattaaattatccccttagactcagagtgaccatatcattttccctccacacaaggacacttttgagaatgaaaaggaggagatgtctgtaccagacgctggatgacaggcaccgacaggctgtctgccaggggagcagcgattcctgtatgttgtagaaagtttttcaaaagtcaccttggaaagaggttttgttccttaaccttctgttaaataggaagctccgtgaatgaaaacaactcccttccctaaacattctagtaatgacccaacactgccaagcctgccagctctgcctcatggtcgtgttgactgtgtgagactatgtgagtgcctgctacacagtacgctttcagtaaacatggtattgcctcgataatcccacaaaaatgtcctattcaaatcacctggcacccaggaaatttccttcttttttttcccaggtgaaatatacagttgaaaacacctgacagcaattcccctctcccatgtgtttgcaggatggtggttttggttcctccatctttgatgtgtacaagtgtgatgttttccccccacagacaagtaaaccacattctcttcacattcccaatgttttgtcaatgtacctccttcaatagaggatcgataaggaaaaaaatcattgacaatctcaattagattcactatttcatccaaaagcatagcttagaactctagtttttgttcaacactcttgccctatgagtgcacagaactttaattctgatacaaacatccctgaatgtttagctttgacaaagattccaaggtgatttgataagaagcagggctgtgtttgggctctgggagtttttgatatggtttcaagccccatccaaaacccacagacctctagaaagtaggtgcctgccttcctgcagcagccctggagcctgctgggggctttgagcagctgctgccaagccaggcctcacccgacactctgatgggcacggccatggtggcaggggcttggacgctgccaggtgactctaacttgtggccagggtgggaagcactgctccacagaggtgccaaaaccaggttccttcctgtgttctcacatttcacagcctcaatgtaaaaagtaagacatgggcactctggaatattacaaaaatatagaaaagcatgttatagtaaataaaaggctcacagaattttgtcatttaggaacaatgattattaatatattagtgtgtgtttttgctcattaacagtatatcctgagatatttcctataccatttaatattttaaaagatgtttacactggccacagtagctcatacctataatcccaacactttagagggcaaggcaggaggatcacttgaggcttaaaaattagccaggtgtagtggcacatgcctgtagtcccagctactcaggaagctgaggctggaggatcacttgagcccaggagttcaaggctgcagtgagctataattgcaccattgcactccagcctaggtgacacagtgagaccctgtttctaaaataaataataaataaattaaaacatttaaaaatacatgatgtttaattattagaggactcaattttatatctatgtatacaataatttttaagtttcttaatattggacttttagtacctttttaaaaatactatttttaaaaaaatctgtatttctaactttttataacaaggaacctttggctttgagatgactggggaatccattctttcctatagtatccatgtccaatggacttaaagtattaatcaatgtgtttatgttttgttatttttctggcattacaaaaaattctaaatatattgttaccgcctgtataaatatcagcttttgagagaaggacattgtgtagaaataatgaaacactgcaacttgtatttgtattattcttttttttttttttttttttgagatggagtctcgccctgtcacccaggctggagtgcaatggtgcgatctctgctcactgcaagctccgcctcccaggttcacaccattctcctgcctcagcctcctgagtagctgggactacaggtgcccgccaccgcgccgggctaattttttgtatttttagtagagacggggtttcaccatggtctcgatctcctgacctcatgatctgcccgcctcagcctcccaatgcactgggattacaggcattatattattctttaaattcacatgagaatttagtatggcttcaaaaaataccataagttaaaatatcaccaagactctgttcagacaaaagtatcagaaaagtgagccaggcactcacatagtttatagtttataaaagtgagacaggcatgatctcttaacctcactatagtcctgtgaataaggtttatttacatttcattttacctgccaggattattgtaaaaacgccaagcacattgcctacacaaactaaatattcagtcaatggctgctattttcatgagttcgttttaacatatatttattgtcctctactggatttaagaagttatatttattatcatctaagattttagctattccttctcttaaaaatagattttataatcaatggcagtaagggagagtaactcgcagttctctgaatctcaaggggttcctggaagccttcctgaaggtatagtgaaatttcagcttcacattcccatccatgagctccctgcaaatatcccggtctgctctcaggacccagtgacttacctatgcagaggctgtagatagcacctggagcttcctgtgtgccctcctcaaactcagccaatgccgtcatacagtagcaggcaggtgtctttgctgggtagttggactggatgtccctgggattgcagaactggaatggggagtgacatcaggaaactataatcatcaggacaacatggtttgccataactttaagttttaagcgaccgcagattatgcggagagagatgcatgcccacagccatgcttcccatgtaactggagaggggtctgaagtttgaaacaagtgttcctaggcacgggttacagtgtttgttatcatcatacttgatttagaatggggcacaacatgtggattcatggtaactgttacaaccttactcattttaatacctgaaaacatgctttccccatgctgggaatcgaaagattctcctaggaaaagaaaggcttgacaacatcgattcaaaaagggcatgcattttcctcatttaaataactctaatgtgcaagtagatcccctgacctcaagctcagaagagtccaggccttcacaccttctctgcttctgctctggggccagctattgagattcctgtgcccacgcaatgcgcacatcccacccctggccgctgtccacaagaaatccagttgcaccaagcaccccactttttgcacctctcatttatgtactcctaagagcctcaccacaactcccttctaaaaacatgagttcctgactgggaattcgatgctgcccaggcagctttgctcagagggagcagccttctagaaatgtttcaagtaaactttcaagtataactaaattcaaaaaaaacacatacacacacacacacacacacacaagtcaaaggtgtgtaatttggccaatatcacaaaccaattagccctttgtaagtggcacccagatcaggacagctgaccataccagcaccctagaagcaccccgtgctgcctcctgggacagggctaccaccatcctaaggccagcacgatgggccagctttgcctgctgttgaattttgcttacatagaatcctccagtaggtactcctttgggtcaggttctttcactcaacattatgtgttgatatttttccatgctgtgctgcaaaattgtatttcttgcattccataactgggcagttccatcataggagaataccacactgcgttcgtccattctaccgccaatggacatatgggttctttctcttttcttgcagttacaagtttatgaatattgtcccacgtgtccctggtgaacttttgtttgcatttctgttgggtacctcagagtggcgttgctgggtcagagggtactggtcgctttagtagctttgaaagatattgccaaaacattttccagcgcagttatagcaaattatacaccaccagcagtagaaaacatctcctaattgctcacagtaaacccccaaagattgccacatacatcttccatatcaattacttaactattcagcaaatttgaagggaaatatatttaatctttttattcaaatagtttataaagtggaatagagatgtgggtaaaagttgtcttgccacctttttagatcggtaaaagtttgttgaatgcaggcaagaaaagatgagaaataatggtacccaatgaaagacatagcagtctacaaggaggggcatttcccggggtgggggggacccacactctgtaactcccacattcaattagcatgttataggtaagctgcagaaaacgaggcagcttgtcaaagaggaacggctcttggccatggttgctgccctaggaggatatttgatactagcagagctggggcaaccctggaggaaaccacctggaatgatgggagaactcctccagggaacatggccctttaatagatctctgttatgtaaaataatcccaaagcagccaccagggcatactgctgcgatcaagtcctaggcggtattcccttctgcgccatagaccctgtgcagagtgccctcaacgaaggagcaaggaagaccaagtctcccgagggtttgcatatgtgtatgtgattctgcagtcatggtgaatgacacagtcagggctgcggaaaagcattggtaaagtgtatatttgaggcttcagaagtttgaaaaggctagatttcctaggccaaaacactgaaaatttgcaattagaacttcagtgctgatgctgggaagactggagttagtttgagacatgcacctgtgcagaactgggcccccagaaaaggagaaggaagggaatccagaccagagtagggcctgacaccactcagactcggcgtgtctataaattagaattgcgttacaattacactttgacattttagtggtttttaaagtgcccagcacaagttaatttttcattaatgaatcctttattcataaaatgcttagatggagattacccttttgagcattttgccagtgcttctgaaattaatggggacctcctgttggaggacacagtctgttgcaataggtgaccactgctctgaatctatgtcacctctccaggaccacgggcacaaccatcacctgaggcatgttggagatgcagatggtcaggccctcctagaatctcagaatctgcattttagcaaagtcctgggtaattcctatgtccattggagtttgagaagcactggtaatctcaaatactttaaaagattactagagtaagataggctcagtaggtacctgaaggcaccatcccaaagaccagagtggtagaagcaggtggaccagcctctgaacacatttctcccccactccccggctgtgtggaaggttgccacctttggggtagtcattcaacaaacacgtgtcaactgtccactatgtgtcaggccaccactgggcactggctgtggctagctggatagacaccatttctgccctccagaaatgtcatgtccactggcacatgacaagtcactaagtcattcagagccatgggtgacagctccaggggccgacaaaggagctgtgatctcacagatccacagagaagtgtcccagggcgggcgggacccaggactgcacagggaggggtgaagtgacacataagaagtcagcccatcagcctgaaatgctcccccaaatcttcccattcagtgttttctcagtagcaaactcgtgggaaaattggttattttacttaaaaaactcatactagaaagctagtttaactttaaaaataaattttaaaaacatttttattaacaaatcctacctttcctccaaagtcaaggagaaaagaatagaagtgaacaatggaccaagtaagcctaaaactctgctctttcccctgctcattttacagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggacaatgttggctctgatgctgtacatccccaacaaccatcaactatttggaaactagaatttcagcataattggagttggtgttaccctagcaaatgctgtgggaagagagtctcactgtgtatcttctcctgtttaaagcctgaatttgttcagaatgtaatatctctgtttagccactctactgaaactgatctaggaaatgttcaaaaaaaggtatcccaaggatccctttgtagctacatctgtgggattcccctcgctctggcgtggcctggcccctctgcatttgacaatacggtcctatgcttttgtcttcctgggctgcgtgaacccaccctgccctggttcacctctcctcttgacccatccttatcagtgtcttgaaaggtccttctattggaggacacattctgttgcagcaggtgaccactgccccaaatctgtttcacctccccagggccatgggcacaaccatccctggagtgtgttagagatgcagttggccaggtcctccaaaatctcagaatctgcatttttgcaaagtcctgggtaactcctatgtccatgagagtttgagaagtactggtctcatgagttcctgacatacaaatagtgctgaggccagtatgctgactgggtagccagatacaagtgaaaaccttcctgttttttgcaaacctggatggacccgaggccgctgacgtgggccaggacaagctactctttttcagtgtttctgttgcatcgctgtgtctctctgtgatcaggtgctgccctccctggcaggaggactgcagacaggatgaccaagagcactctacacagcctgctctccagtgttgggggacgccacccaccctcgtggttcctgttcatctgcctacacgtggagggcccaagagggctaatatgtgactatctccacttcctggtaccctgtgtgaataacttcacttactaaagggatgttgagcaactttattaataatgaagaaagcactttggtttgacaaataatcactccattttttcatttgaaagttaactcttgttagtagagaaagcaatgtattacaaccacaaggacgtttacatggaaatgaaccatctgcaaagcatcccccattttccttttaaatcagccaatgggtggtggtgggagaaatattcaccagagtatttaacatctatcccccttcctagactgtcagctccatccgggcggagactgttggtatctccacagcacacacagggcctggcacacatccggggctcagtgagcacttgctgaatggtgaacagattagctctcctgggaacgttgttgacacatctcataacactggtttggagtggagggcattcatcgggctgcatattcctatttttaattgtattctccactggttacagcacctacagttataaagacattgttaacattgcttataggaagacatttgatggaaatgagtccaaaggcattacggttagaaactggccaggtgtcatttttgagagattagataactgttttccggtagagtgaattgcctgtttgttgcaagttgggactttgctgggctggtttacagggccaaggggaaagagataagtggatcttctagtgagaggtcatctgttttgaaagcctggaagattccatgaactaaatccaagtcttacaacacagggaagtgtgtcatactgtgcagggatgaagtctccaatttagcatgaaaacaagagctcctcacactgtcctcttcagaaagcccatacaatccaaacttctgaatgcttagctgcttacaaccatacatagattgagggataaaactctgatatggaagagaaggtaaacattttttggcagacattcccaggaaaaggcggctctcttctctcattgctgctgctctttcagaatccatttcaacagaggaggagtcaatgggagccccgtgcctctggcagatatcatatggcgtttcagtggcattgtgtgttacccttcttaggtaacagctcagccattagaagaatgtcctacacaccttctcattttctgtgatgagaggaatgtgaggtactgcccttcgagagctgtcatttgtcctagtagccagcagcgtgactgtgctgtcttctgctctgtctccctgtcagccttctgcccagccaccaccactatagttttgttctctccattggaactcctggttcagagaattaccataaaaaacagacccctagacatacaacactctatcacataatggtgactttgtcttctattttggattactgagctttcttgggtaacttccactaaatcgaagttaatattagaagaacttcctcttactagaatcgaaaagcatttaagtgatgcagtcaagtttgtaccataagtaattcagtcatttaacaaatatatatggcctctgtgcgacagtgaccttgactgggaatgaagctgtcccatgtggggcctgttcttcaaaggcagttccctgctgcccagttcagtccagtggatctgggcatctctctttaatccgcattaggggctctttactgattcttcactatccaaaaagacttggaggggagacctgagcccacttctggaaggaaatgataacaatttatttagataatctttgtgcaacaagtcaattcactgaagagatctgctctctaggagcctctgtgaccccaccataactgggaaggctctacctctccagtcttcgggccacatttctctctggcctgctgtcttcccagcactctcagccttgctcatggagcactctagtcctccgtcgaccttggcctttggtaacgtgatttttcacctggcagctcccatctggtctcactccctctttttgtccagtctgcatgacacagcctcacatcgttagtgttccctcactcccctcttactgcccaacctgcaaagtccatgcctgggccagtgcagcatgtgtcctcattgggctgctggtggcagtggggggaaccgcacagccacgctgtgtgctgctgaagaaatgcacagcctcctaccctcgccctcaagaggcagccatggctgcacattcctgcccttctgagctccgctcacttttggcagcagccgttccaacctgcatgggatcttcactctctcacagatgtgctgactcctcctgctgcctcccctctctgtgccttctcactctctgttccctttgccctttctccccttttctcctctgcctacctccaagccatccatcacaggacagctcaagcatcagatcctctgggacactttccttagttgttcagtctgatgaggtgtccctcatcctctcttagctgaaaatcagcagctgcctcaacttcttttccagcatgtctcatgagtattgccacaacagcatctgtcacaatgtggggtagtggctgacttgcttttctgccattcaactgagttccctcagtgctggggccagcgtgcagtgtcttgtattcagtatatagctgattaattgatgaattgattaattaatggttcacactagcacagtgcaaccttcaatgcaaagatctcatcaaaataattcacatggtgggatattttagaaggatgaccaggctagtttgtagtaagaaaaaatcaacaagactaggtcaggaattctttttttgtctacaggcttgctatagaagatattgaaaatcatctacctaattacctttattttatcaggttgtgtattaaatatcacgtctgggggaagaaaatgtgatatgtgattacagacctttcctggtacaacatagtacgtttcagattaactcaaggtattgtggtgatattgcggtcaaagccaggtgattaaagagtcattctttgaaacaaatatctgtgcaatcaattaagaaattaatttgcaaattttatttgcttagagtaattgatatatcattccttttacaaacaaatataaagaaaacttaactaaaaatactgcatatctctttcagattatatatcccagaaaggatatatttttctcctttctggtcttcctttttggtgtagcatctgtaggaaatgcatttcttcatagctaagtgtacctccttgtgaaatatcttcagagtctactggtgcacataagcaattgctggcagcagcttgagggtctccatctcacatttatcatatgccttattgcatgaggctttgcaagaggaggtctagagctacaatatctcatggatatgaatgtcaattcaaatcccagtggcagtttatgagggggaaagcctagaagagaagaaacctagaggaatcaagcaggaggggagagtaataaaagactagagcagcaggtttttcttaactcaaactagaattaaatctctgtgtgtgtgtgcatgtgaatgtgcccgtatgtgcatgcatgcacgtgtgtaaatggatgtgtgtgtgtgcatgtgtgtgcaagtaagtgtgtatacgtgtgtgggcatgtattgtgtacatgtatgtgtgttttatgcatctgtttgcaagtatgtgtgtatgcacataaaagtgtgaatgtacatgtgtgcttggtgtatgtgtgtgtattaatgtatgcgtgtagttctagagtctagttagagaaagtgcataaagaaatagggaaattaacaagaaagctatagcttaaattataggaaaaacttttctccctatcagtcatggttttaaaatgttcagacttgatatgtttcccagtgctattgtcagaaaatgtccctatgacattccatactacttcaatcaaatctaaaacctttgttccaacatgttttattgatatgagtatatttcaaatttctaccaggtttttggagaggtattttggccataaaattgactaaattattcaaaataaaaaatgaataagcctgggccaaggcttggagacttgcttaactcagttcttaaattttcagattttcaaaattacaaatttaagctctaaaatcatggtgctgtgtatgatattctttgattgcaacttatggttgaaaaactatagagggctttatgctaagagttgtggatcttaggattttcatgaaatctgcattatcatcatctgcaagtttagatggggcataactgatccaaaggatggatccctcgggggcaattcaactggctgattccagccaagatgacaacagtcaggatccgttcccttctgatcatccattgggtgccctgatttcctctacagccctagctgaaagaccagacactatctcaggctggctgccccacatgccttgctccacaccaaattcacagtctataaacctgagcctccagtgctcctactaccatactcactcgaacattcccgattctgacctggagatgtcaacagctacttgatgccactctcttctatctttctgtagctaagccatccccaagtttgtcgattcaccctctttaacccctgtcggggtgtccattgtgccccttcaccctgccatctccctggtgcactgttttgcaaagttcagcatacatgagcgtcacctgggaaccttaataaagtgcagatgttgattcagcaaatctgggatgccctcgggctgcatttccagcaggctcctggggatgtccccgctgctgtgctgcagatgacactctcagtggtgggactccaggctctgctgtcgcctcctaggggtttctccacactccctggaggcctaatgggcccttctccacatggcagtaagatctgtttttgtgtttgtgtttcaagttgggagaaggagattatttaatactaaaaggtgcaacatgggattgagaaaactaattattagtcataagttgagtatgcaacattgaaaccacatgctttaaaaaattataagaaaaaatcatagtatttgaaagttacaagctattatggctaactccatttatctcagttagagaagagtcacctgtcaccagggcactgccagaagccaggctcatttccaacagcactgggtgctccagctttggggtgccagctcctcccataaagcaaacacatacctagggatgatatttctttgcaagggctctgccctacagcttgtacatctcaagaagttatgtaattaaactgtctgttttgagaaaattgtagattcacacatactagctgtaagaaatgatgcggataaatccagcgtaccagctttccccacggagacgtcttgcagcgtcacagccaggatgaggcattgacccaggcgaagtccagagcacctgtgcgctacagggccccttgcactgtgctgtcacagacacgcccacttccagatgccatctaggaccccctccaaaaagcagaggcattcttaaaaacacacatctgcacatgttcctcttcatttgaatctgtcagtggcttctcagtgcctttcaaatgaaatctaaagtccttacaagccttgcagcaggaacctctccatcccacttcccctcacactctcagcttcatctctgctaggctctgttcagccaggcagcctttcacagtccctctcctcctgccctgccaggaaggtcccctgcccccaactcttccccacatgtggcggggccccgcttgtccttagaagcccagctgaactgcttcctgaaggaacccctccagaacctctcagaccaggtcaggtttctgcactcttagatcatccccatggcataatcacagttgtgatgttgtgatgattcagtgaatgtctgtctccccactggatggtaagcttcctgagggcaggaacagcattggttccagtcaatgctatgtcccaggactgttcgtttttgcacatactaatcctaaaaggacgatgacaacagcaaccacttacatgacctagatgctcttctgggtgttgtgcaaatattaacaatttaatccttgcaacaatccacgagggaggcattcttctactcccacttaacagacaaggacagtgaagctagtaaagagaagtcatttgcccaaggggaccccactactgttggcagagctgggtgcaaacgcaggcttgtgaagccaggacccatgcattcaaagaccatgccaggtgcccccactgcacacctcatccccacataccagtgagggggagagaaatgctcctgcactgcctctgattaactgctttcctagaagtcacacatataaaagggatttaattctagtgggattgaatctcaatagtttccttattaggttgatttctgttaatagtttaagtactggatatacatgaattagaaaatctagattattagcaaatgcaaactataaagtattttataaatgttatcttgtttgtcaggggatgagtgagatattcattatacaaaaagtagtgtggattttgaggtagaaggtttactaaggatcataccgtagtatgaaatagccacaaacattcagtgaaaccaaacacccccgcttaacctcaaactaacactaaataataaggaatagacttgggggcagtgcaagtgtatttctaatggtgaaaaccattccccagtgaaaactaatgtaccatctagttaataagagctcctctgacccacgcacatcaatacttacatcccaatggtgatgtgacattttgggttttgtatttcttttgcaaattgagctagcatttttgatgagtggcagggctctgctacccaacctttggacagtttccaagcataaaatcacaattccagataattctgtcacaaagatctgggtctcattaggaaggagaggaagctgggagatgatccagtccaacctcccccaaaccaaacatcacggccttctcagttgtttcaccaaccatctaaatgttttagtaattctaaaaattgatgcgctttttccacgaaaggaagtgttaccacattttccaagtgggaggcatctatatccttactccttcatcctctccttcccaccccctcaccccccaccacccacacaacatctgcaattcttaaactaaagcacaaattgttacaaaagttaattgcactttcaaaggaatgcttgtatagaaactttctcggcttcaaggaaaaataatacgctttgaatggctgttcaacagcatagaaattagctgagtagaaggcactcatatagccattaggaccaatcctttctgccgccaacaccccccttataaagacttgacagtgggccagaataaacaacttcaggatgaattcagttgagacacaaagtacacacttccagtttttcccttctctggttactggcctcaataaccaggcagtcaacttaaaaagaaaaacaaaagcttgcttcagattacagattgcagacttcttataatatgtccatttcaccaggccccgctctcagccccgggaaaggccactggaaaccacctcacatggtagggccttgcaggagccagtaataaccttatctccgtcaacatgttctgtcagattgaatggggcagccagagaagccagagttggcacaggaaccaaaacaaaggcttcccatcctcctggagtgagcggttgagcctggattggtgcttagacctataatgggtgcaagcagcgttcattcatagtggctttctagacccagggacttggccccagccctgctgctccactcctcttcttgcttcattaccacgagtctcctagaccaccgaacgatgcctgcatttgaaagacacttctgctgatcaaagcagctgatgtgtccctttgcggttcatttctaattgtccccaaggaggagaaattcaaatagtttattactgagagttaaagaaatccactgaaatattctttggtctaaaattactgtcatggcggagcagcttcaccttagtcattgcccttaaatatgaaagctatttaagaaagtttgcccttaaatatgaaagctattttaaaaagtttaatgaaagaagagaatcacaaaacattttcaaaaagcaaaagaaaacctaagagaaaagttgaaagtaggaattttttaaagaatatacgacgtgtgttctgtgactcacccctgcaagttatttgtgtgtattcccttgcatagtaattaataatgaagcaaagcatggcaatgatatcttttcttgtctagtattctagaagactccatgtttttggaaaatatcactctagttagatctcaaatatattcaatcagaaaatgggttttctacaagattctatatctgtagtcaatagcaaatataattctattaagctagtaggatgtgataggaaactaaaacctaggggagaccaaagcaaggaaaaatacttcctcatccaaacttgagagcaatttaccgtcaggcctactattaatagatggaatacagattccattttcattactcaactgccatattcattattacactgtacagaaaagggaatcacatctgttgaaaacttatatatgatgttcatgcatgcattccagtaattcaacaatttttatttatctttttattgcttgctaatttttcaaaataataagctaaagaaaacaaaatgtttgtgctgttctcagatgacatgttatctctttaaaggacaaaatgtgctgtgaaataatagaatgctttcagcactcaagtgtgagtgagtgctcatacatgagagaaagccgtggggactacagaagccaagaagcagatctagctggggaggcctttgcagaggatgtagttgtgtggagaggccacacacgtggaattcccaggagggctgtggaggcggggaatctgcaggaaagcactggggtgagaaacgtgatgagaaacaattattgtcttaaaatatctgcagggctgtaaggtagagaagcaatacgttgcatctgtgttaagtcaaacaaaattatcaagggactggtttcagcttaacataaggaacaattatgtgatagggttgtcaataacaagagtagactgcttcttcacacactcctagtcactcagaatggtccaggaggagtggacaaccatttggtagagtatgggaaggcaggggccctgggtgggagtggtgagggtagggagtgagtatcccaatctagaagtaaattgtgcccagcacggagctgcaacactgccctgcacacaaacacacacaaataacaatccccagcccctgcatttccctctccggtttcaggaccttgtatcttacttcaattcctttatttagctgatgatgaaataggaagagcttagcactaagaaaatccttttggagtttggccttgggggaaaatgaatcactccaaccaggtctgtcttctagaaagtataggatgaaagggctcctcatcacatacttcctgacctcctgctaggcctttccctaaaacaggggctggcaaagcacaacctgtgggtcacgcctagcctgccacctgtttttgcaaataaagttttattggagcatgactatatgtatttgcttacagtctgtggctgcgttcacactatcccagcagagttgaataattgggacagggaccatatgatgggtgaagctgaaaacatttactctctggctgtattcagaggaggtttactgagcccttctctgagacatggcaagcgctgcttcaggctcatgcttcactagattcaggcctggggcagtaaagagccagctcaggatagcactcccgactcactcattttttcaggcaggggagccatctaatgtcaagtgcctacgtgcaggaactggtctgttaattagcagctctcctcatggaagggataatatattctagaaacaggagtgcggccctattgcaagaatgtcctgagccaaaattaagattcttctatggcagaaacttggctggggcttctcctgagttaacttggtagttgttagtgatttttgagtcagtttttccttgtcaacgaccccaggaatgagtttgggattacagggtagccagggaaagggaaagcttcacgcccgcccccgggacaaggtctgtcttcacactgctacatcccttcacccactttaaaatgaaacttaaaaggaggatttcagttgagtaggaagtgagaagagggctcattttaaaacaagcgttaaatgaaaacccacacacactcagagcacacaaatccaaccacgcttacaaaaccatcacagagggtcaggcgaggcccttttctaaatgaaaaagaacaggggtggagactgttctgagagcatgctgggttccctgaagggaattctcagctgtatgtgccccgcacaggatccctgctagacacaaggccagctgccttcctttcaagccgcagacgcatccctgtgtccaggcgggctggtcagctgcggtcagcaccagcttccccgctccatggtgaggtcatcacaacatgtgagcaggagggcaggccggcaacctctgagtgcttagagaaagggacgggattcctcctgtgcaacccctctagtctcactcagactcaagtctgactaaggggccaggtgctttgaccagggactctcccctctcacttccctcccaggagtcacaggtacatgagtccttgttttacaaatgaagaaaacagacccaacatgattaagatgttgccttcataggggtggcaccaggattccaaaccatggactccactgagcccagtgcccactgacatgtgccagtaacagtgcagctgcctgtggttctgtcgactaaactgccggcagaggctggctttccaccttctttttttttttttcactcttcaaacactttatgacatgaacataaactactggctgcatcgttctgctgacaacatgacatgtttctataacttgaaaaaagcaagcagtggactgctcattggtaaaattgagtcagtaatcttttaggaaggttatttttcttccttttactgcttctcatctgttccccgcagtaaagaggacaagatgacgacgactcagggaacacctccagcctgaagcagcaccatgcgagcttagaccttagggtcggcttagaaaccacaggcggggcggcttgggcccctcggacactccctctcgaagctgcttctccccaagctaccccaaaggcactgagcgccctctgccccccagcaattcaattcactggctgtcctgctcctgtcagtactgagagttgcatgtttgaccctcgggggaaaagtccagaggccctggggtgtccagcatgctctgaggtccctgctgctgaccccttgcgctgtcagcattcagagacattcacacagcacagcctcccaggctaacagctgtcatggaacagtggagcagctagacgtggccattctgtggcccagtgctgcagaggtcaaagggacaagcgcagggagcatctttgctttcagaaaaaaaaaaaaaaaaaagaagcacactggtgcactgacctgctcctggtgtctttgtgattgctcttttctttcgatttttggttgtctttttttttttgaaagaggggcttttatgcttttttcctaatgttcatgggtaaaccaatgtaaatgtgtgtatgtttatagagatggctttaaatcgcaattctgcagtagagattgattttttaaaaaacatgggtaaaaattgaagaaaaattttaaaagaacatttaaaccatcttgggctaggggtggatatgcaccaccccacggaagccaaacaaaatctctctgcagataaacatttgcaaaaagaatttccaatcccaatttttgagtcagagatcttttatttccttgcaaattacatatctgtttcaggatttttgactataagaagaatgaatgaagatgtgtttcttacagataactatgaacaaaccaggaaggataataacttgtatcccccaattcgaatccagaggatgggaaggcataaaaaaaagaaatggaagaaactttatttttagtggtaaatggtgggactatgtattttacgtatggtgaagtcaccaagcccaacacttggcacttgtaggcaaggtagtcttctaatctgaatgtgaagtattatgttttcatttgcttggtaatgaggaatattggtgctttcgtcccagttctcgagctgactgacttctctttctgacgtgtgttcctttagcacacctctacactgcatggctctgagatgtcctgtgactgtttcatgtgtaaagttgcctccccaaaggactcacatattccttcagggcagtgagtacttctgattcatccttagcagctaccttcgcgctactttactagatatgttgtagttgaattaatgaacaaaagaacaagcaactttggtgcctggtgtgcatctcagagcagggtggagtgagcctggccaaagggtcatcgtgcaacctctgtggctgactccatctggccacggagcttctcagccatgcttggtattcacatgacttctagggcgacagctcaaccagcaaataaacagcttcatatgggaaatattactcagcctttgtcatcaaggagtgagtcacgggcctgaactgaatagaagatagaggagaaaaggtgtgtggactgggtgagacagcgcccagcgaggtgaactcccggcagccctgcctgtctttacctgcacatcaccttgctagggtgccttcggttgtgagggcctgtctaggaagagaagagttgcaccctggcaggcagcactgagctgtctcatgcaaagctgaggaagaaagagtgagctgcccagtgagcctgctggggtggtggaggctgggctgggctgtgcagtctgcagcccccagcagcccttggcacctttctactgcctggtgctcaccagctctccagtaacaaagagggacgtgaagtcagaggggaagggaggtagcacagggcagtcttgactttgaacaaagagctggcttcctgaagtcagctggccgggttttgaagccgattttccagcagtgatctttgatgccaaccccatttaggaattctgtatctccccctaccttctaccagatgtctctgagctcacctttggtgataatcatgcaatctccgtcatccccacgtccacactgccccattctgtcccaccccgggttctgtggtgctgtcggctccccagcgagccaggaagggagaggccagctctgctggggctcctgccgccctggctctgcactgcccttctctggcaggtctgaggcgccactggaggagccacacggccctgaagcagcaaggcagatgccctggacacagtggaggcacagagtgcaagcaccggcctggcccacagacttttggaggggaagtggtattattcagttcaaaagtatgcctgtgtgtaaagagagagcccctgaacatgagtaagcaaaagtctcagcgcagagattagacaagtagaatgctggcccgagaggaggcgtttactcaccctctgtctaggaaggaaagccaggcccagcacgctcactgctatctatcctctcacacagagggattttgaatcgaagccagcatcctgtcctttctccaatgtcccctgctcaggagtcaggactcagcaaggcccaccccagccacacacagatacagttccaggactcagaactcagcgaggcccaccccagccacatgcaggtccagttccaggattcaggacacagtgaggcccacccgagccacatccaggtccagttccaggactcaggattcagtgaggcccaccccagccacacacaggtccagttccaggactcaggactcagcgaggcccaccccagccacatgcaggtccagttccaggattcaggacacagtgaggcccaccccagccatatccaggttcagttccaggtaaatcatctgccttcctccgtccaaaagccttgtttcctgtgtgtccttgtgtttaaaatggaaacgttatgagaaactgcctgccagggcaaagggtgctgcccggcacacagtagggactcaaaatgaaactattgtattgaatacataacagatcaacgggtattgctttctgaaatcttttttagcccaattttgtttcttatagtccaataacaggtcaaattcatttctgatttactagccattcagttgcccataaaaaatggaaagtgatttaagattattagtttaaaaaccaatgaaggtaaaacagttatcattgaaggcacataggcagaaatagattgcaatagttgctgccatgtgaagcctcagtgtcatgctccatatttagagagatctatgatttctgaggccctttcatgtccatgatctcagtactgctcacaactgccctgtgaaattcgccgagctggccccatgtcaatcagagtacactgagcactgagacccagcatgttgagataactggctagagatcatcccataatggtaccatcacaatcttcacactgtagaagtttgatgatgtcactggaagcatattccacagtcccttgtgaactggccttcctgtgatcagaagcatcagtgaactcccaagagggtgggaactcccaagaggtattctcactctacttagtgtatattttacaaatcacaagcttggctttggattcttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaacgttttgattaaacccacaatgaaaatttaaataagtgtatttactttggtttaaccacttatttcattatgactcacaactataggttttctagtttccattattacaaactattgtgtggtttaaatcaatttcatagactagtctagttctatagtcacaatttataaaatttttttatgtggtaaattgagtgtcttcatagatgtacatgattatttctcaatttttaaggaatgtattttttaagatagccttctttagccttctttaacactgatttttgtaaattttttacagatttttttaaatttttggtaattttttagcataaagtaatacatggtcactatggaaaacataaaaacacaaaaactatgaagagtaaataagaaaaacacccagaaatttaccattcagaaaaggtcattgttaacaacacggtgtatcttcctcctgtcatgcttccgtgcatttgagcacatttgagatgtgtatacatgttcactttgagattttagtatagcaaaagaaatgaccagtcctgattcaatgaaacctctggcaaactcgctatattttccttacatatttttaagttcatcctataaatgaactatccattcatcttatttgagattttcttaaatctttcagcaagaaagcgggaaaaaaatcctcctctggcctttaaagcctaattaaatatatgactaagctagaaatattttataatgaccaaccagaaagtggcaaggactgtcactcttcccatacagcccacctcctcctctatctccctcaggcacacggaaacgagaaaggcagagaaacccaggacaagtcatccaagactttggtcacatggccatccattgctttcacaacaaaaatataaatccaacatgtgtgtgtgcatttcataccagtaggtccaataagctatctatatatacacatatgtgtacacacacacacacacatccttacagacactccccagcttactacagtttgacttaagattttttgactttacgatggtgtgaaagcaatgcacattcaatggaaaccatacttctaatgttgaattttttatcttttcttgggttagttgatgtctgatatgttactttcttgcgatgccaggcaatggctgggagccagagctcccagtcagccatgcaatcaagaggctaaacagctgatactatacagtggactgtgtcaccagcattttggggatattgtgttttgtgtttttgaatcctatcatgtctacaaaatgccattttcgactgctattttcaatttagggtgggtttatcaggacataaccctatggaaagttgaggaccatctgtatatctggtagggaaagatggataacaaattcataggcaaataataatttcatgattattattaagttattcctacttaataataagtagtgatcactgccagggagcagagaatgcaggataatgtgacagatgtaatggtgggtacttaagctaatgtagttgcagaacaggcttttctagagggtaggcctttaagcgtacctcgaagatgcaaaggaagcaaagatgcgaagatctgggctggggatggaagcagagacaacttggaggccaaggggagagactgacaacagcccagctcatacctcagcagcctttaatgcatagctaagaaaacaacaaattaaaacaattatagtttacttagacgattctaagtgtctaagtggatttgggcaaatctggagaaacttgttctaatactgtgtcttaataagtaatatagatttgcccaggcttgtgggcagagtggtatacaccccataatagcagaggaaggccacagggcctaccctacaaaaccagaggcatttaaaaacttaaaggaggcagattgcttttattttcagttaaaataaagtgaggagtttctcaagaaaaataataacgagaccaccggcccgccctagatgtccaacaagaatgcacagataacttcgtatatccactttcctgaacctgcccctgacagccaagtggagcacaacaacagagatgaacctcaaaactactgtgctgtgacataaggcttgctcaagaggacagtgtggtgtgagtccatctatgttctaaagcaagcaaagctattctgtagtgaaaatggatcaggacagcagttgcctctggtgtatgggggcagggatcgactgggaggggcatgagggatgacagttagggtttcgatcatgacaggaattcagattactccagcatgtgcatttgttaaagctcatcaaatgctacacttaagattaatcctctcacagtttgtggatgttaccttaaaaacaacaatgatgactgcaaactaatattgaactctggttagtgatataccaatgtgaagtatagtgatatctctactttactttaaaatgcatccaaaggcagactagaggaccatatctgacagacagaaaaatagatatgtgataaggtgaatgtagtaaaatgctaacataaggatgtttgcggtacaattctttcagcttttctatacatttataaatcataataaaattttaggacaaaaagttagtgctttgaagtcctaagtcatagggcctgctgctcttgatgcagtagaatttgtcttcagatttgcaaagggtaaggcaaaccactagcattttgtatggaacttgatgcaaatacttttaattgtctggttttcaaatgtatagacttaaagtaatatcaactctttctttgaatcaactactgaaatacctagtcttaaataaatatttttatgtaatccttaaagtactatgtattcatttttctttcttctttcttttctggtttgataaatattctataaagtaactgtgtttaatggccaacatttgagtaagtccatatgcagatccaaacatctcagtttagacaataacttaagacaatatagagtggctgacatcccctaacgtgggtccagatgcatgttatgttatgtttctgttgcattctcaatagttaactttaataaaagaaagtcaaaagcttatatattttttcaatcttcaaaacatttctgggaggttgtcttagttaattttatgttgctatacccatatcacagactgggtaatttataaagaaaataaatgtatttggctcatggttctggtggctgggaagtccaagagcatggcattggcatctgcttggcagctggtgagggccttcatgctgtgtcaatctatggtggaaggtcaagagagcatgcatgtgaggtggtggggaagagaaaaagcgggtttaactcatccttttatcagggactcactcccgtgatagctaacccattcttacatgaatggcattaatccattccttagggcacagctctcatgacctaattataatacctcttaaagtttccacctctcaacactgttgcattggtgattaagtttccaataaacgcactttggaaaacacattcaaaccacagcagagatcaacgttattgtcaccattttcatatttgaggaaagcatggcacagagagcttggagaagtacttcaaggtcacccaatgaggaagtggctaaacaaaaaccttatcttaaattaattaaaaacctcttgctctttgcagttttgtcttaaatctacctaatttgtgactgtaatttttaagtaatttactcatataagtggtctcacattaaattttctcattgctttatatttctaacatgagatatttggtataaggatggaaccaagatcataccttgttttaattagaaaacctagaccaagtcattgtgatcctcatcctagatttcagttaaatgctgctgtctccttttgggtatgtgacaggggaaagcctcagaagaaacaaccttatgtgttttcttttgatactttagtaattaacccaggatagtattcaagattgacatgccttatattgaatcaaatagcatatcaactgccttcttattctcaagtatagacatgttgggtaattgggcatttaagtttctttgcaattttttccattattaacaaaattaatgagcaacattctgcataaggtctgtttcctcagaatacgtttcccaaagtggaatcatcatgacgtagaatttaagcatacttacttgtttaaacaaattgtccagttgcttcccaaaatgttttgtgaattaagatttacatcaagaatatgtaatgttgttactgtctcccaaatacaggatctttttctgaatataaaagttatacatgctaattgtagacaatgaagggtcattatcctcatagataatgaagtgcttctaatacttgtgcttttattcatttattcaaaaagtgctaaataagccctgaaggggcttttggggggtcatttggggcttatttagcactttttgaataaataaataaaagcacaagtacagtttttttaaaatactgttttctataatagattaatcttaaatggcatgttttcctttattttactgacaaaagttacttactctgtgattgaataataaaaattctttggttcagctgagagaaacttgcaagctgacgtccttgattatttaaaatgaaagcagctgcctgttttcatctctctgcatcctgaggaaactcttctgcaacgtgttccagccctaggttctagctgaccctgttcatctgtttggcacgaggggcccaactaacacttgcggctacctggacgacagccaatctagttggaatgagagttagaggccatagtctgtcagctgggaaagcagcttttattccaaggtgtgccaaccgaaaggccacatgttattgtcacaacctggtacctacatcagtgctgacatctttaagaaccttagaattgggaaatcagtttagccctatctgcatgtgtagccgacaaccacacaattgttccaacttgaggttgcattcagagcaacctcatttcccccatactcctgaggaaaagcagaccagagacgctgggtcaatccagagttatggttggaaaaatgatggaataattctgcccctggtgataggagagagggactccatcttgtcaactgtcatggttcccatgtgaaagctatcattatcactgaaattgaatgagaacacagaagggaagaacagggaaatccccacagagttaaagaggatgtgaagattgcttcatgtttaatgtttgtgtaagtgctttgggttggttatgtgctgtctgaacatgtgctcatttccatggctcattgagagggcagacagtccaatgatactctttagaatcattcccatggggaaggaacaaagaagcctgtaaaatagaaatgcacatgtaaaaagcattgaagaaagtgccagtgtattgattttggccatggtttgtgctctaccacctggttactgtgattgcagaagtgcctttgcagatgaggaagaacctggccaaggctcaatccaacatccaaagccagaggccatatttcttcactcttaagataatttgggttcaaattatagtccctttacacactctctgcctcaaaaggcccaagactctcttttgttatgcttgcctaaacatgcctttcaaagaactagttctgtaaatacaactttattataaacctctcctttgcttttaaaaatggatcaccacgtccatttctatggtccaactttgtcccttaatttaaaattttttcttggattaagtttgatgccttgaaacattaggaactcaagcatacaagattgtatgctggtggtgagggaagtaactgtgcctccgcctgtgctgggtggatcaacatggagtgtggacgagcatagggatgtgtgggtttctcactagctgagagtgtttttaaatgttgtattttgatgtttgttattttctgaatattctacagttagacctttgatttattctttgatgcattcatttgaataatatttttaatctccagccagttaggtttttaatttacacttttgtccctgattttaggtgtagtgttgtgtacactactgcccagtgtatgttatgtttgtaaacattcattgcacgcacaacaatgtgactcacaatatttttgagaagtaaaaagttcattatatagttattaactcaaccctacagttatattcgtgaaataccttgtgaaatttattttttgcctactggagctcttacaggttaatcctgtcttcaagattttcatagaattttcatctaccacccaccactttaaatttcaacatttttttattttggcattttaatgcaattcaatgcattatagggacaagctatctcttattatgaattgcaccttatataaacttaaagatcttttatcacaaatttctttgctgtgtcctttagtgagaatttgtattatcagtcactaaagctcactaagttagtaagctttgcgcccagatgacctgggcaggaatgggtgagtctctgtgtggagagagtgaagaaactgctacccttaatacctggaccttgagggattgttttattttagtttttctgcatttctcagtatttcatgtgatatctgtctttttcttccagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaaggttggtgactttgattttcctacacaaataaaattggagaaaatctaagtggagaaaggcctgggcagaattccacttgaagtgtgtttatttttgctatggcaatgacaagtcttacagagctacaaacgagagttttatgagaaagccattttaccagctaatgtcaagtaataactagaaaaggatatcaaatagaaacaggctaatctggagttccatgtcatcatagacactgacgtttatccctgaccattacctcagtcatgatgtgctgccatactcgctcttaaaaactttttttaaaagccctgctttgcaccatttgcctattcccttagtgtaaatactcctactatagctgatttcaaggtaccaagtttcactcagctggtcacagaattcttatttcacgataggcgctaatgaccccataggagccagctctgaaggcttcagagtttcactgaattttggatggggtttacttagccttcttctgtttttcttttacctttcctttttaaataagaaataatgcaagacagatacaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggtgagaggctgggatgccaaggctgggggttcataaatgcagacagcagttccgatggctcccagcgagcttgtcactcaattccacctcggagaaggcttttatttttacccagtacacgtgcactgagtgccggctgtgtgtaagatactgcaggggaagttactgagaagatggcagatactggaatgggaagatttaagcggggtaccagtgtttacatggacatgaaaaaatactgagagatagtaagaaatcgtaaagattctgagtaaaagagagtatgaccaaacaagctgagcaggaatcgtgaatctatgtgtgtaggcagtgaataaactgccagtcttattacctggacctcaaggataaaagacatacagtaaaaatcaacccacattgaggacagtttcgagagtcgcgctgctacacagaaagccctgtgtaagttaaggatagagaatgaggtgttctagaactttgaatttttgtgagcaggactcgtgaggttcctgtgagaggaaacaatgaaggatgatagaaaagaagggaaattgattttaaaaaactggagatagcagtgattgtgcctcactgtgcagtgggtttggggccaggaatgttaaattggtaacttcatttaacgcccacaacctttcttcaaagtaggcactgtacagatgccccttgacttatgatggcatcctatctggctggaccccgccgagggtgaaggcgtcattaggtcggatttcagggctaattgaatgtatattgccttcacaccatggcaaagtcgaaaatctgtgttaaatcatgctaagccggggactggctgtgctctgccatcgtacaaataaataaatggaagtcaagtaactcccttgagggccccagctagtgaatggagaggccagctatggccaccactctctgccccagggcgctcaacgcccctcctgtgccatgcagttctgacagggaggcagtgctggtaggaaaggggtgtgatgaaaggggtgcccagcagagggagtcatatccggagtgacaggagcccaacaggggtgcagcgctggaacccaagccagcacctctggtcatggctcctcagttcaccgcctataaaattgtgtggttcccccacaccccttgctgctcagagcagccgcgcacatgcttgtgctgtgcgtgcctcctgtgagatggcctggtacaccggttcctacagtgcgcctcacacgctgtctcggagggaggcagcctgtgcgggtgcctggacctccgagccagaccctctgggttcctgcctggccccgtccctcagcagccagatggctcgggagcacattctccaatccctccgtgtctctgtttcgtcatcttcaaaaatgtggatggcatagctgctaaaaaatggtgacatacttcctaggtggtgcagaaaattaagtgactgtaggaacaggcctcagcagctccttccacttccttggtatgattgttttttaaaccaaggctgggattgtatagatgcagattagttaatgtgataccattaatagctaacctagtgcctgctgcagggtgagcctcccctaagccaccgggaagcggctcctgcagcctccctcacgtgtgctggccctcctctggcagtcattgcctgtggtgtgctgaaggcccagctctgactgtgcctctgtgctctcctcgccccgccccctgctctctctcaggtctttggtctgttgtccgagctgccacagcagcctggacatccctgttggtgtttccagccctgtcctctcctgagttccatccacctgtgcatggctttttcatgagtgttttcacggatggttctgctgtcatctccaacctgataaacaaagcaccacgattcagcccttatgaccccaagcttccttcctcagttccttgcttctgtgcatccactgaagaagcctgttccactgtttccctgcactgggtctcctgtctgcaggaagccttcagccctcacttccacactcctctaagatgtgtgcctgtgcccttctggggaagctcattttcctagcagcctccaggatcttcaggggtgaatccctcctttcccacgttggtactctgtacacacaacatgcccattccctgcctggggagctgggcattgcttcatgaatcagaggtcaattttttctctattaaagtcacagatgctcattgcaccattgtgagaatgaatgaagatagtgcttataaatcagccagcaaggtacccagcctcactgtgtcagggtctccctgggcatgaggtggttagagtgtgtgacatgtctgtccccaagcctgtcagctcccagatcgaagccagtggatctcattcatcctcgcagcgcccacagcacttgcacagggttttgtacacataagtcattctgtcaatgttcatgtttaatgtcatcagtggaacactcccactttgtaaagacttgaatgtgttcatccctgacttttccacatcttgttagttcttctttggaaacagctgtacagtttcaccatcctgtgcatccctggagtctacctgtctctgtcatacattcagattcttcttgtttcgtgtcactctcatatccttttctctaatgaaaagctccgcctgggcatgcaaggtggagccctggatgccagcccctcacctggcatccagggctgtagcactcaggaactgcctccctgccctgcctaccccctacatcatgcgaccattccagtccagccaatcagccccttgggacccagcttaccacatgcatatcatttatgctgtgaccactgactaaaccattctcttccttcctccccatatttctaaatttctaatcattgctcaaagcccaattcagagaaaaccctagctcctccatggcaccatcattaacaattttatctggccgccccccgggaagttcactgggctaattgcgggactcttgttcgcaccatggcatctctttagcagaacataaatgcgaagagcacatgcatccttcatgggaatttaaaggagctggaaagagtgctcaccgcagttccattctcccgcagaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagtgcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaacaaaaaaaaaaaaaaaatagagctgacgtgaatcttcaaaatcatcaactacagggctttggatttttgtgtatttgttttattttcattttatggatggattgtgatgaaatgcccgtaatacaagattttccatcttaaccattgtaagttacaatgtcagtggcattatacatccacatgggtgtgtggccatcaccaccgtccacacacagaactcttttatcttgcaaagctgaaactctacccattagacagtaactctctgctctcccttccttcccagcctctggccctggcaggcaacagtccacttgatgtctctatgaatttgactgctctggggctctcatacaggtggaatcatgtagtatctgtccttttgtgtctggcttatttcacctagcaaaatgtcccgaaggtttatccatgctgtagcacgtgttaagaatgtccttcctcttcatggctgaataatattccattgtatgttgacactacattttgtttgtccattcacctatctacagacactggggttgcttccatcttttgactgtttgaataatgctgctgtgaacatgggtattgaggctctttgttttatagacatattattccaccagatacccatcctgacacctactatgtttgcaagaaactgaaagctttattttacattgcaaaatttcatattatgagatcaaggttagcatttcctcagctgtctggtggacaatggggaggttaaactgtgcacattttatttttttttaatgaacctggaacggttatggggccagtgtttgccatggatcaggtcaggcagcccacaatggcaggtctccatgttctgtacaacaactgtgggaaagacccacagagaaagtgctggaaaggggaatgatgggtaggttcatgcagtaaaaagattcaaatactacagggcattgaactataggccaatatagcattgctttaagaataaacaaaaaataagacagtaagaataagcctagcaaaatcaaaagtctataaagaactgacatttcaagccaataagagaataattccttattcaataaattgtctggaatgacttaactattaggggtgaaaatatcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatgagatgatttaagtgttttatggacaagatgtctaaaactcagaaaaatttcacagtgtgcctagcttttatgtttatgttgaagttgggcattagaagttagaatgaatgggtttacttcagagaaaattaaatccatcacccactccttgtactatgaattccaaatacatattaaatacatataataaaatatttaatatatatgtaagtgccagaaggaaacataaatatgaatattttgtaatatcaagttgaagaaaagccaaaatctgacatcataaaagaaaactttcaagtaaaatatgttaatggctaccaggaaaatattgtgcaatgtctgattgccatgaagagggttaatatccttgctatatcactctgtgaagtcatctttaaaagactaagaaaaagatgaatctcttaataaaaacctggcccagaacatgagcagcctctctctctcactctcactgtctctctttctgtcacacacacacacgcacacatacacacacacacacaaatatggccaagaaataaagtaaaatgttatttctaatgtaataagtaggtcaaaatagaaaaagaaagcatcacaccttcctttgcaaagtatttgggttccttttgcttttaaacacctgggtcagctggggtgtcgagaaacagaaattctcacgttctgcttgtgggcatatatgttaataaaaccaagcttggcaatatgcctgcaatatgtatctaaagcttcaaagtatgtatagctttgaccaatcaatatcacatttcggaataagagaaaaagaaataatgaaagtgaaaatcataagagatgtagaaacatattcttatacaagaattccttgcagccttatttataataaattttgtgaacaaattatatatctaaaaataagagattggttgaaaaaattatgcagcagccatgctattgataatcatgttagatagaagcatatttaaaggcatggaaaaattgccatgttttatatgggtttttaaggttataacacaatgtatagtgggattccaattcctgtatatacatagacttatatgtctatattgattaactctggatgagtctcatgtcttctttttgctttcttctattatccatattttatacgatgtgcctgcatttcttttttgtaacagatggtcaatactagaatcataaacagatcttgtttgtttattggcaaatgtttcccgttagaaaaagatgcatttttcttttaaatatttttattttatacaatgattacaagcttataatagaaatttgaaaattatatgtgagtacagggtaaaaagttgaaagaatgggattgcacgctacagatctagctgcttttagcacgcctgcgtaggaccttgctttctctagacctctgttgcagtctctctgcctacctcctcacaacgtccatcccccgcggtcactgtcgtgatgccagcctccccggccttcatgtctctaaggagcaccagcgcggcaattagcgccctttgccttggtggtattctggcttcacagtcacatgggagatcaatcgtcagcttttctgtttgaaatctaaattcttcctgactgcaggggacctcgggacccatgaacacctctagtttactatgtcttcacagtaaaagatatctgcatgactggactctttaacaaatttggtggttaacctactctttctatatagatatagcacttcgaccttcagacttctcaatactgataaaaagaaaacacgacagatgacaggaaaacctttgcagctataatttgtaatcggccaattataaaaactgcaaaaattgaccagatagctaaggttttacacagtcatgaaagtgatctgcactgttaacatttcaccctctgtgcaccattctgtgcttctctctggtttggagtctagaaggttttatttacaggctatgacttaacaatcccagaacggctgacacatgcagtcactcaagactggacacagcaaggaagtagtgggtccatgccaaaggctcagccagacgagacactctagctgtggcaggagatgccagggaatgctccaagcctaagcagattgtaaacaaggaacctcaaattcatgaaaaattcttgcttatgtggcccatgtcagtaattactctctgcctcagtttccgcagctgacatgtaaataaaagcagttcatggttcatcttcttttcttatcggggtctcaagtgattctacaaaccagccagccaaacaatcagagaataagttgaaaagattgtcttcatttattgaatgtgcttaactcaggcccgggaaagggcgtcatcagtttctcatcatttcactgagatatgcatctattacttttacatttcaggccaaaagtgtgatccaagctgtcccaatgggagctgctggggtgcaggagaggagaactgccagaaacgtaagtcagtgaacagcctcagacccatgtgtgaccgcccctctcttccttcacttgcttaggtgattggatttgttttccctctgaagactccaaagagttactttattacagggtcagatgtgaaccagtaggtgaaggacagtcttgcaaatctcaccgcatgcagttaatccagggtgggctattttgggagcttcagcctatcacaaataagtgaacatcagcaggggctgggcgcggtggctcacccctataatcccagcactttgggaggcggaggcggtcggatcacgaggtcaggagatcgagccattctggttaacacagtgaaacctcgtctctactaaaaatacaaaaaattagccgggcgtggtggcgggcgcctgtagtcccagctactcgggaggctgaggcaggagaatggcatgaacctgggaggcggagcttgcagtgagccgagattgtgccactgcattccagcctgggcgacagagcgagactccgtctcaaaacaacaacaacaacaacaacaacaataagtgaacatcagcaagtaccccagccctgtcctctgaacacagcacactttcccaggaatggaagacttgctcctgttgacagcagtcaccagacttcttgtttcctctccctccctggctttctttggtacccacctacacagaagcctgagcacgggttctcatggggacttttccatgtggaccctgctttacgatggagagggccattctcctaggtatggttgtctggctcagcctctcagtggccaaggaacctggggacatgagctcaaaaacggacactatgtccttaagctgaattgtgggggggctgttaggcccttctaaacactacttcccagcaggtatttttgttctttgtatgtgctttctgcattgcccaagatgcatctaattatttagcaggtctcaaagtctagacttgatctcatgagttctcttaagtgattaaaaataaatcaggagaaaaaagaggcaatcagaaaagggcatggtttgacttagtttgaatgtggtttcgttggaagcaaatgtgtcttcactttttcatgaaaaagtctgcaagtgctctgcgacgtccctgggaaatgatcctaccctcactcttcagctcacagggaacctttgctctttttcagtgaccaaaatcatctgtgcccagcagtgctccgggcgctgccgtggcaagtcccccagtgactgctgccacaaccagtgtgctgcaggctgcacaggcccccgggagagcgactgcctggtaagatgcccctccagcagcctccctggagcaggctggggctgcacccgccccacccacaccaggacagaagacttcctgtgggggagctgtcaattagcatttgtcataacagacaggatattgccctctgcctggtgacaaagtatctttagtatcctgcctccaccactcactgagaccttgggaaaatgatgggactaccatgcctccatttccttacctgacaatgatgcataacaaagtctctcccagttgaatgcttaaatgatgagatgcctgtgatgtccgtcattaggacctgggcacagaacaagcactaaatactacatgcaagtatttgtcatgaatgtgccttgttgccagcagcacactctctttattgtttgacttcggctatacctctagagacttgacactgtgaggtccctaagagacccatggagagccacacaggtcttgctggctggggctgggttagggcctcctgacacggatccctcggctcctccaccactgctcaggcacctcctgagctgcaccctgccctcaaggggtcctgaagtactcactgtcgccccattgctccagaaagtgccagcagaagccttgctgccccagcgggctctgagcagcactggagggtacaggtcagaagcgtcttggaagtcctggagacgccaaggctggtggatgtgactcctggagtgggagctggtgtgacgaagcccttcctaagactaaatccagagcactctgtggtttcagagaagattcctaaattccagagtttggacccagacccaggaattgtgacttggttggcctgagctgtttctaatgtgagccccagggagaagactgtgcgtggggttggtcctaggaaaagccctcgctgtattgggtctggctcctttacacggcattgttctagcaaggctttctgccattcagcaatacattataaaatataccctcaattgtactttataagggaagcccaatgtcctttataagggaaattaaacataatttcattccatagtcaccgctataatgtgtgaactccatcatctatacgttagtaaagagacgtatttttatcataatccataaattatgataggtgggacagtgcacctaagaaaaaaatggactttttagagaagggtctttctgactctgcagagggcgccagctgggttttcccacactagtggaacactaggctgcaaagacagtaacttgggctttctgacgggagtcaacaccgtgctgcgcttcctccgtgtgtggcgctgagtgtacttacctcacttgcccagcgtgtcctctctcctccataggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttattttgttttgttttaatggtttgggtttgagttttgcttgtttgtacttacatttgtactggtggctccagggtttagggaaattgtgacataaaataattcctgacagagaaagcaaaactttgtctaatgaaagagttttagaagccactcttgatctctagaaggggagattaactgagaaaaaaaattgaaagaacaattatgagggggagattttaccctgccagatttgtgtacatgaaaaattttacattccgtatggaaaaaaaaaacacaaaataataagccattataaggtaaatgacaaacaaagctaaagaaaaatgtgccacagtgatgacacagatatatctttgagatagggcttaacagagctttaaaatccataggaaaacacttcgagcctgagataccaagagcagatggttcacagaagaatcatcaatgtcctataaatatttttgaggatcttcttggggaacttaaaacaggaacaggccaggcacagtggctcattggctcatgcctttaatcccagcactttgggagactgaaggggctggattgtctgaggtcaggagtttgggaccagcctggccaacagggtgaaacctcgtctctactaaaaatacaaaaattagccgggcgtggtggcgcacgcctgtaatcacagccgctcaggaggctgaggcaggagaattgctttaacccaggaggcggaggttgcagtgagctgagatcacaccactgcactccagcctgggtgacagagcaagactccatctcagacaaacaaaaaaggaagacatagagctcctaaaaataacacagaagtctgctattaatacaaatgaattactttaaaggtgagagcaggtggaggagagggctgaggtgcctgctgggacgcaaaacagctggcccctcaagggacccagtgtttcctgccatgatgaaacacctgtattgtccacattgcggcctagaatgttattaaactcttgaacgggattccttctctatttgcaacctttcattctttgtccttaaagtaaataaagccaaaggaggatggagcctttccatcacccctcaagaggacctggaccgcctgtgtgaggcccgagcacctggtgccaccgtcatcaccttcctttcatgctctcttccccaggtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttagggggtgagtcacaggttcagttgcttgtataaagaaaaacaaaatctgcctttttaactggtagagattggtgatcaataatcaccctgttgtttgtttcagtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaatggctgatgttttgatatttttcaaaagtgcagtttctcctgcaggcaaaaggggacacgttaagtccaggcttgggtcattcactgcggtgtaaacacgctttctccctcccgcccggccccagccagctgccttggtggcccataacccctgagggtagagggaggggacaggggtaggtgacaggcagcctgggcctcaggcttttgaaactggacgccagagccttgtggggccacgggcaagcctcgggtctatgactgccgcctgagctccgcttccttcctctctaaaatgggaagattagaccaaaataacaagactgttttaaggttggaatcaaataaggaaaatttgtaaagctccttgtatgtgataccagatccacaattggcagataatcgcagcaggagcctcttcggggtaatcagatacgcggcgcagcaggggtctcagggccacagccaggggggcggcgggagacatgcggaatcgcagcggaaggcgggaggcagctgtgaactctggctcggcctgcgtccgccctgcgcatgtacactcagagaagatgataatgaaaaagaaagcaaatccaattttcccacttactgttcatataatacagagtccctgagagtctagagtaatgtctcatacaaaaaagaaactcctacgtggtgtgtgtctgaagtctttcatctgccttacagggtttttgctgattcaggcttggcctgaaaacaggacggacctccatgcctttgagaacctagaaatcatacgcggcaggaccaagcaacagtaagttgaccacagccaaagcctggtagattacatttgcctttttagttggaaattaggcttaacaggagagttgctaagatagggcacagagctcctgcatctctcgccggcattcccaaatgctatctcacatgagcaggcacagggagcaagactgcacgaccactggcacaggctgtccgctaaaccacagacttctcagcgctcgccagtgcttctgcttctgtgtccactccagatcccacattgcacttagttgtcaaatcttttcagtccatttctaacctatattagctcctgtgtctttccttgtctttcacggccttgacacttacaaaacgtgtgggtcaggtactttgcacactgtctaaccatgtctgttcagctggtgttttctcaggatgcaattgaggttatgcacatcttatcacagggaccagagagactttttagcaccactcttcaagaatttccactttttcagctttgacagtggaatagacatgcaggtgctcacacacaagcatctttaatatggtaatggtaatcatcagtttagtggtgtggaggaggagatgggaatctcttagtgaaacccgccttggaagcagcctcgttatgagaactgctgcccctacttgactcttaaagcactagataatactgtgcaacattaaagagaataagagtgcgtgaaatatgcattgcctcccataaactcccttggctctgaatctctgatactaaatatgtggctaccgttgcttcccagaaaggcctttttgctctgaattctctggaatgctttctttgaccaagattcttataaaaataagagatttagagcaattttcttggatggctggtatgagccagttggcttagttgtagggatttaaacaagataagggttacttacttttcacatttaatgagaagtctggtgattccagctcctactgagacagggtggccacacgttccagggtgtgactcactgaggccccagacctgccctgcaaggaaaacctggctctgccctggtgtcctggcctccctgggcatatgtgggggagaattcctaatggtattggttacaggctcctatgcgagaccactcatctgtgtaggagaaaggaaaaagatgggggaaagaagagcagcagggagaggagaagcctctggatgatactctaaccccctgccatccaacacctgaacatcagtctcttcatccagtgctctcagctggcccagcccccagcctggggtcagatgagagcttcctgcaaatgcagatctctttcctgtggctccttctcaattacagacagctcctccacaaggtgcactctggccttgtgctccctccccaaaccagcccagccctcccagcctgcatcatcgtggtcctgtaggggctagaggttctcacacccatcgtggtctggcagaggctggtggttctcacacccatcgtggtccggcaggggcttagtggttcttatacccatcgtggttcaggaggggctagtggttctcacacccatcgtggtctggctggggctagtggttctcatgtccaccgcgtgctttcctgctcctccaggtggctgaggacatccccccttcggtctgaatgacttccatccagtcatctgatatacacattggaccacccaatagcatcctagtgtcatgttggatggtgaagaaaatgccacagttactgctttcagggcctcacaaccttgggcatagctttttggaggaaggccccacttcccaggcatccctcccagacctggtcagaggcccctgctctttgcttccatgttgcccacactcactgtgctcttcacaccggctcaaaatgatctgcttacggggttgtgtcaccaccagatcaagcgtcctggagaggaggaaacatatttaacctgcacagaatttgggacagagaacctctagtgtttgttcaataaatatatgaatggatagagggacaggttgggtggtggatagatggatgaacccacacctttgaagtgtatttggctgtttgagaggttagaatatgttctcaatttccaggcaaaatgaaaatggagaaaatataatgacattaaggcattttattcatcctccccatctgccactgggttaaagatactaaataaacaaggaactatcttttgcctggaggaactttaaaaacacctgcagttttcaaaaggtgcagtgtgtgcctcccacagcatgacctaccatcattggaaagcagtttgtagtcaatcaaaggtggtctggagaaacaaagttttcagggatacattgtttttataatttttcaccacatgatttttcttctctccaatgtagtggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcagtaagtcaccgctttctgttttgtttatggagttggttctaatgggtcctttatttgtatttagaatattgaagggctattcccatttaaattacttttttcagttccttaagaagcaaattaaaatcttaagattcctaattgtgaaattaccatgtgaattccattaaaactttttccagatcattaccattcaatgggatgaatttaccctgaggtttaggctaccaattatttgtaatgtaagtaactaaatttagtattagttatattaccttttagttgtaggtcactctctgctcatttcagcctgtaaagactacagctacacacatacacacacagaggaatggaatgagcactttacatcaacacttcctgttctggctctagagcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacaaaacataaataggaaagtaaaactgaaggatagaggccaaggccatgttttagaagatttaaagaaaaagggaaatttggtgagcaccataggaattacagatggctgtaggaattcttcctgttttactctctgggcatggaccacagcttggatccagaaatatttaggagcaggataagaggaccaagttcaattctataggaatcctttagctgataggctcagaacaaatcacataattgatagtgctgcttcaacttcaagtaaggaatattgatgcaatccttacagctacaaatggacagtggtctcatgttttcagttttcaagtgtttcttaagaggcaaggtgatgaaaacgcccacgtggggagccccatgtccttccattagtgtagagaaacctggtgtccagcagcacctgctccctctgcaagcccagcccccttcagcaagggcagtgacccagagaagaagcacagaagacacaaccctgtatcacattttgtttaatggtgccattgaccaaaggggaggatgaaaggcacacacttttttgttgttttttgagacagagtctcacgccatcacccaggctggagtgcagtgatgtgatctcaactcactgcaacctctgccccctgagttcaggtgattctcctgcctcagcctcccaactagctggaattacaggtgtgcaccaccatgtccagctaattttttgtagttttagtagagacggggtttcaccacgttggccaggctggtctcaaactcctgacctcaagtgatctgcccgcctcggcctcccaaagtgttgggattataggcataagccactgcacctagccaaggcacacactttggagaataaacactccttgttcgctgctggagggtagaactatgcttgactactaggcagagtccagtcttactgacaaacagccgtacatctgttctgtcttttcaatcaaacatcagcttcttgcttaacattgatgtgtacatcttgagggatgtcaaaatattgtaagctaagtttttcatacctgtgttccacactcaccatttttagtaataaccattgagcgagttcattctccctccttcctttttctatcacttaatctaaaattatcatttttccagcttaattttgataaccatgaatctggtattagaggcagggaacacctcctcaggactatcttttcttttatcatttggcttgcttacccaatatgcaaaaactatgctgtagaaaaagcagaaaagatatcttgattatgaatgaagctcctgtgtttactcagagagaagatgacccaggattcagttaacaaaatcagctgattatattactatatagtcctggagtcccaactccttgaccattacctcaagttatttggaattttgaagaggtgatttgtgttcctgcaataatgtctcaggggtgggctgacgggtttcctcttcctcctctcagtgagccaagggagtttgtggagaactctgagtgcatacagtgccacccagagtgcctgcctcaggccatgaacatcacctgcacaggacgggtaagagccccttgctgctatccacgtccatttcatgggaagggccttcacagaagccgaacagtgatgatggcccagggcatcctgtgtgggcaggacggccatcagagccacttcccagaggagacggcaggcgctgacagcgctgtccgggcagggtgtcggtgacattagcacacacattagcctgcgatgaacattcactctttctgctgacacccccaaccttatctaagcttatcaaatcctcacatttaacggaggctgttttcacctggtttcccccatccctgacctagtcagcattgctttatcgctttcatcaaacatcctcaaattcttaacattagcttgtaattaattgaagaatttttaaagaaattgctagcaaaactttttaaactgcacaactttgtatctatatgttcaataacatatagatacaatattctttacaataatcttttaaagaatatgagtgagaattcgggcccctctcacaccaaatgtcctgatgttgttaattctcaatgttattatatagggagctctgttttcttgtgagcttcaacagccagttctaaatctactaactgaaaacattttttagacattctctaaattgggcagaagatgacaggactgtgttttgagggataggctgccagcgtggctgcttacaaagtaaagacttggtttataggtttgcatggtgttgggttaaatttctgtcattaaaataattggcgatattgacatagtcatctaattatgctggctctgggcacacacagcccttgagtggacaaaaccaacatgagagaacttagccaaggggaaagcctttccctgctggttttatttctgctacttctgaagtgtggggcacacaacctgagcagtgcttttatttgagtcccaatgcttttatttgagttttgcaaggttattccaagttttacaaatagaaggtagcgtatgactcagtccttgatatgccaaccactgcacagagacttgccaccttcctgtcactggagaaacactcatgtgggttttcttaaatttgcctccctctgagcttccctttaacttcaactataatatgcaagaaagactatctgaccataaatacacatttgggccaatcaagatggttttgccaaggaaagatgcccacaatggttaagcagaatgcaataatgtagagaatatcatttctttcatgctggtgtatatcatatgcattcaaaaacagggagaacttctaagcaactaacagtgaccatatcaagcaggtgcaatcacagaataactggttttctcctttaagaatttttctatcatttggctttccccactcacacacactaaatattttaagtaaaaagttacttccattttgaaagagaaaagaaagagacatgcatgaacatttttctccaccttggtgcagggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtgagtggaaagtgaaggagaacagaacatttcctctcttgcaaattcagagatcaaaaatgtctcccaagttttccggcaacaaattgccgaggtttgtatttgagtcagttacttaaggtgttttggtccccacagccatgccagtagcaacttgcttgtgagcaggcctcagtgcagtgggaatgactctgccatgcaccgtgtccccggccgggcctgtgttgtgcaatgctgcacatcacaacaggagggtagggggacaaaagagcacaggtcctggcagctgccacagtctccaggggcttttgcgtttctctccagatttctaaggttaacatggggattagctgttttgcaatgaataaaaggtaacattgcctggaatgttgcttaaagacacttttttaaagctagttgattgttaagctgttgctacttaaattaaaactactttgggccagacgcagtggctcacgcctgtaattccagcactttgggattccaaggcaggcagatcacttgaggtcaggagcttgagaccaggctggccaacatggtgaaaccccacctctactaaaaatacacctgtagtcccagctactcaggaggctgaggcaggagaattgcttgaacccgggaggcagaggttgcagtgagccaagatctcgccactgcactccagcctgagcaccaagagcgaaactctgtcgcaaaaaacaaaaacaaaaaaaaaagctactttgactggaattagcagaagcactctgattgtgtgtatcttatttactggaataataaagctgtcaatcaaactggatcccactcaacaatcagaaagagaagttgagctgtcatatagtagttcacacttacttctgtttctcaaaatcctcagctttgtttggaactgttactcattctttctctgaatccatctgtatgagttgtgtgcccttgggcaagggtcttaccttctctgtgcctcactttcttttctgtaaattgggataataatgctgcatagctcacaggatttttatgaccatgagttaagatatgtcatatacttaaaatggtgcctggaaaatggtgaatactgagtcaatgatagcatcattgatggtgggatggtgatgaggaggtgggagtcacaatggtggtgttgatggtggtgatggtggtgaggaggtgggagtcacagtggtggtggtgttgatggtggtgaggaggtgggagtcacaatggtggtggtgatggtgttgatggtggtgaggaggtgggagtcacaatggtggtagtgatgatggtgttgatggtggtgaggaggtgagagtcacaatgttggtggtgttggtggtggtggtggtgaggaggtgggagtcacaatggtggcagtgttggtggtgaggaggtgggagtcacaatggtggtagtgatgatggtgttgatggtggtgaggaggtgagagtcacaatgttggtggtgttgatggtggtgatggtgatgaggaggtgggagtcacaatggtggtgatgagggtggtgatgatgatgaggaggtgggagtcacaatggtgtcagtgttgatggtccgatggtgatgaggaggtgggagtcacaatgttggtggtgttgatggtggtgatgatgatgaggaggtgggagtcacaatggtgtcagtgttgatggtggcgatggtgatgaggaggtgggagtcacaatggtggtggtgatgacggtgttgacagtggtgacgaggcgggagtcacaatggtgtcggtggtgatggtggtgaggaggtgggagtcacaatggtggtggtggtgatggtggtgatggtggtgaggaggtgggagtcacaatggtggtggtgttgatggtggtgatggtggtgaggaggtgggagtcacaatggtggtggtgttgatggtggtgatggtggtgaggaggtgggagtcacagtggtggtggtgatgagggtggtgatggtgatgaggaggtgggagtcacaacgttggtggtgatgatggtgttactggtggtgacgaggtgggagtcacaatggtggtggtggtgatggtggtgaggaggtgggagtcacagtggtggtggtgttgatggtggtgatggtggtgaggaggtgggagtcacagtggtggtggtgttgatggtggtgatggtggtgaggaggtgagagtcacaatggtagtggcgatgatggtgttggtggtgaggaggtggaagtcacggtggtggcgatgatggtggtgaggacgtgggagtaacaacagtggcagtgacggtgattgagacatgatgatgatttgtcaactttctaggaaaacaatcatataatctccaacagtgatatcttaatatcttttccaaaagtatcagatcatattataagggccaagtttccagaataatatcagacataatgacagtggacatcagagcttggcatctaaaggtaatgggaatagctctaatgtctcagcgtgaaaaacaacatttgctattagtctgagatactaattatctagttaaggaagtactcacctatacctagtttttaactgttttttaaaatctggaattgattttgaattttaacaaatatttccctgggaacaatgtaagattcttcatattttcgcctttgggtataccaacatgccagctctgttggccactttgtgagctcgatgaagcatggtataaaagatgctttgctagtgtttcacgtaatctatttctataagcaattttggagctaagcctctgaaacagaattatattatctgtatagaataaatgttttatcttcccccttttctttcttctggaatagatgtgcatcagtatctctgcatcaatatctctatatcagtatctctgtgtcagtgagcatatgttgctgggcttaggggaggtccagaaagtgattgggttttggcattttcaatacacttactttgtataagaaatagtttgccaaatatagaaagaggggatttagtcaagatttaaattaaaaatgttagtggtcatttttctaatgtctttctattttttcccaggtcctaataaatcttcactgtctgactttagtctcccactaaaactgcatttcctttctacaatttcaatttctccctttgcttcaaataaagtcctgacactattcatttgacatatggaattttataaatattttctttagtatgtgtgattacattcctgattctgagcctttttagatgagtatatagtttgatataatcttgttattgccacctgtgtcttctcccaaagccattaattatataggaattacacgatagaaatgggtttaatttttaaaatacggccaagtgttgatgagagggaaaatttttttaatttctttcactgagtatttatgacgtgcacaacattcctgaatatattgtctctctcatttctcagatgggatgtattgccttctccatttctattgttaaagaaacacttacaggggtttctttaacaacttgtgaacagcagcatcagagcccagactacagcataagcagctgctgattccaaaagccctaccttccaaccgggcaggtgcagccacccagacgagggggaggaaccctggaggaatagctatttcttttttttttttgtcgagacggagtcttgttctgtcaccctggctggagtgcagtgccgtgatcttggctcactgcaacctccacctcccaggttcaagcaattctcctgcttcagcctcccgagtagctgggattacagacacctgccaccacgcctggctaatttttgtatttttagtacagacagggtttcaccatgttggccaggcttgtcttgatctcctgacaagtgatccacacaccttggcctcccaaagtgctgagattacaggcgtgagccactgcgcccagcaggaatatctatttttaaatggaactgtgttttcatagtacacggtgaggagaaagttgctttgaaatctttatcctaataaaccaaataatatgaaaatttgcctattttaattatatgtaacaaagtttagttactgctataattgcaaatatgtataaattccttaccaaaaaaaaaagaatcaagtgggggccagagaataatttttctgacagaattaaataacatgctatagctgcttgagttcatactcaatagtcatttctgcagagttaccgagggcctcatcagcgtcagcaggagcccctcgccttctgacgctctcacatccttctctcctgcagccccgtcctgccactgtccttgtccagcttctcttcaagggtcaactggtctacctttccctacaagtctgtcacagcttcttgttagcaatccctatggttgcccaaaagcattttcagagcctgcataagactgcatcttgtagaaaatttgcagtttcaatctgccctccctctgccgggtgttcccattgtattgcattcagcaggcagggagagactgctattaggtctgttcctgagtgactgctttctgtctcagactgtttggtgtctgtaggaggtagtggggtgggcagtaacgaggtctcctgtatattccacccctacgaagcctgtgtgtttggtttatgaactaagctcaaaagcaccacaggggtaagactgcagtacatgacaccatggaaaagagggagcacccagacccccaaattaagaagagcagtgtagagaacagagacctggagagcagagatagaaactgttaggatcagattatagtgttacaccagggctccccaggcctctcacatattgaaatgtacttgtccatctttctccaggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccagacacatagtgattttaattatttaagagtagtttagcatatattgctttatgatttaattaaaaatctccaaaatatatgccaaagaagtagaatgagaaaaatgtatatttctctttcacttcctacagatgcactgggccaggtcttgaaggctgtccaacgaatgggtaagtgttcacagctctgtgtcacatggacctcgtcaagaatgaccacactgctgtgggtgaagatgctttcctgcatttctgactgtcctctgtcctgatcaagtttctatggctctgggccagcctaccctcagccagggtttctgcagagactgcccagctggttccacgtggctccacgtgccaactttgtcctcagtggagggaaagttggacacacagtgctggggctgctccctgctccgccgttgctcgatgcatggcctgcctctgaattccttggttccactggttttgctgggtccttctgtgcctctagctcctctttttttctgtccacttaccccattggtcccatcacaagcctgtgtgtgagtggcctttctgttcgatgacaacctccagcataggggagtgtttctccttgctttctttcccagacacactgcccagcaaaggcaaaagggcttccttcaacatcagctctggccagtttgccagagcaaagccctgagaaaagcaaggttgaaaagtcttattcaaactcaccaggaaagagtggtgttactctcgatggcgtctagccaggaatcatggaattatacaccgagcacctgtttgccattttggatgtttccaaacatgaaccaaacttccaggcccctctgccatctctggtaacatttacaaagtcccttcctcaccactgcccttccttcattttggcatgctcctccgcccccgagttgacagccatagctctctctcctgccaccagtgtcacatgatcgaggaagaaggcaacttcaaaaagactgggtccccttccactcccatctcttcagtgagctgctaggacacccagcagaacttccccactccacactgcaatctcagggatcttagtcacggggctttccaccatgtctccacctggaaaccagtcatggccattccttcttacatctgctcttttccatctttttcttctcctcctgttcacccgcccttactcttgtggcgccctatggatatgcgctccatagcaaatgattctttatatcttacggtattctagtgagctggcacatgtggcttctggtttcctctctctggaactagacatgacctctgtgggagggaggattaaatgcaccctacagtctgaggctgcatgatgacatcactcatcacaatgatgctttctatgtctgaatcctattcctttataacccctttcaagctcgttcagagagtatttcacacaatccatgtgctcatcttaaaagccaaggacccagaggagtctcagcattgccaaaaagtcccttcacccagcctggccagaggcagtgcctggtccatgtgtatggactatggcacttcaattgcatggaaatactcttggaatgaacaaaataccaatccatgaaaaagcattattgaagtctaagttattttttgaatcatattttgttaatcaacaaattgaaaaatactcattatatggagaggtccagataaagcctcaattttaaaaaatgaggaaaagtgtgcctggtaggggactggggagagcttgagaaagttggaaacgttgccttagaagcctgttttttctccttttagaagctacatagtgtctcactttccaagatcattctacaagatgtcagtgcactgaaacatgcaggggcgtgttgagtgccaaggccatggaatctgtcagcaacctcacccttccttgttcctccacctcattccaggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggaggtgagtgccagtcctgggtgggctcaggagccctcgcaccccgacaggaacaagggccagccccgagaacgggccattagcagttgtgtatgttagatacataattgtattatgatgcagaaagaatctctgaatgtgcagttatacccagttggtgacatgttggtacatccatccgaggaaatggcaatgtttctaggctgcacccttcaatgtccacaaagctgtgtggcatctgcttaggacccggtgcctgtgtgtgcataggagggaggccaggaagcctggctgttgatcccatgctggcactgtggcgaaggcgagagattcctgctttggaaaacaccattgtccacacagtggctttgtccatgatggacttcgccacagcccagtcctgtgctggaagccatgttctctggaaagagcaacccagcggctcataagcataagcgcgtgtgatgtgccccaaccaaacgaccgccatgcacaacttccctaccggagttttcaatccagttaataggcgtggaaacagacatagaaattgtgtttgttgaaaggtagctgttcagttaaagaacacctgtatcagagcctgtgtttctaccaacttctgtcaagctctgtagagaaggcgtacatttgtccttccaaatgagctggcaagtgccgtgtcctggcacccaagcccatgccgtggctgctggtccccctgctgggccatgtctggcactgctttccagcatggtgagggctgaggtgacccttgtctctgtgttcttgtcccccccagcttgtggagcctcttacacccagtggagaagctcccaaccaagctctcttgaggatcttgaaggaaactgaattcaaaaagatcaaagtgctgggctccggtgcgttcggcacggtgtataaggtaaggtccctggcacaggcctctgggctgggccgcagggcctctcatggtctggtggggagcccagagtccttgcaagctgtatatttccatcatctactttactctttgtttcactgagtgtttgggaaactccagtgtttttcccaagttattgagaggaaatcttttataaccacagtaatcagtggtcctgtgagaccaattcacagaccaaaggcatttttatgaaaggggccattgaccttgccatggggtgcagcacagggcgggaggagggccgcctctcaccgcacggcatcagaatgcagcccagctgaaatgggctcatcttcgtttgcttcttctagatcctctttgcatgaaatctgatttcagttaggcctagacgcagcatcattaaattctggatgaaatgatccacacggactttataacaggctttacaagcttgagattcttttatctaaataatcagtgtgattcgtggagcccaacagctgcagggctgcgggggcgtcacagcccccagcaatatcagccttaggtgcggctccacagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactttctatgtctttccctttctagctctagtgggtataactccctccccttagagacagcactggcctctcccatgctggtatccaccccaaaaggctggaaacaggcaattactggcatctacccagcactagtttcttgacacgcatgacgagtgagtgctcttggtgagcctggagcatgggtattgtttttggtattttttggatgaagaaatggaggcataaagaaattggctgacccttatatggctgggatagggtttaagccccttgttatttctgactctgaaacttgcattcaattcactccaccaagttatctcatctttgaaatggctttttttaaaggtgcctagaatatgatggcgtgcagtctataaactgttgcccaccttctgtactttctctcagaataattcacattcttctccagtgtctgttgattgttactttgtggaataagttcttggaaaattccacaagattattgttatcttcttactaccaattctattgaactttctccaccttctctgggccttccccagccagtggtgggaagatgctggctggagtctgacagagcctcttctacactggcctgggcttgctgtgagttggtggaaacctttgctcttgtcccaacacagagcaagtgaaagaggaggtcaaggggctcaggcagcggactagggaagcagaatcgaggaaaaggaaaaatggctgacttattacctcaaaactctagagaatttagttgatcttacagccaagaaggacaaaagccagagagtaatatcctccgcctcatgtctaacccacagaatacatagcaagtaaagagaacatgggcctttataaaaatgtcttaagatacaattttttaattggaggaaatctacagtttaattttctctgggcagcttttcttccttttattatagtaggggaaatcccatgttgatatacttctaaatgaaagatgatgaattgatataatacaataaaaaatctgtaaaattgatgatatacttatcaagaaaaattagctttcattttaacggtttacaaattgagtcaagtcctagtaacaaaatgttaagtctattaacataaccacaagaaatacaggaagacgggcaatctgtgaagcctttcacttacaatctctggcccctcacctgtgctgtgtaggaaaatctttgtgcacaatttgcttccttaattcattttttattcattcaacacattctaataaattatacaaaatcatgttgaaatgtgaatttcagtggtatttataaatgcagtgtgaggagggtttggatgtattctaagacaatagttgtgctttgggaaggaagcagtgttcactgaaaagtgcccccaggaccttttaattggaggaaatatgcttctgtggagttggaaatggggtagaagatagataaggtcaaggcttaaaagttaagtgcacccaacatctgaagcgtccatgggcctggcatggtggctttcgcctgtaatcccagcactttgggaggctgaggcaggaggatcccttgagcttaggagtttgagaccagcctgggcaacatactgagacccagtctctacaaaaaataaaaaattagctgggtgtggtgtctcatgcctgtagtcccagccactcaggagatgggaagatggcttgagtccaggagatctaggctgcagtgagctaaaatctcaccactgcactccagcctgggtgacaaagcaagaccctgctcaaaaaaatagttagatataaatattaatatagatacctatatatatctgaatatagatatctatatatactctgtatatagttatttagatatataaatatatatgatatatatttagagagatatatatttagagagatatatatttagagatttatatatattttatatatatttagagatatatatctctaaatatatatctctctctaaatatatatatatctctctctaaatatatatatatccctaaatatattaaataaataaaagaaataaaagaaagctcagtttggcctcctgcttgtcctgtctcctcatcccctcttccccctccatcattttatttccttgccccatgtttcttcactgcggccatgtcccccctcctctccaatgatggatgtcatgtctgctgcagtcagagggcgacaagcctggagtgttccctgaagcctgtggtttgtggtttgtcctgcagctcaggctgcccaggcctcaccagcaatcctggcgggcagggcaccacactgggatggagagggggaagctggaggaggcactttctggtaaagaaagcaaaagccagcagtgcccaggccaatttcaacagggagttaaatagcaccttaatcctgtggcaggacagctcatggggccatgtgtgctcttagaaagactcacatgcacgcatgcacggcagcaatgactccatactcacgttcccctgcagacaccaggcccccacagccggcacacacactgcagccccagttccatgttgctagcagtggcttagtgaatgagtaaagttcttaaaatgcaggggacacctgcccttcattcataaggctggacgtacacctctccttaaggagttcaagagctagtggaatcccaattcatacggtagagccattcacagatgagagagacaagccagaaggaaggaaccaaaagtcatgtcagcagttaggacaaaataacaggctttcaaggtcacaaagcctcagggacactcctgcggtgggactgggctaggagccatgggggctccaactgtgcgctctgcctgccagcctgtgggtgctggggctccacgaagattgttgtggaataccaagcatgcttgctgtaggtcacggtgcacgtttactacttccaagacaaacagccgagaacaaagctcgctttagcttctgcgtacaccgaacgggacacacgactgaacagcgttcccattgtgcctgctgggtggggaggaagtgatggcccagtgggtctatcagatgttagtaggatggggcctggcagggctccaggctctgtgtggccgacacccacgccccccgctctgctccccattcccagccccaggtcagccctgcgaggccctgcagcagatgggctgctcaaactgctctggtttgcagatttttcttccctctcaaatgaatacaatatgttttcaagtctcaaccagatcttgagaaaataggaagagccagagggtttctttggtgttatggttgtacagcttcccagactccgggggagagatgtgatttgtgctttctggcaatcccatggcgtattaaattttcataggctttccagtttaaatttagggtaggcaatggaagggaacgcaaaacagatttctaggtgtactgtgtgtgtgtctcccacgtctaaagtctgttaactggagcacccaacaggccccacaggctgccttcacacagaggacctggggcgcctccgacccattggggtgagcagtgggccatggagggagccagggtcaggagacctggttgtgggcctgacctgaccctgctcagggtggcctcaggtgggccgttcacctcgtcagcctcagcttaccctctgactacagtgacctcagacaaaatacgcttcctggccctgtccagttctgactttttataaacaagcacttatccaagttaaagggatattttcaatatctactgagtccacagatattaaatatctcctctcttctttaaaattgtggcattatctttagaatataaaaggaaaataacacacactctccttgaaaatagagagcctaaacactctgcaggaaatatttaaagctatagtttttgtttgtttgtcttgaatgcaagtggcctggactttgacttgctttgagtctttgaccttcatgacttcagtacagttcaaccctgacagttttgaagtaggtatgtgcctagatctgccctagtccctgctggaatgttgaagaagcaaaggtccaggccctcagagcacttgccacgtacttgccaacagatacggggcggagacttgagtcaacgtaagagcaagtgtgtgccgggtgatccgacactgcagagcgccagctagaccctaagcgtgtgctaggggctgaccaagccgttctttcctcaaaaacttggtggggagggtatttttaaaatcacacaaatatttaagtacagattatgatgactgcctcaaagcagtggctcttcagcttcatcaagcttcagagtccagagggtttgttcatatggaaggctaggcctgtctcctgcatttcaccctcttggcctgggggcgggacccaagaatgtgtggctctaaaaggttcccaggcaatgctgaggctgctttctgaaggaaaaactgcaagataccaggagagtttcatttagattgaagagtcgaggaaggctcctctgagaaagagtctgctaaggaaggaggaggtgggttctggggacagaggttctcccgtgggtaagggtggagggaagctctcctggggagaaggtgggcaggaggaccagaggctggagggaggagggcagtcagcctcggggcttcccaggaacagggacggccagggcagggtttagggcaaggaaagcgtgtgagcatatttgtattttagtaaatatttacagtttgccctccatgtctgcagtttcatatccatggattcaatcaaccacaatgaaaaacgttggggaaaaaaattgcatcggtactgaacatatacggactttttttcttgtcattattccctaaacaatacagcataacaattattcacatagcatttgcattgtattaggtactataggtaatcaggagatgctgtagatgggaggatgtctgtaggttacacacaaatgctgtgccactttatatcaggggcttgagcatcctcacattttgatatttaagggaggtcctggaaccaattccccagatactgagggtccactgtctgtgtcccctcgccccaccttgcctttgtctcctgtctcctatctccaccctgcctcccgccagcctgttgctcctgacctgcccgggcaccctggagcagcaccctatctcagagcctggctcagtgtgttcacttctgcagagaaactaacttgcccaagtccacactcaaaacataggcattgctgagatgtgaaaagcagctgtggatgctttctgctacagtctgtgtgttcttttccatatctgaataaaaggtcaccaccatttgtattttaaagagaaagagaatttatgggtggaaattggggattccctcattctcagtcagacagaaaagagggccccattgtgtgcctgattgcaaataaatttagcttcctcagcccaagaatagcagaagggttaaaataaagtctgtatttatggctctgtcaaaggaaggcccctgccttggcagccagccggaattagcagggcagcagatgcctgactcagtgcagcatggatttcccatagggagcctgggggcacagcacagagagaccacttctctttagaaatgggtcccgggcagccaggcagcctttagtcactgtagattgaatgctctgtccatttcaaaacctgggactggtctattgaaagagcttatccagctactctttgcagaggtgctgtgggcagggtccccagcccaaatgcccacccatttcccagagcacagtcagggccaagcctggcctgtggggaagggaggcctttctccctgctggctcggtgctccccagatgccttctccatcgcttgtcctctgcagcacccacagccagcgttcctgatgtgcagggtcagtcattacccagggtgttccggaccccacacagattcctacaggccctcatgatattttaaaacacagcatcctcaaccttgaggcggaggtcttcataacaaagatactatcagttcccaaactcagagatcaggtgactccgactcctcctttatccaatgtgctcctcatggccactgttgcctgggcctctctgtcatggggaatccccagatgcacccaggaggggccctctcccactgcatctgtcacttcacagccctgcgtaaacgtccctgtgctaggtcttttgcaggcacagcttttcctccatgagtacgtattttgaaactcaagatcgcattcatgcgtcttcacctggaaggggtccatgtgcccctccttctggccaccatgcgaagccacactgacgtgcctctccctccctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaaggtaatcagggaagggagatacggggaggggagataaggagccaggatcctcacatgcggtctgcgctcctgggatagcaagagtttgccatggggatatgtgtgtgcgtgcatgcagcacacacacattcctttattttggattcaatcaagttgatcttcttgtgcacaaatcagtgcctgtcccatctgcatgtggaaactctcatcaatcagctacctttgaagaattttctctttattgagtgctcagtgtggtctgatgtctctgttcttatttctctggaattctttgtgaatactgtggtgatttgtagtggagaaggaatattgcttcccccattcaggacttgataacaaggtaagcaagccaggccaaggccaggaggacccaggtgatagtggtggagtggagcaggtgccttgcaggaggcccagtgaggaggtgcaaggagctgacagagggcgcagctgctgctgctatgtggctggggccttggctaagtgtccccctttccacaggctcgctccagagccagggcggggctgagagagcagagtggtcaggtagccctgcctgggtgctggagacaggcacagaacaacaagccaggtatttcacagctggtgcggacccagaaagacttctgcttttgccccaaacccctcccatctccatcccagtcttgcatcagttatttgcactcaacttgctaagtcctatttttttctaacaatgggtatacatttcatcccattgactttaaaggatttgcaggcaggccctgtctctgagaatacgccgttgcccgtcatctctctccgacagcagggcagggggtccagagatgtgccggggaccagagggagggagcagacacccacccggcctgggcaggtcctcctcattgcttgcatccccctggttagcagtggcagtcagtcctgccgagtcattcatgaggcgctcacccaactccaggcagatgtaaaaggtgacctacaagaagacaaacaaaaacatctggagcgctcttatgccagcatctgcccttgacaccaccaggcaggctgttgctgggagccgtggtgcttgggtaagctccttcccatggcagagctcctgggacgcattgtagaagcagggaccacctcccaggataaccagatagcagcacaccctgcacagccccttttactccagcatcatcgggcattgatatctcagctgcagccacaggcggcccccagcaccccaggaagtggggagcgctcatgcttctctgagcacaaaaatcactgaatatttttgccattctcatggtcataacccgggccacagagtagaacactcctatcactgttgttagacagtggtcctgggagagggtcttgtgtgcctcggatgccagggcctctttttattgggaggtgcttgttatttctgtgtgtggctgcatttgtttcccaagactgccacaacaaatcatcaccaacttggtagctcaacatagcacagctttattccctcctggctctggaggccaggtgtctaaaaggccatgctcccacaatggttctgaggaggatccttcctgcctctctggcttctggtggctccagcatccctgggctgtggctgcacctccccatgtcaacctccgtcttcacaaggccttttcctgtgtctctgcaaccacaggcccctctcctttctcttaataaagataccagtcattgagtttgaaaattgctaagagagtctgttgtaaatcttcttagcacaaaaaaaaatgacagatatgtgaagtggtagatatattaattagtttgatttgatcactccgctatgtgtataaatgtcaaaacaaacattgcactccataaatatatatattaaaaaagatcccagtcattgcatttaggacccaccctaaatccaggatgatttcatttcaagacttttaactagatttgcaaaaccccatttccaaataaggtcacattctgcagttttgggtagacgtgaaatgtggagacactgtgcaacccactgtcttggggagggggtggtcagcctggggcagatgttgctgggtgtggagctacatccactcatgccctgacctggaacccagacctgcttccccagctctcctcctggttatctgaagcagggaatggagagcactgccctccttgcccaggcagtctctatcacctggttttagtttcttcttagcacatattgccccagaatatctggttggtttatggcttacttgagtttgtgcctacctgtcccaaccgggaggtgagccctggctattccccaaacccggccctgcatgtgggagctgcccttcctccgttcatcagagggggccaacagtccacagctgttcttaatcatctcccagtaacccccagctccacaaaggtgactccttacatggtggagaggtggtcgggccatctgtgtgaaatgtgtatgtgaccgttttccttaaggggcacgtagtcttggcaggtttcgctcaatataggatgagctcaggactccagtggactgtggattcagatctggattctggcgcattcgccgtgtgaacgggggcacgttgctggcctgtctgcgcctggtctcccgactgtggagtgtgttctgccccttgtctttctgggaggtagggagggcagtgagccccttcgcatcgcccaccacaggcccagcacatggctgatccccactgagtgttcttttcctcctttgatcccctttggctgacctgggttggagcagccactaaaatatacccagaaacatcttcctaatctacatctgtgccaaccctcattccctggcgcagcatgaccatcacatgcccgccattgttcctgatctctgctgctcatgacctgctctccagcgctccttctcatgctcacattccagttggcctgacctagataagtggaggtttatttgaccccaaaaattagccttctacaaacgaatataatagtgtccattacagagaataaacttagtgcgtgtcccatttaagcagaagttactgaaagcctgagtttaagtttccagggcctgaaagttttccatgacagttttctgcataatattacctacaatttcaatctgttatttaaagccattcttgtgtttgttgtactttgattagctttattttgatttgaagtccttttacattacgggcagttaacgctttgtctctgttagatttgctttttagttcacaagagaaacctcattcctctgtatttgaatagttgcaatgatggaacagctgtccctggagggaaatgaaaacagtgattccccaaattgtgacaatagaaatttgctcttgggttacttacaatgtatctgagtattaaaaaattttctttttaaacgtttgaagtaaaactacccagaaacacttagtggctgaccagaaactaaactcctggcatcctcaaaatgggatttattggcttataaatgtcctgtgttgactcacaaaggcacaaactatctaggtaagttttcttctaaatgttgatgggagagctggccactgttatgcaagtttcattgtcctgactaaactgccaaagagattacataaaattatatcaactagacaaaaggaaaaaggaaaaaaaacagaggtgtcttgggaggaatccatatgagaccagtagaccatgagagagacatcccttgccatctacaaggaaaatggattttgttctccatatgcaaaaccatctcaggagcttgcggagacaccacttgcttactagccagaaagagcaggtgcctcctaaattccccacacaggagctcacagtggctttcatgcactgggattaagttagacttaagaaagcctgtctactcttcctgggatttacaagccagctagtaaatcccagaataaatcacacggcacagtcatccaaagatcccgtcatccgtgccgtttggaaagccctgctcctgtgccaccctctccccgtggagcctcccatgcccaggactgcagagtcctgccattcagactgcaactcatctcacattcttccaaactatttggacaacagagctttctcatcacctaatgcagattacagtctcacagaattgagtgttcaggcagacactgatgtggttctgtagtacagcaaacaatatcagtttacagtcctgaggccaggcctggtgaacaacgcacggtagcggtggggcagggttctcagaatgaaactggcttacacatggcactctctgaccacaactgtataagcaccaaactacacttagttccatctatgaggtaaaatttaatgcagatgaacatcaaagaaaacgtcaaaggctcctttttacaagtacgtgggctacttaatttggtccaagtccattttaaaaagccctaggtgctttcacggctctgctactgacaagaagccccagtgcctgtgagctgctaatgggagggagaggaagatgagctgagtgggccgggctatcccgtccacaccgggagacagggaaggagactccaagctggtggtgccagcacattccaggccactcaggcctattcctaggtgccaggtcacgaaaaccacgctgacagatcgtgctgtgtgcgtgtcatagcacacaagcaggactgtgagagagtgaaagtgacactgggtggagcactgaggaagggccacagtgtgttggtggagataggctgtcatggagaagagaccctggcttgctctacattgcttccaatgcaactgcaaggcaggtcccagagggctccggccttcgtcatccaggtttgctccctcccctcatggctttcccatcctcagatgaggactcggcagagcctacccctgctgactaactgtggccccagggtggtgactcagccctgcacctcctgatcccgtctgcactgggccagagaggatgacttacccagcacgttcacatcacacagctttgtggattcctaggtccaaggaccagagatttcagttatgtgagttattttttttatttgttcttgcgtattccacaaagggtcgcagctaaacttaacctaatgatcactttagtatatcactaaaaagacaaagctcacagtgctgttgaagcacattcatcatctttagacattttgactagttatttcttaagcatttacctgctagtgttaagcatcacatgaaatacatatagaagtaagacaaaatttcttatctccccaagtttgccaacaaatacagagcaggaagggaagcaggtcagagcaggaggcgcagctatagtgaggccaccatgcaaggcacagggagggtgagctccaagtttgaatggaatgggtctgtcagccaagccccctggctctgggaagatagcagtgaacaagccagatggcccctcaccctccagagccgtgagtcctgcagaccaaacagcgtgacaggtcctttccctgtccaggaggcctctgtgggtgagagttggctgcggacagggcgtgaaggcacttgagggtggggaagtgactctgactgggagatgctgaggacagggaggaagccaccagataagggacactggggaggaggggtggacccctcagggccaagcacatggagcctcatcacaaaggcaagatggtggccaaattcaaggtcgctgcaaaaggaatggagaagagagaatagatttggcatttggaggaaatggtgacaatcatgagcacctacccgggactctccatgggtgctatctctacataaactcattccaccctctgattaatccattctacatatggggaaacaaaggcatgcggtgtttacgtcacttgccaagatctcaggatttgatccaggtggcctggttccatggtgcagcctctcagcctgcatggatgccccagctcagagcatgactctcaggacaggggtcccagcagccctccctccctgagcagcagggtgcccgtgctgcaccacttctgtctaggaataggacattctgacactttcctgcctcttccgaggtctagcacttactctatgcctgcctgggaaggtggcaagctggcctgaggaacagactcttccattttttagggagctcaaggccacagatgctctgagatctggagtccagagacaggagcggaggcttctcctggtgaccactctgcttaaaaacttcatcagatccgtagtttcagagcccccctgaaccccatcccttacctctaccagttgcaggtgggtctctggggtggggctgccctccccaccagcaccccaagggctaaaaggttgaggggagaacaccatcatttgtacagggggatcctggaagatgaggcctgagaaagccctgcggggcccctcaccttctccctagctgtggccaagagtgtctggccttgcctgcctcaggaccagcccaaagtggaggtgagaggtgagccccagcccccaggggaagggtgatggtggtcttggtctcagcatggttctggtagaggtgggttattttgaagatgatgaaccttaagcctctttctgatcttgctttaaataaatacttctgaacaacagcaacaacagaatagtgttgataggaaagccctccactccaccagaaccacgcggccttctcgtcctcccctcctccacttccttcctaagtcactgctccatgagctcttccacaggagatttacaaaacagaacacaaacaatccagttcccgcctctcactctgaactcctcccaagactcgtggggtgcggcagcccctgggaacacccagcccttcaaggtcaaacacagcccccgcccctcactctggggtaccctgccagaataagccccgacagccatgtggagcagagccttcttttttgtaagtggaagttccaggctggcttttcaaatccccttttaacctcagtgctgtatttcaaaattcattccagttttcctgtagtaattaacaaaaataaatattttaatttcaattaaagtgagggtctcggagaagaagcaggaactgagtttcctgagaggccccgctgaggctttgttgatatttcttcctgcgacctctgctcggaccctgggagctcacaggccgtatcgcagctcttatctttggggaccagttaaagcataactgcgccaggcacagagttgtcctttcaaatgtgccggcagtgggacggagacccatgcgtcaagtctcctctaagttcacatgggattctctccttgtcccaaagctgtctctgacttaaaaccctccaactgattacctgaattccagaatatgtcctgtgctctctgccctttcccacgcctttggtgaagaccggtgttctgaggaaacagacactgtgtagaaatggctcaggtcctttaaagccctggtgtgaggagtggggaagggctgggccagaggtcagctggatttgttagattgacagagtgacgcggacttccccagaggcacgggaccaaggtgcatgctcacgctgtctcatgctctcacacataatgtgtgtgtgtgtgtgtatatatatatacacatatacatatatatatatacacacatatgcatatatataaaaccccaagcagcctctggcttagcaggtgcatttcccagcagggcaattaaagccatggtcccagtagtggtcttggggtctcagggtatttggtctgtgcagccacatgcttcagtctctggaccccaggtcatctaacgaggtggtcgtgtggggactgggatagaaaaggtgtctgcacggacgtgtgtgaaagggctggcacatcgccagtgctcagcactgtcagctgctatcaccagtcattcaatcattcattcattcattcagttgttcattcttcaacaggccgttttaaaaatgtgcccagtataccaaaatctccgctaagcatttaaagaggcagaatgaaagttagcagtggtggtgaaacgaagctgggaatgtgctctgagggcctccttgtgggcttaatgaatatgtagaaaccacgcattttaaatagagagggagaaagggagaggttcctggtcctctgcatggggacttgtgtgtggctctttactgtaggcctgtgccactcctgctcaacagctaccacagaggacgccttcaacaaatgtgaagaacgaacaaaaggtacaaatgtgaagaacgaacagggtagaaagaaaggagaaagcaagggtgagggtgagaaatcaagggacagagaagagagaagaggagatagcctgggagttcacacagccaagaaggtagacactcagttgaaccagcaagaggctgagcctaactctccctttcgaatgggcaggagttcatgatatttaataaacagaggccttgctctgtaagagacagggtaccaggcagagagcaagtcagcatcgcaggagtcaaacgaggcagacagcgggggcagggagcttgcctctgaaggagacccaggctgccagagtagcagggagtctgggccagtcctcttttgggaagcgcttcctcggcttctgccccccctctcctctccctttccacccaccatcctgacataatacttcctaatctggaagtgttgtccagagaagaacctgctcatttcctcttaagtaggcagggaagcactaacgtccagcagcatcggaaacccgtaggagcgctctcggcagtgcagggtgaggggacagtccatgtagtcatgagacgtgggtgtcaggcaagcgtctcttttccaaaagagaaaaacattaaaggcctcacaaacggcgcccaaagactaattctgcatagcatctttgcgagaccctaggttcttatgatgactggttttgcctgagaaagaaaaaattttaattttgctctgacatgccaattcaacaaatcattttcacataatattcatgcaaaaaaaaaacaatttgccagaaaacttgggaatccatccacatctacagcttttccctgcagtcacactacagtgggatccctccatacaggagcggcagagtggagcaggctagagatgcctgtttgtttctgtttgctgcaccgcagcaagcatttctgtcgtgcccactctgtactagaaagtacatgaacatcagccataaagggaactagaaaggtggcccaccctcttggtggagagagaagagagtgtggtagaaacaataataagaagtctgcagaacttgacccctcccagcctctcccacctgccagcctggcccttgcagagagatgcaggctgccattcttaggccaaagcctgggacagttgggctcagcaaggtaggcatccgtcaagcaaggaggagcaggggtcagcagtgaccccagcagccagcagggagaaaggtgcatgtgacaaggacaccagaggccgtgggtcaggatcagccagggtcagggtagcatttctaggaattcactctgttgggcgctgtgctggctgcttctcacatattattcctttcttactctcagagcagagatttcaattgcagcgagattgtggaggcagccagggaggtggggagggtggtgtcttctaaaagcattttcagtatccatgtggtttcagtaataataataataataaaccagtgaaaagtaaaacaggacaaaaatcttcataggcagtgaaccatatcagagagtccaagaaagcacaatgagagtgtggcttaaaaaccctgaacgacattcctttgcaccagcttggtgaggagggcatggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacggtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttctcttagggaccctcacagcactaaggggtgcgcgtcccctgtcaggccctcgaatgccctcccacagccaggcccctctgaggtttcactctggcctgcttggctcctagcagccaccaacccatgatgctgggccctgaaaacacacgcagacctggatgagtgaggccactgggcacaaccagggctcccagctcaccagagcagcctgggacacagagggtgctcagaaacctaccagagcagccctgaactccgtcagactgaaatcccctgttgccgggaggaggcgccgggcctgggggacgggtcctggggtgatctggctcgtctgtgtgtgtcactcgtaattaggtccagagtgagttaactttttccaacagagggaaactaatagttgtctcactgcctcatctctcaccatcccaaggtgcctatcaagtggatggcattggaatcaattttacacagaatctatacccaccagagtgatgtctggagctacggtgagtcataatcctgatgctaatgagtttgtactgaggccaagctggcttttattgttagttaatttacattatatcctctgacatgcaagtattttctttcgagataatgactaatgataatgtaatcattgctgtctatctattgtactgagaaaacacggcagaggaaatcgagtccagctgccgtccaaaagtcactggagattgcaatgagctcgtctggcagggtggggggtatgggagggaaagagcttaggaaacggctctccctgcaaagtccaaccaaactttaacgttaaccaaaccattaatgttgccatgaatttgaagtgaaccagagggaggtggcagaagaagcttaatggggaatagttccggtagagaaatgaggcttaagatgaactaccctggcccttatgtgtcagagagaacggcttgacaaacacacactgaggatgtctgcagggataaaagaagaaagggagatgacccttgcttctcgctctcgggaggaccatctggtccggccctggggattctctgtttcctcttctgaatcccagtgttgcccagcactggcctgtacccatcctcacgagggccgctctcctcacccggccctaggtccctgccctgtcctgagcctacaggggcctcccatgttgagaaagtgttgctgacacattgtctctgaccgctgtgccaggcattttctgctgaattaccgcacttggtccttgaatttcacccagcaacttactgaaaggctggaacccatgaacctaccccttcactgaggaaaatcagttaccccagccatctacagcgacaggagcaagggaggagtcgcctcacctctctagaaatgtgtatttgaggagaacactattgaaatgaatttccaagaataatctagtcagtattacaaaagcaaaattatttgggatatcgtccttttttacttagtattttttctttttcctatagcattattaactttctgattttccaaatacatacacatttttaaatttcctgagtctttatctcttctgttaaaatgtaagatttatgatacaaaggcagagatttgtgtccatgaataagtgaagtttggtgtgcacctgtgagctgagccacctcaattaatggaacagataaggaaataaaggtctgctgatgcattgttatttacagccattttcagaatgtatctcctctccacgagggaactgcagggtcctgccccaagccatttattttgtcctcaagcagcccgcccctcccactccaggcacagcccggtctcctgctggtctcccctcttcccacttgctccccctcatctatgctccagacagaggccacatatattttttaactttttttttttttttttgagacagagtcttgccctgtcacccaggctggagtgcagtggtgcagtctcggctcactgcaacctccacctcccgggttcaagtgattctcctgcctcagcctcctgagtagctgggattacaggcgcacaccaccatgcccagctaattttttgtatctctagttgagacagggtttcactatgttggccaggctggtctcgaactcctgacctcatgatctgcccgcctcggcctcccaaagtgcatattttttaactttatcagacttttcattctctgctcaacatctttctttggtcctccaggtatgttcagataaaacctgagcacctggccatgactgatgggttgctgggccatctggccctggcaactctcccgtccaccaggtccccctcccgtcacgctccaggcatagcctgtgtgtgccagcgcaatgcccacactccatgcacaagtggaagccctctcaaagtcagtggcttagtgccttgatgtggtcacacccattctcaggaagtccgttcccactgaaaacattgtgtgttttcaacatcattgaggctgccacggcagattataatcactggcctaggcagcccactggaactaccagaccatgagcctgaattttttgtttaaaaatcatatcctgttttctctactctctagtctctagtcaaggcgaattattcaatttaataaattaggggcctagtgtgttgtaccaaggagctaaaaagagagaactcgcaacaccttccagcccattctccacctaacactggctatactggctctcctctctctcgctgtttgttccaaaatctaataacctgtcttcccactagaattcatcatacatgtttaaaaacctagttaaatagtagttaaactgactgcatagatctggaaatgagacagtctttcttttacaaatccatatagactatgagttgggggcaggggatgacacaagaatctattttcttgcccccaaaccattgctttccttccaatgttaagcttgtattctgtgtattaattcaggtggttccgtttgggaatggcctctgttacccagagatgggagggccatcagaactcggggttgtctgaaaaaacactggttctaaaattatcactgctttcacttgtttttaaccatcatagttgtttgattttgaaggaaaaacatgagggtttttattctatgcttgttatatctatattgtggtttcgtattttttagattttagtacctgacatttttttaacttttattttaggttcaggggtacatgtgcaggtttgttatataggtaaatttgtgtcatgggggtttgttacacagattattttatcacccagggattaagcctagtacccattagttatttttcctgatcctctccctcctcccatcctccaccgtcctatagaccccagtgtgtgttgttcccctctaagtgtccatgtgttctcatcatttagctcccacttataagtaagaacatgcggtatttgattttctgttcctgcattagtttgctagggatgatggcctctagctccatccatgttcttgcaaagtacatgatctcattctcttttgtggctgcctagtgttccatggtgtatatgtaccacattttctttatccagtctgtcattgatgggcatttaggttgattccatgtctttgctattgtaaatagtgctgcagtgaaaatacgcatgcatatgtctttatggtagaatgatttatattcctttgagtaatgggattgccgggtcaaatggtagttctgtttttagctatctgagaaattgccacactcttttccacaataattgaactaatttacattcccaccaacagtgtaaaagcattcctttttctccacaacctcaccagcatgtgttgggatttttttttttttttacttttcaataatagccatctgactggtatgagatggtatctcagtgtggttttgatttttatttctttaatgatcagtgatgttaagctctttttcatatacttgttggctgcatgtatgtcttcttctaaaaagtgtctgctcatgtcctttgcccactttttaatgggattgtttaattttttcttgtgaatttacttaagttccttatagatgctggttattagacccttctcagatttgtagcttgcaaaaatgttcacccattctgtgggttgtcttcactctgatgatagtttcttttgctgtgcagaagatcttcagtttagttagatcccatttgtcaatttttgcttttgttgcaattgcttgatgtgttttcatcatgaaatcttagcccattcctatatccagaatggtattacctaggttgtcttccagggtttttatagtttggggttttacatttaagtctttaatccatgttgagtttatttttgtgtatggtgtaaggaaggagtccagtttcaatcttcttcatggctagctagtcatcatttattgagtagggagtcctttattcattgcttttttttttttgtcaactttgtcaacgatcacatggttgtaggtgtgcagccttatttctgggctctctattctgtttcattggtctgtatgtctgtttctgtactagtaccatgctgttttggttactgtatccctgtagtttaaagtcaggtagcatcatgcttccagctttgttctttttgcttaggattgccttggcaattcaggctcttttttggttccatgtgaatttttaaattgtattttctagttctgtgaagaatctcattggtagtgtgataggagtaacattgaatctataaaatactttgggcagtatagtcattttaatgatattgattctttctatccatgagcatggaatgtttttccatttgtttgtgtcatctctgatttctttaagcagtgttttgtggttcttattgtagagatctttcactttcctggtttactgtatttctaggtattttattctttttgtggcaattgtgaattgaattgcattcctgatttggttctcagcttgactgttgttggcatattggaatgctaattatttttgtacattgattttgtacaactgagtcttcactgaagttgtttatcagcttaaggggttttgggtcaagactatggggttttctagatataggatcatgtcatctgcaaacagagatagctgttttcctctcttcctgtttggatgtccattatttctttctctcacctgatttatctggccaggacttccaatactatgttaaataggagtgttgagagagggaatccttgtcttgtgtcaattttcaaggggaatgttttcaacttttgcccattcaatatgatgttggctgtgggtttgccatagatggctattatgttgaggtttgttctttaaatacctagtttattgagaattttaaacatgttgaattttattgagagccttttctgcatctattgagatgatcatgtggcttttgtccttagttctgtttgtgtggtgaatcacatttattgatttgcatatgttgaaccaatcttgcatcccagggatgaagccgacttgattgtggtggcttaagctttttgatgtgctgctggattcgatttgccagtattttgttgaggatttttatgtctatgttcatcagagatattggcctgaagttttctttttttgttgtatctctgccaagctttggtatcaggatgacattggcctcatagaatgagttaaggaagagtccctccttctcaatttttttggaatagtttcagtaggaatggtaccagctttttttgtacatcttgtagaatttggctatgaatccatctagtcttaggctttgttttggttggtaggctatttattactgattcaattttggagctcattattggtctgttcagggattcagtttcttcctgaggtttttatttttatcaaatggaacttaacctttttcatttccaatttttttatgatctaaaaatgtgcagtttacagccctgttcagaatctgcatcttcctcattctgcagatacaggtccctcagagcaggtgactgagtgtgtatcctgtctggagcataatacttatgctagtagagttactgttgtctttattgttaattaccaaagtttaccacttatcagtcacttactacttgctgggcattgcactaagcatttcagttgtattatcttgttgggtccttacagcaatcctgtgaaacagatactgctattaccccactttatagagaggtagactgaggcttccagcattgaagcaaattgcccaagactacagaaatgtaggtttctaaacatcaagaaacagtaaccagtaatgatgactaaagcaagggattgtgattgttcattcatgatcccactgccttcttttcttgcttcatcctctcaggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgtgagtgactggtgggtctgtccacactgcctagctgagccttggtggctgctcttagccaaacagctgaggcctttgcatccctggagaaatgtcatcacattacttaaggcaggcacacaaatccagaaacatctgtaaataccccttcaagcattcttttaaagacacttcttgactcattgggcagtatgacctgacatttgcccatgtttgcaagcaaataaataaaactaaagtcttccgcaagccattacaccaaaatattctattcgctgagttactcaatgaaataccgagttgccctatattttgaagcctgttaccagagagactgaatgtttttaaatgcatggcagtgagtaacaacataaggctaatagagtcaacatttctgctttgacttaaaccttttaaaccagtggatttatgtgaagtctctgcagtgtggcatttaaacatttcaatctaaataagagtgtgtaatttgattgatgctattattctaccagattcacgagtgcagtgggctctggaggtagcattacatgcatgggatgagcatttgcaaaagaaagttgtatagggaatatgacagagccaagttaatgtaaatattaatgcctttctgaactctaggccacagagttgatcttttttaacttccttggtttgggctaaggaagctgtgatccagagaagccacgtgatttgtctaaggtcacatagcagtctggcctaaaatagcttgatatgctgtggatggaaaataaatgtgatccctcaagaggcatgaggatttccaggcagtagccatacctccaaattgtttaatctggatttagattgttgggtagtcacatgcagcagcacagttaacagtgtgtcctcctgtggaagttgccagcacagccagccctctcacttgcatgcatgcccaccagccttctcacttgcatgcatgcccactgggtatgtgctgtactggagacgccgggggtaggggcccagtcccaaccccaaattctttaaagcctatttttctaagttgcatctggtttcctacctgaaggaatgctaagggtggatgttgagtgaggaccttggtgcagggcaccctgcagtcaggatagttcatggagagcaattgtacagacccacactgctccatcccctcaggcgtaacacaggatgctgaccccaggaagagtgggcgtagaaaaactagagggcattattgttattctgattcaaatgtacagtgctggcatggtctttaaacagtaaccagtactagctggccaagacagaaaagtctaccacaaagacttggttctttcatcacttatttgactggaagtgtcgcatcaccaatgccttctttaagcaatgccatctttatcatttcttccagtgttctaattgcactgttttttctcattccttccccaggctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcacaggattgtctcaaagattcaataaaatatgttgcaaaatacgctccctaacacctcacagcaaggtgcacactcgatgaatgctgcagcttcttccctttctgtttcctcagaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctggtatgaaatctctgtctctctctctctctcaagctgtgtctactcatttgaacaaattgaattttagggaaaataaccatctagtgaaactcacatggatatgaagtcaattttaaccaaatggtaaaatcaaaatcaaaataaattaagtgtattaattattttgttgcattgcaacaacttgattgtaagccttttaggtccactatggaatgtaattaaatcaaaactaaacctagttgctctaaaactaacgattaagacaaaaattaaacaccttcacaatataccctccatgaggcacaccacctgcattcaggaaaagtggatgagatgtggtacaagcattccatgggcaacttctctgtttctttttcagagtgcaaccagcaacaattccaccgtggcttgcattgatagaaatggggtatgtatgaacaccttataagccagaatttacagctctccactatggctctattttacatggaaaatgccttaacctaaataattttaacccagataatcttgagttttcttcctgtgtgggtttttccctgcacggctgtcacgcctcacagtgccgttcaaagcgtgactcctggaccagtagtagcatcgcctggcagcttgttagaaacgccatttttcaggccactgccccagtttgaccaaatcaggacctctgggggtggcacccagtagtctatgtttgagccactttccaggtgatgctgatgtctgttgaagtgtgaggccgtggtctagaccgcactgtgccatgcagaaaccactagccacatgtggctacttcaacttaaatgttaatgagttaaaatgaaataaaatataaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgcagactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagatactcataacctgctaacacacacacatatacacacacatacacatacacacatatacacacaccacacacatacacagacaccacacacataccatacacagacacatacacatgcacacacatatacacacacacctcaaatacatacacaccacacacacatacatgtatacacacatacacacaccacacatacaccacaaaaaccccacacacatacacatatacacaccacacacaccacatacacacacgtatacacacatatatacacacatacaccatgcatacatacacaccacacatacatacagacacaccacacacacgtacacacaacacacaacacagacacacacgtacacacactacagacatgtatgcacacatacacacacaccacacatacatacacacagacacatatacactacacacaccattacatacacacgtacacatacaccacacacaccacacatacacacaccacacacacatacaacgccacacacacaccacaaaaaccgcacacacatacaaacatatacacactacaccacacatacacacacacaccacacaccacacacacacatacacacaccacacacaccacacatacacgcaccacacatacacacacgtagacacaccacacacaccacagaaacacacattaacacaccacatacacatatgtatgtgcatatacacacccacaccccacacacacatgtataaagatttagatatatataaaacatacgttatatatatgttgatgtaatatctaatatctatatatctaatatgtagtttattagctatctaatatctatgtcatatatatcaaaatctttatatataaaaatatgtagaaatctttatacatatgttatatgtatataaagatttagatatataacatatgtaagttatatatatgttagtgtaatatctaatatatagtttattggctatctaatataatataaacagattatcaatattataagctattagaaaaatgcaagttaaggcagatgatatacctctttacacaccaactcacacaccaactacacacacacatacacacagacacacacgacacacaccatacacatgtacacacacaccacatatacacaaacgtacacacacaccacacacacatacacaccacacacacaccacacatacatacacatccacacaccacacatgtacacacgccacacacacacatacacaccacatacacatatgtatgcacacatacacaccaacaccacacagacaccacacatgcataaacatatagacatatacacaccacacaccatatgtacacatgtacacacacaccacatatacacacaacacacacaaatacacacaccacacacacaccacaaaaaccccacacacacacaaacatatacaccccacacatacgcatatatacacacacacatacacaccacacacatacacaccacacacacaccacacatacacacacgtacacacaccacacacacaccacagacacacaccacacatacatacacatacacacaccacacacacgtacacacaccacacacacacagacacacatagacacaccacatacacacccacaccacacacacacaactcataccacacatacatacacaatagacacatacacaccacacacaccatacatacacacgtatacacacaccacatatacacacacgtacacacacaccacacacacccacatgcacacaccacacacacatacaaatatacaccacacacacatacaccacacacacggtgcacatacacacacatatacacacaccagacacacataccacatacacatcacacatatatgtatacatgcatacacatacacacacacatacacacactctcctcaaggcagtttatcctctgagaactttaaatttacaaaagacacatatgtccattactttgagaaggacaggaaagaacccactttcttttgcagcaacagcaagagggccctcccaaggctcctgctccctgtcataagtctccttgttgaggacattcacagggttcagaacccagggatcctgcatgggatggtgctttgctgattacttcacctctgatttctttccactttcagaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcggtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaatgccatgttggtactagttattaatcatatctaaccaactgtaggtgttctttcctgataacttttttaaaaaatcaataaattatttttagagcagttttaggttcacagcaaaactaagcagaaagttcagagagccccccctgtcgctaaccagcctctcccaccatcaccatcgcacctcaggaaccagagaactttttaatggaaaaaaaatccaagccagctcggaggcttcctcctgtgtctgggccagcccctcgggctctcagatgcattccaactcaagctcttcacatgccagagccttccagtgcccttgagacccctcattccaaagatctcttcatagtttttctccttcacagagccaagagggaattccctgatggaacagatttttctatggcaagcccaggttttatttcttcagagtaccaaaataattagaagtttgccctgattctgctaaaaatcagaggaattaagtgggtcccagcatgggcaaggggcctcccattcagctgccccactcaccgccaacctctcttacatgtgggtggtcccaccctccacccagaactttcatggcaggagctctcactgccgtgtttaatgtaatgaagccactacctgcacatcgggaatagccacggtgtggcaggggagggttctagggagtccgagctcagactgcagtcaggcttccttaccacaggagcatgttctgagaaatgcatcattaggagatgtcatcaccgtgcgagcatcacagagtgtacttcacacatctagatggcacagcccagcacaagcctaagtgatacggcgtagtctgttgttcctaggctaatgatctgtacagcctgggactgtactgaatactgcaggcaactgcagtacaatggtaaggatctgtgtatataaacatagctaaatgttaaaaagacacagtgaaaacgtggtattataatcatatgggaccatgtgaacatcgttatgtggcacattatagaaaacccaggttctgtgtctaaacgcttaaacagataaatgagtacagatagttttctcagttctagctgtaaaagtagagttaggggatttgaactcaacacctgagaaaaagcaaacctgttgatgaagcagatgatgctaccaaagaggagagaacagcttcccaaaacccagcatcaagggccgagcagccaggaggctgggtggggatgcacagggcgaggagggcaggcagggtgcctcctgcaggcatcagagagtggaccagcaccagacgcagctcctctctcctgatgggatggccctggggctcctggtggctctgacttctgtaaagcgtctccctccggcgcctttccctccaccagccggtggctgcacagtgccctgccttgtttctttcacacagaagtgagggcaggaagcaggctgtgccagctcacaccacccctaatgctcgcagcgctgactctaattgtttccaggaagatcgcagctttgcttttgtgctgttcctggtgaatgccatccgttgtctatgcacaaacatggggctgagagtaaaccacatttccttgtggaagcaggacttcaggatagccaggtccacgaacaatgagaaaatccggagcttcccagcattctgctcaaggcccagcatcccatatcggaacccgccgcacccactgctctctcagctcctgagcctccacaccctggctgcctgggaacacctcaggcacatgcaggtttaatataatcaaagccttcaattagggggtttagtccatatggaggaagtccagattctgcagatgagacaagcatggggagcattctgaggtgctggctttctgagcctgaaatgttcccccaagtggaggccacggccggccatcccactgaacagccttcacctcagggcagactcagtggcaccactgatttgtcactgaccgtcacgattccagctgaagctgggtgcagatggggtttcagctggaagaggttttccctttgggccagtaatcctataaaagtcatcatacctgtctggggagatgggcgatttccctagaatggagagtccaacgtgcaggagggagctgctcttcctgtcgggccttgggtgcacccctcatagggctcaggtcccactgctccagaaaggacctttaaacactcaggtcgagaagcagcaagatcacatttggtatttgccctagtcttaaaaacaataaacaaagcatgatagggagcccatgggcagatgtctgcaatttataaatgtgtgccctgaagcaccctcacccttctgtgctcatcacctctgagccccggggacatgcaccccggggaggccagccctgccctcactgccttctgtggcctctgccttccatctttctctctacatggacgcagggctaggaaacctagagactgggttctaaaagaaatagaaacctcttttttaccctgctcctgagagtcaacccttctgagctcaagcaaagggcattcccggtcctcagctccttgcccccacatagatctgaagtgagcctgtaccgcccacctctcagttctcaactgtcgcttaatcctgccccacaataggccacccctgggctacaacttgagcttctaggtgtgcacactgaaggctctgaacaggctcacagcccggggacactcggcaaggactccccacattcccagcacctgagcgaggcccagaaaagagaggggcaggcaccagattggcagctttgtatcctttctgcccacccccagggaaagggtgtagcccatatatggggaaggggggctggggaggccaggggctctgcaagccagggtccacgtcacttaggactgaaggcggcactgcccaggcaaatggcacctgaaaacccaacaggaacctggaggcccaaagcctccaggcgcctaaaaacccattcacttttctaaactgcatagtcccttatttgaaccagtaatgtccttaaaacctccagtgcagctctatctcggagggagtggaggtgggacctgggaaagccatccctctctcactccagatggcttgggccaccccttactgactattttcattctaaagaggttgcttctgtcaccctttcagcttctccagacccctctccttccatctttctctcttgtataatctaacctttcctgaacccaagcagaaatgcagtgacaaacccacaagatattcaagtgctggcacgcttctctctgcacttgcactttgcctgggctgactggcttctcaagggcaagtctaagggaacactggccagtgccacatacagactttaggggtcagggacaaagagatgtgatgtgtgatctacagcgtttctcctgtagatcaatgacacagaagacgccggaagggcaggccccattgctgaaacgtttgccaggtccaaatggttttggagcacacttgcaaactttcaaagaacagctaatttttgtattaaagtgtttcagagcacaaaaagatgggaagtttctcagtttattctacaaggtccgaatagcactaaaaatcagagagatactagaaaaagaaaactatagctttattcatgaatgtagatgtagaaatcctaaatgaaatgtaggaaatggaattatttattctaggaattaaaagatagctcattttgtttatacacgtgaggaaaataataggtgaaatgttaatattaactcatgttcataaggcatcaataacgcccaatcacattgctgttaaaatctcttagtcacttgggaatagaggacaacatgtttaattggattaaagtatctgtcaaaaattaataagaaacatcaaacataaaagtgaaataccaagaacctagcaccttaaatcagaacaagacaaggataactattatcacatctattattcaacactccagaaatccagtgttttgggggacaagagaagacatattacttaaatatgatatatttgcatcattagaatatagtcagaaaaccaaatctagtcagcagcctatttctatgaggttttattaggacacagccatgcctacttatttatgtattgtctgttatgactgcttttatactacagtggcaagttgggtagttggaactgagatcctttgacctgcaaagccaaaaatattccctgtctgactttttacagcaaaagtttgcctctcccaaaataattaactgaaaacaaaattaaacaagaaaatcagtagggtaagcacatagaaatataatcagtagtttttctacataccatccatcattaattagacaacataatggaaaagaattccatttaaaatagcaactaaaacaacaaaatatctagaattaaacttaaatgtgtgagaataatatgaaaacaaaaactaagaatcctttctgaggcataaaaggagactcaaaaagatatattacattcatggacatgaagacgatgttataaagataccaattatccctaaatataacatacattcaatgcaattcaaatgaaaatttcagtggttattttggggagtataagctttagaatttggaatctagaatagaaaatgtaccacagtagccaacaacatttggaaaacaattgagtagtgaaggaatgatacaaaaatatactatataaaaataataactaaatcagcacagtaattaacggaaacatagtttggaagcagatacgtgtgcataggaatgtgtccatgataaagaggacatctccagatgggggacatgacagactacccagcaaatgattttggagaaaacgcctatacatttgaaaattaattatggttctatttcacactctacccaaagacaaatttcagatggaccgaagatctaaacataacagccaaaacaaagtattgggtaaaatctatgtgaatatttttgaatctcaggaagaggaggtgatcctagtgcatagcacaaaaccccaaaggcataaagaaaaagatggacaagaaggaaatccaatgtttttcagtttttaaaggaaaaataactaaccactgaagaaaagccaatatatatacagggagaaaaactttaagatatatcaacaattaataccctaaaatgtgaagtattccaatgaatttgtaaaaaaattaaacactctattaaaactttaacagtgtatcaatggacaatttatggaaaaaatacaaacggcaaatagcactaataagtatatagcctacctcactaacaatgaaagaaatgccacttaaaacagaatgataacctttcacccacattttggtgggaatgtgaattactataaactttttgaagggcaaacaaaattttacatttgtgtatcctcttgatatggcaacttcacttgtaaagataaattctgttaacatattcaactatagaaagatatataaattagaatgttcactaaaccacagtttgtaatggagaaaaaaatggaaacttttaatgtccatcgaaagggaaactatcccataagtcatggaacatcataatatagaagtctgtgcagttgatagagcaataaatctggccaggtgcagtggttcatacctgtattcccagcactttgggaggccgaggcaggcagatcacttgaggtcaggagttcaagaccagcctggtcaacatggtgaaaccccatctctactaaaaatacaaaaattagccaggcgtggtggcgggcgcctgtaatcccagctacttgggaggctgaggcaggagaatcgcttgaacctgggagacggaggttgcagtgaaccgagatcatgccattgtactccatcctgggcgacagagcgagactccatctcaaaaataataataataataataaatccatctgcaatagcatggagttatatctgagagagagagagagttttaaatgaagcaaaacaagttactgaataatagttttgttttgaaaaaaagcttctatttgtgttatgtctgtgtgtgtgtgtgtgtgtgtgtgtgtgtgtgtgtgtacaatctgaaaacctcttggaaatattaatgtcaattaactaatggtggagacctctagtgagtaaggagtagaatgtgaaatgatgaaatgacaaagaggaaattttactttttattgtatacacttctgttgcttgaatttttataatgaatatatattacttctgcaattgtaataggaaaaatattatgtgtcagttcatggcctttccccttccttccacttgcaacagaacatttagcaatttcttatttaattttctcttcttcctgatctctctcccccagaacaaaatccttgctgcacacctccctgtgggaggagccctgagtggaagcgatgcaggcctagtgggccgaggtggtggggtgtgtgtttc

SEQ ID NO: 75 - DNA, 2217 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcac

SEQ ID NO: 76 - protein, 655 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 77 - DNA, 6358 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 78 - protein, 1204 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSIKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 79 - DNA, 210 bp, Homo sapiens
ggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggaagctacatagtgtctcactttccaagatcattctacaagatgtcagtgcac

SEQ ID NO: 80 - protein, 45 aa, Homo sapiens
MGENNTLVWKYADAGHVCHLCHPNCTYGSYIVSHFPRSFYKMSVH

SEQ ID NO: 81 - DNA, 2361 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccac

SEQ ID NO: 82 - protein, 703 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 83 - DNA, 110021 bp, Mus musculus
  misc_feature (1)...(110021): n = A,T,C or G
aatccaaactccacacgtgggataatgtaataaattaacaatacctgtgtatatactgttaaactatgttaaacctgtaaatttctaggtcagtcttatagacaaaggcagtgtttctacagtatacagaatcgtctaatcaaaacattcttcaatctgttacaacctcccctagacaccaactgaggagccctaacaaaactattatattgaatttattgcctaaaagacttctaagtcctctctgtccttcccatgaatgagtattccatttttttattacagacatctctacatcatgggataaataataagtcggagatagtctacccattagccgtccttgggagagcaatgtcttcactcttgggctcttgtgttgtctcccccttttttgtcacagagtcagggggccaacctcatccaggacagggtttctggggggacattttgagattaccaagctggagtctgaagtaggaggacaaatcccatctccagaggcagcttctctgtgagttctaagtcgatagaccccctacacagcggctctgcccctgcggccgctgcttttatctcagcagctcccatttggccccagaatgcagataagagtctagggtagcacacctggataattaaaaaacatcagaaaccatatggactaaactgtcttcttactgtgggcaggacttaggggggtccccaggagaaaagaggccccagacctcaacaaggccttttgtgccaaaggaaactgagctctatggaccagctgttcatctctcaggcactcagagggcaaacttagggattgagggaaagaaagagggcagtggtgggtagatggaggtgtgtggagagagacagcctgggtggaagtcccttgaagggtcagggcttgtccactggatggatacgtgagagaaagtctgggaaattcagtttagaaatttgagcttaaaaaaaaaaagtcctgatatgtagaaacagagtaacaaagggggggactttagtggagatgaaaggacccttggagatggggaacctgggaccatttgcaatttcactggaggaattttgtcaaagtcccacaaaacggtaggttccaacatgctaaatttaggccagcagttgtcaagggtgtattacggatagaacaggatccaacttgaggcccagctgtttcagttttcttaggagacaggccaatgggctctctttggggatacagggttcttgcccatgttgtagcttttggatgggctgaggttaatttcttaccttgaagtggcccctgaaaagttcccaagagtttctcaaggaaccaaccaggaggactgacaggccctctttacctacttctgtgtccgcagggaaaatggctggtgttgtgtgtggcgctggcaacagcgaagtttctcaagtggcagaggttggactagaacagtacttctcaaccttcctagcatcgcagccctttagttcagttcctcctgttgtgactctcaaccataaacttattttcgttgctccttcataaccgtaactttgctactgtttatgaattgtaacataagtttttcccccccagtggtcttaggtaacccctgtgaaaaggtcggtcaagtcatgaagcggttgtgacccagactgaggactactgagttaggagaaagagaagcaggtttaccattcatgcaaaaaacagagggcaagagtctctcagaaagaaagataaaggaaacccaggaaccagaggatggagaaagaagcctggtgggggaagaggcctgatcaggctaggcctgaggggagggccttcctggatttcagcactaattaatgtaagaatctgaggtaatcggatgcgctaaagaatgagtatccaggtcaccctcagcaggctttctattggtcggagaggttggcaaccccaaaccctgaagctcagtatccaagggtacaggaggatgcagcatgcaggggctgagaatcctagtcaagagaaggacagcagcacttttggatagactgtttttgaaatgtgaacagcaatatgaaccaaactgaccctctcagagttcccagggactaaaccatcaaccaaagagtacacatggagggacccatggctccagccacatatgtagcagtggatggcctcgacggtcattagtgggaggagaggcccttggtcctgtgacggctcaatgccccagtgcaggggaatgccaggacagggaagcgggagtgggtgggtcagtgagcagggggagagaggatgggatacggggttttcggagggaaaaccaggaaaggggagaacatttaaaatgtaaataaaaaaaaatctaacaaaaaatttagctcttgttctcttgctctcttgtttctctcttgccctcttgggctcttccctcctcctcccgtccccctctctccacgtgttcatggccagcctctacttctctactctcccctcatctctgcttttctctgcctctactatcctcttgactaccttccccatgccctgaataaactctagtctatacttaaaaaaaaaaaaattagttaaagaagaaaagaaaatgcaaagccgggcatggtggcacacgcctttaatcccagcactcgggaggcagaggcaggaggatttctgagttcgaggccagcctggtctacaaagtgagttccaggacagtcagggctatacagagaaaccctgtctctaaaaacaaaaacaaaaaagcaaaaaagaaagaaagaaagaaagaaagaaagnnnnnnnnnnnnnnnnnnnntgcaagtgtgagattagtaagactgctgcagtgctcaggcacatactagacagcatccactgactgcttactctgtgagaggtgttacctcacaaccttgattcaggtgccatcttgggaataaggcacagacaccaccctcctctgtgggtgaggcgcagagacaagaaaagttggctgctcagagaagggatggtcattcagagaggtggcatgtgcaatacctgctggagaccgagaagctattcatgctgtggaacttgggaagtgatagcgacaggaccatgaggggtctaaggttatccttggccacatagtgagtgtgaggctagcctggcctatgtgagaccctgtttcagaaacaaaaagaaaaataacatgagaaataatagcttttccttgtgtttcttcatacatttacaatctacctattccttaatcactaaagttttactatttagagagggggataagggagagagacagacagacacatacagagatagacagatacatacagagacagactgacagtcagacagacagacaggggagagagatttaaaaaaaaaaaaaaaacgaaaaaacaacaagagcatccacactcttagcacacagatgtgactgttgctgacacctcagcagacttctttccaacctttcaaaaaaatgtctttcttttgcctagctaaggttctgcttagatgtaattctggatctttaattttttcctctctgaacatcagagcataaacccttcatgttttaagcggctatataataatccatcatatggcaattacgtaatttatgacctattccttcacgattggatctttaggttgtttccaatattttcactattataaataacccaccatgagcctgtgaagcccataaatcagtgagcgaactgcagagtctgcagattttaggatcattccccagaaatataattactaagtgtcacaaatgtttcaaaagattacacggtgtttagtggtgtttctgataaatagcacatacgtccttttaaagataaagaatatccaatttttaaattttattttttatctgtatgggatgttttgcctgcatggtgcatggatgcatgcgtaccatttgcagaagcctggggtctctggaggccagaagagcgtgtaggatcccttactgatgattgtgagccatcatgtgggggctgagtcttgaacccaggtcctttgcaagaacagtcagtactcttttttttttttttttttttcgagacagggtttctttgtatagccctggctgtcctggaactcactttatagaccaggctggcctcgaactcagaaatccgcctgcctctgcctcccaagtgatggggttaaaggcttgtgccaccaccgcccagctaacagtcagtactcttaacctcttggccatctctccagccacaacacatacattcttcacaaacaaatggcaagcctttcaggtgcagaagttgcaagtcagcttgtccctgtgtcagtgtagcacagggtagctctaaaagacacaccttctggctctgggcttatatgctaaccattgcactttctctcctataagctacttttcaatttgttttttttttatttgaagtattgtgattcaaacatttttttaatggacaacgtatgtacatggtggatgcaaatggcgtttgtggtactactattttatttatctgtttacttatgtagtggttgcatgcgtgcacatgcccctgtgtagtccagaagaggggagtcagccaccttcctctattcttctgttatttttgtctttttttttttcagagctgaggactgaacccagggccttgagcttgctaggcaagcactctatcactgagataaatccacccccttcctctattcttttaagacagggtttctcactgaactgcaactatgctgactggccagtgaagttcagggacttaacctgtctcctcactccttccaacccgggcactggggttacaagcatatgtagctatacccagctctctcgctctttctcctctcctctcctctcctctcctctcctctcctctcctctcctctcctctcctctcctctcctctcctctcctctcctctcctctcctctccttccttccttccttccttccttcctttcttccttcctttcttccttccttctctctctctctctttctctctctctctgtctcttttttttttttttacatttccaagagtagtttatttcaaaactgtaaagatacatatattacttttttattacacttaataagtaattttaagcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttacccactgagccacttttctagccccttattgtactttttttttcttcagttcttccgtttatttaaacagttttctggggagtgcttggctagcatacatgaagtcctagatttgatcgctaacgctaaatgggcaccatagtggcaacgcacacctgtaatgacagcacttttgaggtagatggctgagggtcagaagtttaaggccggggctggagagatggctcagtggttaaagacactgactgctcttccagaggtgctgagttcaaatcccagcaaccacatggtggctcacaaccatctgcaatagtatctgatgccctcttctggtgtctgaagacagcaacagtgtatttatatacaagtaaataaataaataaataaatctaagaaagaaaaagaagaagaagattaatgccatcttcagctacttagcaagtttgaggccagcctgggataatgagaccctgcttcaggggaagaaaaaaaagacttcctttctaggaacactgtatccccaccttttcatctactcttttatatttctcagtacatttcattttattttctaagcagtggccactgtgttcccaggcgtgttggtagcttaaaggaaagaggtgcattttgcagttgcatgcatgctatggtttttttttttttttctgaatcgttcataacagcacctcagaaactagaggaaaagttgctccaggaaaccctgaggtctgtcttgtgactcaaattcttcaatttatgctgcgtccaacgccttgcagtgagagctgtctttcttacatgttgtgaaaggtgagaaaaggtgtgcttgacttcaggctccaaacacatacctgcttgcttggccagttcctcacaggtttttactctcaattttttttttctttgaggtttttgagacacagtttctctgtgtagctctagctgtcctggaactcactctgtagaccaggctggcctcgaactcagaaatccatctgcctctgcctcccaagtcctgggattaaaagcatgcgccaccactgtccggcttactctcaatttttaattcttaagaaattacatttttaaaattctctctctctctctctctctctctctctctctctgctccccttccccatgtgtgtatcaaactcagtcatcaatcttggaggtcagtgccttgacctgctgagccacttggctgggccccttcccctctaagtatctaagggcacatggtcattaaatacacagcaaatcattgtcagcaaatggaattttctcaacgtatgacaagactcatcttctttcttttttttttttttttttttttttggtttttcgagacagggtttctctgtgtagccctgactgtcctggaactcactctgtagaccaggctgacctcgaactcagaaattctcctgcttctgcctcccaagtgcttggattaaaggcatgcaccaccacgcccagccttagaccatttctatggtgatagcaaatgacatgcatgacagtgaaggactaaattaccccccccccattcatatgttggaacccaagccttggtgtgactgtacaagaagatggtacccacaaggaggctagagtccgtgaggatgggctcatacatagcacaggcttcctcagaaaaccccggagctcgctccctatacttgtatggacagggccaggtgaagacacagttgtttacaaacgaatagaagagtttatcagaatctgacctggtgacacgtggggcttgacactccagctttccaggactgacaaataagtctttaatgcctcagaccagtcacaccccttgccgcctgggggtgagaaaggcaactctctaagccactatctgcttttccattacagcagatggagagaactcacacagttcctgtccacaccaatggtaagaatggtttgatcccttccctctgtgagagccttgcagactcacggtgcattggttttgagagttcctggcctggttttgggggtgggggatggggaaaggaactgacaaatgtaggtgcgagactccccttccagagcctcctctcccttggagttttgctaaccaaccctatacagattatttctggctatctcttttttctgttcttcattcatcaactaaggcatgttgcaccaggctttgtaatagcaaatatacagactctaagtgaaacccagacattagctttgtgacctttggtgaggggacttaatgcttttctggtttgattcccctcccccagaggggagatagagatgaagccaatacctaccccctccagatggtcgcctaattatcactgttattctacactgtgtcaatggagtccagattagcctcaaattcaccacgtagcagagattaaccttgaactttggatcctccagcctctgccccataagtgctgggatcacagtggtgcaccacactcctggaattacgaggtcctggggatggaacccagggcttcatgagtgcatgacaagcattccaccagctgagacacatttccagtccacagcggactcatgacaagatcaactatcagaggccctagcacgtacggaatgtcaataaaagctaagtcctaagtgtctgctactgtaattttcttagtgatagccatcatttgtgggcttcatcttccattgcatcctaaaccctaaccatcccaaattctgctctctcctgtccccaacctatacagcccaaggcttccctccttctctgtaatcctgtctagactgtttcttgggcttggtgttctgtttctggagtacagaagccctgtcctctgggatgctggatcttgcaaccccaccccctccaccccccacctcccgtgtcagaaggcctggactaaaggcccagattggagtcccgataggaaaacaagttcttttagcactcatttcagtcccttggaattaactctttcacagcctgactccaagagtagtcaatcctggaaggtagagctacaaagagttgtcttggtcacccaaagcgggatagagtaaactagctacagtggggcagaagtgtgtgtgtgtgtgtgtgtgtgtgtgtgtgtgtgtgtgtgtttaacactttcaaccccagtcctgtaatctcccaggcctcaagaatggttgattacttcagaaattcggatcatcccttcccctgggtgtccttcacctgagtcagcgatgctcccggggggcttccctcgctcctcccactgctgtccctccagccaccaccaaccccctcctccgcgtggcgcctcccctcctcccattccaggcagagccctgaggggctaggggcggagcgtctgggatgtgggctgggtggcttttaggccggcgtttgcttgaaaacctccgccgccgctaggccgggggcaggcaatggcaggggatgtgtgattgcggacagtgagagggccgttgctatcatgcccgggcgcgcgggcgtcgcccggttctgcttgctggctctcgctctgcagctacattggccgctggcggcgtgcgagccgggatggaccacaagtaagtggcagcgcgcagatgggttctgaggcgactaggggtggtggtgatgactgagggtctgagagtcgctcttgcatgccggcagctccatgaccgctatccctgcggactccgccactccccgggtgtgagtatcgccacccccaagcctaggagcccaggctttgttctcttgtggtgagccacgggaggtcgtggagctagtgcgctcactgcaatcagaaagcagtaagtctctctctctctctctctctctctctctctctctctctctctctctttgcttgccttcctttcttcatctccccgtgttttcttactttgggcttctctttccgctgctcttcctatctttgctgtttttcttgaggttgctcgtctccgctctgcctctctctcatcgctattttgcgcccgctgctctagcaaccccagagcatccccagaggagcaccccaagcatcctatcccgaatcggcgagggaaccactccctggatcttgctgggggggggggtgtcaaaagcataccagtgggatagaaaatcaaaggtttccgagagattagggtagggtggtttactggttatctctgcctatacacttagcatctctgaaagaccataaaagaaccatgcgcacccattatgcagatcgtaagctgaagttcactaacaaaaacccaggtgtgtataagtacgccccacattgaagatctgatactggaaaccggagctttctttccacctcacccaatgcctatctcctcttggcctcagttttcatgtgaagaaaatggaatgggctccacgcttccagtttggacgctggataatgcctatttctcacaactgttttcccaggcaccgctccctcccgggccgcatccctcagaggttctcataggatttcgcggaagggacggtcccggaggggcaatgcctggcttctgtcatcttgacccgggagagcttatttagccttagctctgaggcagctggagagctgggctgactccagacggtcgcgggtgcttgctgtaccaaccgtcagcgtttttaaatcaagctaacgacgccctagtgtacgggctgggcaggctgcagcccccgccccatccctgcaagaacctgacccgagggtttcctccactcaacgctccagctcctttgccttggataggagaaggctcttccttttgttggggtgtggggttcctcggggaagagggagccaggtcctgttcgagtctgattttccagcctaccatttgcacagaagaaagacaggaaagtaaacttcacgggatctggaggccttgagaacagtcagtgaggtagagtgactgcagacccggggagaaagcaaaatctacgagttgtaaagtgacccatgatgcccaaatgagcagttgctattaatattttcctttcccccttcctgtccttctatgactatatactgatgaatctggaatcgtaccattcatacactttaaaaggtgcttcccaaatcatgacatctcccaaaactatgattttaatggctctaagttctaccaagagaccacagaaatataatttcctcaaagttaaactcctggctcttatacaaatgtgacgaagatttttttttctttcatttatgaagtggccaaagcagctgctaaagctggtcaaaagcatcaacataatcaatatcaacataatcaataccaacataatcaatatcaacataaacaatatccccggtgatacagggagtggcatagggaattcctttgggtgagacagaatcaagcagttgttggttctccctctcctatcctgaagtcacttgcatctttgtctgtcacaggcgtgcagttaatgttaaacttcaccgaatacaggccatcccaccgaaagcaaacaagtgagccagagataacattctcttaccctttgttaagtgacgctccaggtctgacactgaaagcttgatcccacgtgctctggccttattttcaagttgtgagcaacccttctccagttacgttgccttacgtgtacttaaactggactgtgtgtaaagagattgccctcagtgcttttcaccatccgagacctttagtcgttctcttctatcctgtacagctccttttgtttaagagtctagatccatcagtctctgtagaggactatgtctcacttgttccctcatgaacattaagcacctagcgtagtagcatagggttaagaactcaggatgttttgggtaaataatgtaaatgtatctatctcttctgatttgtaccagtgtaaacaaaaccaataagactttttttaaggatacattttgattgcaaatatatcatatttttgaaaaggaatttaatcagtggtaatccaacacttttttgtttgttttggggtttgggttttggaatgttgtttgtttgagacaaggtttctttatgtatccttggctgtccaggaactaggtctgtagaccaggctccctttaactcggagatcttcctacctctgcctcctgagtactggaattgaaggcctgcgccaccactgcctggctccagctacctttttaaaaaaattttttttttgggggggggggcttttcgagacagggtttctctgtgtagccctggctgtcctggaactcactttgtagaccaggctggcctcaaactcagaaatccgcctgcctctgcctctcaagtgctgggatttgggattaaaggcgtgtgccaccatgcctggcagaacctttttttttttttaatttaattcttctctgggacaggatgctgtgtaggtggatgctgtctcagagatctctagatagccaagatggccttagacctctagttgtcttgctggaattacagatgtttgccacaaaagctcagtcatcttttaatccctcctgcggttgatgaggctgagttagaaggaacagaacacagggttccttggtgacatctctgggagtcttcagatctactctagatagccaagatggccttagacctctagttgtcttgctggaattacagatgtttgccacaaaagctcagtcatcttttaatccctcctgcggttgatgaggctgagttagaaggaacagaacacagggttccttggtgacatctctgggagtcttcagatctactcagtttcagagatgtaatttgcttagggatcaggaaattcttatcttttaaaagatgacctgtagggctggtgagatggctcagcggttaagattgccgactgctcttccaaaggtcctgagttcaaatcccagcaaccacatggtggctcacaaccatctgtaacgaaatctgatgctctcttctcgagtgtctgaagacagctacagtgtacttacatataataaataaataaataaataaataaataaataaataaatatttttttaaaaaaagatgacctgtaagtagtgttgaggtcttccattcttgaacatggctcttctgtggcttaggcttcttttctcaggaatttgctgcctacctctatcagtcccactatgtcaactcgggatatcttaatggggaatttccttcactctacgacaaactcatagacccattcccaagcccttttagttgaggaaatgaaaattcacagcaacccattcccaagcccttttagttgaggaaatgaaaattcacagcaacactgacaggaactgaggctggagagatggtttagcagttaagagcacttgctgttcttgatagaacccaggtgtgtaggataagaaaaaaactggaggtgagaaggtttggaactaaggaagtgaaatataacttcgaattcaacacttggaaggttaagttaaggttaacaatttgcaagtgaatggtaatggttgggaggcgaagaagtcacctttacctctggccctcccagggaggtgagtgtcacttccaagggggaaattaaagctctttggtaacaaacctgagctcacacccttctgcatctcctcagcacctcaccacatcatcaccttccaggatgctatccaagttagagccacatcttctctcaccagagctccggtgcgccccctagctttgctgccaccctttctgcttctcctctgtccttgtcccctactccctattctcccagcaggcagggtcacctttcaaaacaaaaacaaaaccaatacagatcatactgctcttgtggggctttttttttttctctaaagacatcaaaaccttccaggtaatgaaacccagaccctgctcatgcctctatgttattacaaccacagccgtctcacttagcatatatatttcttaccaacatcctctgagttacccacccttgcttagcatatttaccaatgtcccctgactttgtaggctatttctccttcctgcgtgtgccttagcgagcccgggcccacgtctacagttgacactctttactcttccccagatttttgcataaatggcttcctctggtccctcaggtcttaaacatcatcacactggccatcctgtttaaaacaggaaccctgccagcttccctttatcctgtggcacaatcttattattcccccccccgccccccccagggctgttaagtagcacctgagaatctttgcttatttcctgactcttcacgggggacacagaccttgtttgcctagcctttatcactttgtcaccaaggcccagtggcgcccagcaggtcttctgagaccactgggaggagcattttccaggaagcaatgactgcctcagaagtgctttggagcaccacttgggcttctgaacaccatgcctgctcctgagtgcccgagatgtggaggttgggttttcttatggttatgttgtcttgtgttggcaggaggaagccaagaaggtagccctccgctacagcatgaactcataatacctcagtggcggacttcagaaagccctgggagaggaaaggtaagatgtccaagctccttggagaagcaggaatgacagttcctctagctgtgtcaacttaggatatcttagcggggactttccttcactctatgacgaactcgtagacccattcccaagcccttgtagttgaggaaatgaaaattcacagtaacacacgaactgggctggagagatggtttagcagttaagagcacttgctgttcttgatagaactggggttcaggtccaagcatccagaggatggttcacaatcatctgtaactccagttccaggagatgcctctgagggcaccgggcatgcatatggtgctcatacatatatgtaggcaaaacactcatgtgtgcacacacacacacacacacacacacacacacacccctacacacacacatacacacacacacacacacacacccctacacacacacacacacacacacacacacagagtcttttagaaatacacagattacgtgcaaatgtgtgaatttgccatagatcttgattggactttttctttttttggtttttctgtctttctgttttctgagacaggttctctgaaatcctgtctccatctcctggatctaggcttgaaggcatagtctagggtgtcatcatgtgccgagcccagttctcttttgaggcagtctccagtgtagcttaggctgacctgtatgtaaatcttaatctacctgcttccatttcgaaaatgcaaagatcacactgtgtgtcatgggtacccagcgattttctttttctcttttctttttttatttttattttttgttaataagaggcaagatagggagctaggattaggttatatatctcaaaatatcttcctgattccttggcccagagcagtagcaaaatacacagatgttgccaagacagtcagaacatggtccaccaagcagactcatattgaggatgttctcaaaagggaaatatggtagttgcgtgacagtaacgtcttatgtgactttctactttacttgagcttcctcatttacaaatccagttttagtgggaataaagaggaacagagatgtggagaagggctaactttctttttcagcgggaccttttatgtgtcctactctggcctctaagtggagactatgctgcttcaccttcccagtcctagcactgcatggataagcactgtgcccactttgaaggactcgtttctatgatctcttaggggccaaatggcctgtggtttattgggcaacagataggagcaagattaaagccagggaaggaagtgtcaggaaagacttcagacaattgtggccctggaatctggaaagataaacagatgagaaacacccagaattccttaagtgactgtagagtcatgcagacatgtcccccaagttcaccgcttgggcttagtaagagaacttaaaagcaggacaataaaagttgggaacattttacccgaaaagcaaagaaaaaaaaatcatgaactcatttcatcctaaagtaggaaaggctgaaaatagccttaaggaaatgctagacaaattaatggatggccgttctcaggcagattattttttttaagtgtaaggtcttgtatatttcatccactaccattattgccgaagaatggatatgatcctttttatagaggttcctttgttacctccagatgttggatgttgggcatcctcaggaaggatccgagaaacaaagcggaggaccagatcctgtcattgttcccagccattgtctactcagaatgtggctcattgtattctacaaggatcagcagcccagtgcctggcactataaatatatggagagagggagagagagagagagagagagagagagagagggagagagagagagagagagagagggagaggagtgtgttagtttactctgattcttatttgcatctgaataattcattgatttattagacatcgcttagacactgactgtatatgaagtctaatagagatttttgaggatgatgcatatacacaggacaagcttgtcccagatggtgtgtagctgtttaattttgccctcaacagaagggatttgggggtctctcagggacgtgtgagcattggggtcaccttccagtgcttcctcaggccctgttggagttccaggagggaagctgtccgtaggcgagctggacagggaagctccggagagctgagaaatgcagtttcactgttgtgttgtgctggatctgttccctagaaacagggaacatctgattttaaacctctgtgtctgagcacactccagaaacagagagaagtacttttggatcacctaaataaaaataaatattagctctcatgtgtcaagtaatgtctctgtggggggcacatggtatcacttgctcagtgccaagattcttttttccgtgtggcccgtcacatgggtgccaccttcaggccagggtaaggacttgtttgacttctgtagtcatgtgctcaaatgcccacaggggctgtgcgtccttgattctcaatgtgactgggcagggctctcactccaaaagtccccagggcaaaaccacaagtgggagccaccagccacttgccgaattagtgcttcagaattagggaagggagtgcctgggcacccatctgtctccctgcctcctgaatatcgaatgccccctcttaagatgaggcaacaggattaactgggtattggaccaggtacctgactggaatgttcttatctcatctgaggctttggtggtcttgaagtctgaagccaagatcccagttggggatgagtggagcaggggttaagagaacgaatgtgattgggctgtgggtgtggctcagtttgtactgagcttgcctgaggtcctgggtatctcgcacagtccacacttatacagaaaaagaagaaggatgtaggaagtgtcactggctccttatattgccatagttagcttaaagatttttttaaattttggtccatgttgtcaaattatttttcaaatggttccagttaaatttttcagacagaggatctcagggtgaccattttaaagtatgttccacacagcactgcgattcacagttttaaatggactatgtcacttttgatttttcttaggctatcctcttttttaaaatactctctctctctctctctctctctctctctctctctctctctctctctctctccnnnnnnnnnnnnnnnnnnnnctctctctctctctctctccctccctccctccctccctccatgagagaggacagtgcttactgatgatgctcagcactgctcttcaggtttattggccatttgcatgttttagatgatctgtgctgggtgtatggtgtgtttggccattgacaaactgcttatgtgtaagatacatctgactcgacttactatacaactctaatttgtgaggctttagctaccacccctttgatgattggagtgtccaaattgaggcccaaataaaagaaagcaaaatataaaagaactcacttgggtgtttttttaaagatgatagccagtgtaagattgacagcttcctttgaactaggcactgtgatacatcatttaccttcatttatttgttcctctagtccttaaggatcctcagaaggttggttattaccataccatctcatagaagagtaaagagagatgtagggaggctgggtgacggtccagggtcccacaattacaggtgacatcctgtacacacactgatccagggtctgactctccagggaatttacttctgagaaccttcataagactgcagtacacctgctcagccttggacctcagcttgagtgtctgtctctcctctgcttctgggagaaagcagatggggaagattcgggttgtttggggactgaggtcacttcacgctggaaaggctggtgacctttcctcgctggcttccggaggatccctgtgctggcaccatgtcagatccggtgctggggccctgggagcctgggtccctgcttccaggaactgacacgtttttattgttgtttttagcatccactcagagcagagctcagggtcatggctgaagggcgagagctgatcctagacctggagaagaacgagtaagtgggtttctcccttcttttgtctgacacagaacaatgaactcacatttgatgccagtctgacccaggtgtcccagttggaaaggaagaagtttagtggtgtgcccccccacaccacacccccccagcctccaccccgctccctgccccaagctcgacatccttggtccctttgcagggcctcttgccaagagagagcttttccttggtcttttgactgctgggagattggcgggatacttcacatcctgcttggatttccttaggctgtgtttccggtgcatcgtggagttcactggggccgaatgtgtgtgtgtgtgtgtgtgtgtgtgtgtgtgtgtgtgtgtgtctaagggcgggaagggactggaggcagctgctgctgtcctagctcccgctcagtgtatggcaggaaatgaaggcgattagagggagacgggagaagcagcaggctgggcagggatttggcacctctgaccctgattcttgcatctacccaagattctgctgagaagtgcattgcttgaagccgcctggcttcctcgggttcagcttttccctaatctcattcatgctgggcgtcggcctagttcagaaatatctccgcattgattcgccttccggcataactgtctcaattcatgggtgcagggttgaatagatgaccctgcccagctgtgtccattgattgactgcccattctgccgtcagccccagtcacctggcctcccagagctcctcctacttggctagggactctgaaggcttttataatttccccaccaatggtcccactttttatcgtccacattgacattgtagataaggatgcttggtttggagagttgcccgtctgctcttggcagcctccaaaacaccctggaagctgatgagtaatgaaagcttcgttgccaagaaggggctagagcaaggccttccccatccaaaccagtgggaatggctgcctggctttggtggaatgggagaagaaggatttattccaaatttgggctcgttggacacttgcagagaagtccccagtgctgtgagagggcagctggtgcagggacagggtgttttgtgccactactctatggagatgtggacgaacatctgtttgccagtgacaggcccaagtaaggatgccaccaaagtccaaatttgtgaaccagtaatttttattgggattgcttacagtaataggggtgaagggttacctatgggtacagaagtgactcaaaagatagcagcctcaccaaggcccacccagcatgggtaacaactcatgaaagctagaagcctgaggttcactgcatggcttgcaggcagctctggtggtgtgagcctggtccaaggggctgggctgggtttgggttgactagactgagcctcagggaaggaggtagtccttactgcttatatattgttgaggagggaggggtctagtgattctggtcatcttcaggaacttccttgaagccctgggttgtttattgtttactttctgagtttaatgagcttcccagcagaatggaatgttttaacacattctggagtaagcaccctgtgtcttaaaagagcatggggtttattatggaggaaattgctacataacacagagttctgtccctttctcttccctctgccgctggctttcatttcagcactcccaaaaagatagacatcactgccattttggctcccctctcccagagcaaaaccagccttttattggtttgctgaatggtttctttccttctcttccccggggatagctacccagtgtgggaagcgcctccttgctcagggcatcactttgactgtgatgctgtgctcctccaaggctcagggagggctagtttgcgcttggcttctcttagggatctgtttggtgccttactggctctgttgagtagctgcttccctgctcctgactgctgtccgtgtctgtcctatttaaccctcgctcttccccaagtccactgaattgatgatacgttcaggggccgagccttagctgaatcagctaaggagggacccttgtcctttccttctgtgttgggacttctgtagaagatcacaggaagttaggctaggaagatttctttagaacaagagcttccaatctgtggctcaaaacctctttcttggcaaacctgtcaccagaaattttacattgaggattcataacagtagcaaaactacagttatgaaggagccatgaaaatcatctatggttgtggggagggagaggagctgtatgaaagggtcgcagcactaggaaggttgagaaccactgcactagggactcctgagtgctgtggtctcgtgcacaagtacagaaacttcatcacagaaagggagagacacttgtctaaagtcacccagcaagtgtatgaagagggcgagtggaagtcagttgtgttcttggcttggatgtggagttgtagcatgtgacctaggtagggcaagctgaggaaatctgagaggagagtagtgatggctgcctcatggggtgcttgtgagggatgggccgagtgggcaaagcgtagaatgtgagcacgtggagttgtcaatatagtgattttttaaaaaatttctttttaatttgtgtctgtgtgtgttgtgtatgtgtctctgtgtgtatttgtatctgtgtgtgtgtgtgtgtgtgtgagagagagagagagagagagagagaacaggtttgaatatggatatgtctgctcagaggtcaggggatagcctcaactgtcacccttcaggaatgctgcctactttattttgaaacaagagctccctgggtgtggtggcgtacgcctttaatcccagcactcgggaggcagaggcaggcagatttctgagttcgaggccagcctggtctacaaagtgagctccaggacagccagggctacacagagaatccctgtctcgaaaaaaaaaataaaaaaataaaaaaacaaaacaaaacaaaaaaaacaaccaaccaaccaaccaaacaaacaaaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttcttttcttttcttttcttttcttttcttttcttttcttttcttttctttcctttcctttcctttcctttccttttcttttctttctttctttctttctttctttctttcttttttgttttttttttgtttttttgtttttgtttttcgagacagggtttctctgtatagtcctggctgtcctggaactcactctaaagaccaggctggcctcgaactcagaaattcacctgcctctgcctcccaagtgctgggattaaaggcgggcgccgccacgcccggcttgtcctgatctttaacatacctactgaactgctaggggtttttcataggtgccacccattgtctgcccatggcctccaccaactcccagggaggcccgtggagatatggttcctggcctcctttagcctaccgcagcctggagtggaagtggcacagccaaacagcatgatctcaccaggtgtccctggggaaggacttcctgcttttctcatccaaattgggctttttgtttttgcacacgtgttgccgaactgaattcactccaactgcactgcacttcctggtgtggctatttttccccacgtcctctccttcacaggccgccaagcccagactcaaaacagctctgggctgaggagaggggatttttctgagttttcaagttactatgttaacatttctaccttctggtggtatggaaggaatctaggtccgtgctcagaaacttcccaagccttgttcgtttcagctcttggtggatgcctctgctctccctgtctgttttcacgtgaactgtgacgttctgggcaccagggtaggtccctggactcgagttgagctgtggggaaaagagttctgccagcctgcagctcttgctagagtcagaagggatacagggagtgaacggatagtgtacaggatatcaaataatgagaattgtatacaggaagcaaaacactgggctcaggaagagcgggggtggtgggggtggtgggggtggtggggggtgggagggagccgatgttgatgaacagcagtcagaaatgatcatgggaaatctgagcagagaactaaaggagtgagctgtggagacagctgtgggagagtttcaaggagggaacagtcaagttcagaggtcctgtagattacgaggattttagcatccctatcccacttctctgttcattggattctctggtctcccgggagccacagacaagggtttctgagacaatggtgaggggaaggatattgaaatttgtttttcatcactctgaggtgtctggctttttccccatcgatttaaagtcctcgtgctaatgcacggcccgaaatagcagtgagcgggtccttaatggaattcacacatggagaaatcatagccaagaatggtgcgggcagaggagctggggtgggggtggggtgggggaaggaggggtcaggagatgggacgtggcgggcggagctttagcggagtcagagccagggcctactttttctccagtttgaagccgctcaggacaagcgggtcatagctccttttctgtggagcgctggcaaaacagatatggccctgtgagaaaatgagcatgtggcttcacgttgtggctcgcatttagatgctgaccttaccattcagcacctacattctctccctttaagtctcagtcccttcgcccaggactataatcacagtcctgcatctcaaagcgtggggaggctgagatgctgcgtgtgtataaaggacctaacccagtgtctaccttgtactgcacactcagtaaagggcaactattatcatttcttgctccactgtttgcaaattgcacaagtggggcatgttcagtatagaacacatagcagtgccaagcaaagaaagcagtagagctcactgctgtctgatgggggattttctagacctttcttgtgcctatgagagcgtagatcctgtcaacatgcagtctcagggaatctgatacagacgtctagggtagctggggaagaaaaaaaaagattaaaaagaaatttatatttatttcttgcgcatgggtatttttcctgcatgtatatatgatcaccatgtgcatacctggtgctctcagtggtatcaaatcccctggaactggagttacatatggttgtgatctaccatgtgggtgctaggaatagaagccaggtcctctggaagaacagccaatgctcttagcctgtaaggcatagctacagcctccagaaaataggtttttacccgtataaacctattctattctgttaaatttattgtatacacatgagtgtcatgaaaactattctgctcagtctcaggacagcattataatgttatttactataatatctaacatatacaagctacagacctttggactgctgcacagttgttaggagacagtcagtcccttgtcacccaggcatcccgtctggtggacatagtcctaagctcatagaagtaacttagagttgacgaacacaccagcgccccctcctgagcttcaaacttctcatctgtaaaatgagatttttgttcaagttgggcttcaagagccttcctgtgttacctatttaaaggacgctgtctgcgtggcaatgcgaagttcctgcttcaggagagcccctccccccaaaagagtctacagcaggatgcaaagaaacggtctccaaccatgtccttgaagttggggtgaactgttagcttaggtctcaccagttgaggcggcagaaagaagagaagggaggattacaggatggaaattacaggctcctagtcacagcctgtaatttggtggcatacatccataatattttttcctctgtgactcgcccccctgttctgaggactgccattaacctaggggccgtgtctgacaagccttatgtgctgttcaattagagacacttttcttgtgctgaagtcatcttaggagacagactcctgggggctgtggactctagttctcttgccccgcggcaaccttttctaagagaaactccactaacttgttcaagctgattctaagacagagctgaaccagggggcaaaaatcactgtattacaaggtcaccttcaacagcaatgaggaccggggatggagctcagtccgagtacttggctagcatgcgtgagcgaggccctggattcaattccctccctgcaggatataacttagccctggtggtgcacgcctgcaatcccagcactgagaggtggaggagggagggtcagctgctcaaggccatcctcgaatacactctgaggttgagcacaactgggctatatgagaccctgtctcaaaaacaaccaggatgtcaccaaccaacgaaggaggaacagtgtcagcactatctgtgctgtggccgtgtcctcgccacttgtcccctgagcacaccccgaggctgactcttctcgcttgaggctactctgcggacttgagtccaaatcctagcgatgtttagaattggtctcgagaagggatgtggcaggtggtggccgcccataccattggtgttgcatgaggcagaggcaggcccatctcagtgagttcagggccagcctggtctacagcgcaagttctaggatgtcacaaagaaactttgaaaaactaagaaaaaaaaagggggactaggggaagaagaaagacagagagagaggtcctttgatcttaaggtggaggctcctcaataacaatggctctctgggctggtttatgctgtcaatactaaggcagaactcaggcatgtggagcttaggggtttaactacccattataacttttgatgggttagagttttaagagtcttactattcactatgacttttgacaataagctttcttcctagctcagctattatagataggaggatggttttattgtcctgaaactttagagtcagcttagaaaattaagtcatttctgaattgttttgtttttgcctctctctctctctctctctctctctctctctctnnnnnnnnnnnnnnnnnnnnctcccttccttcctttctctttgttttctaaagactgggtcttactcgatagcccaggatgtcaccaaactcatgacaagcctctgccctctccttcccatctaaggagatcacatctaatgagctgccaccatatcagtccacagccacttgttaccagcctccctttccccttagccctagttggatcgtttaatgacagaggggcagatgcatggcgaatcaccaggcagagggtgctcttcagcagacaactcaaattactcactgcctctcattctcaggtttgtctttcttccatggaattctcttagaaacattcagccagttcaaacaggacggcactcctgcccccgcgcttcatcccagcaccttctcaggtggggacagatttcaacatcttacctagagtcaaggacacctcactttggccctgtctggtcagaaatttcatctggtcagaaattctattggttgttggcaaaattcaatttcctgggtcaaagagacgctgggaaaggcttagctggcgacccagtgcccttaggagaccttgctttgctgagttgcattaaaatgagtcacaggcatatggattacatttcacttaaaatacacatggcccaagaaattaaaggatagcgtactttaaccaagtatttggcagatctcaggtattccaaatgtttttgcaaagcctgtgtgcagctgggctcccgggtccctgcagttaatcctgtgagacttggtgccaaggaagcagctgagtggctgggtggggagaacagaatttaatgagagctgcctgtggctatctgaaaatttccgcagacgtatttttgggtgggaaatacggagaacagaaccaggcctactccatccaaggcgatgaatggatgcatgcgttaatatgaatgcggagtgctgttaggccttgccctagcgtgacctggaagttctgtttgagttgtagtttcccactgcagcttggagacagatttattacatcttacagttcccatgtgcagaagccctgacatggtagagcaaatggaatgtcagtgtctgataggatctccgtgcgagtcagactattctcagccacacttgctcaatagcaggctgtctgattgccatgggctgggggtttatgtctctttcaagcccatgtactgaaaggggatatgttaggcatggttttataaggtgattgggtcatgctgtctctgcccttcatggcttgagttaagcggccttctaagagcccccaggaagctagaacacacttgctatgtgaaagtgcagctaaaatcaacatctacttagcacagtggctcttggccgatacgagctattctagaatcgtgagacattcatttctgttggttataagcctctctgcttgtggtattttgttgcagcagcctgggtggactacatcttttccaaatgactggaaacaatacctttttggggtcgattgttcagagctggtctcggtattaataattgcgagtgctctcttgaagtcacgccctgcacagtcaaccagggtgtcagatagcctccaaaatggaaatgaccaagtgtgttgacactgagccccagaggctctgcttttttttttttttttttttttttttttttttttggtttttcgagacagggtttctctgtgtagccctggctatcctggaactctctgtagaccaggctggcctcgaactcagaaattctcctgcttctgcctcccaagtgctgggtttaaaggcgtgcgccactactcccaggaggctctgcttttaaggcagagagggatttgatcgcaggcaggagagggtggtgggaccacatacacagagcataagtgacgcatgcatgaatgagctgagaacggtgacatccaccgctgctggcagaggtggagactgttgaagcctggatctttggcacagtaatgctgattttattcttttggcctccagggctggggcgaagaaaagcttctgtggtcttaagccactgaacccaaaacacaaacacgaacgtgtttatggcttagagatgctgggctgtatccctctagtcagtgtctgtcatgtgtcaagtaggttttcagtatgtgttaaatttattttaaaatgactttgttactgtgctttatgtgtatgggtgttttgcatgcatctaagtctgtgcaccacgtgtgtacatggtgcccgtggaggctagaagaaggtgtcagatgccctggagccagaactatagacagttgcgaagcaccatgtggattctgggaaggacagccagtactcttaactcatggagacattactccactctcctgtgttaatttaattttaaaaaataaagatttgtttctctctccctctctccctctccctatccctccccctctccctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatatgtgtgtatatgtggtatgtgtgtgtgtgtctgtgtgtgtgtgtgtgtgtctgtgtgtatatgtatgtgtgtgtgtctgtgtggttatgtgtgtgtgttactgggaactaaactgagagcctcatctgctagcccagcactcatccactgagctatgtctttagctttctttttttacttttcatttttcagacaggtttttctactaagttgtccagaatgcccttgactgactgctcctacatcagccttccaggtagctgggttttcaagcctttatctaccacttccttctagaacatcttttctgaaaatcttgatgatgcaaggcattaccactgagaaaatgagaagcacaaaacatattgagaaacctgtgtgtttgttacctgtcaagtctttcttaagttctgggaaccgtctcttgataagagtccactctgctaaagaacttaggggggagggtaactagggatggtggttggatgttaataatggtgacagcagtaacactcctcactgcaaatggacgtaaccggtctggtctgcagcctttacatagctggttagtgccattatcacagtcactgtatgagatatagggacctatgctagtctgtttgcaaaaggggtctctgaaatattatgttttcaagttcaccagggtgagaggtagagataaatgtgagtctggtctgtttgagtccaaagtccaaattggtctaagtcagtcagtcagtcagtcagtcagtcagtcattctgtctatctgcctgctggtttgtttctgtctctctgtcagttccctctgcccccacccccacacactctctctctctctctctctctgtgtatgtatttatgtgtgtatacagattcatatttgtgcacattaatgcaggatgtatagaagccacaagccaactgtgggtgttgttcctctggagctatgcatcttgttcttttgagtcaggtctgtgttttggagctcggcaagtatgccagaggtgcccaggcatccagatgtttcttcctccctagcactggggttgcaaacctctgcccccatgtgtgcatgttaaaagcatggtttctgggaaccgaactcaggtcttcacgtttgtccagcactttcctgagtaaactgttgctcccaccccaaagtccaagcctcttaaccactgaaccgttgtgcctctctgacttagtgtgctttgaacatttcttggttaacactgtgcctagcatcttcactgtgtcttttcctttcttcgtgtctcagttacggttccccttctgtggtaaaacaccgtgtccaaggcaacttattaaaaggaagtatttaattggaagcttgcccacagcctcagagggttactccatactccttatgtaggggatttgagtttgcagggcgggcaggcgggcaatggctctggagcagtagctaagagctcacatcggaacgttaggctgcaggcagagaaaagaaaaccagagccagggatgggcttctaaaacctcaaagcctaccccagtgacacacctcctccaacaaggccacgcctcctaatccttccctaacagttctgctaactgggaacaaaacactcaaatctatgagcctgtggagaccattctcattcaaattaccaccttctctcttcccaagccttgactggaactagaatgtccatgtaatgtgatagggataattcagactggtatggaccagagcctggctcctcttgtctgtagaaggtgtgaaggctagtattatcagcttgacagagtctagagtcacctaaaagacaggactctgaccatgcctatggggaattatcttgattgtactggggtggaaaggccacccaccatggacggcaccgttcgctgtgagctatgtttgtagaggagaagctgagcagtgatatgcattcatagcccttagctttcttatgatggagacagtttattacttgaatgtgacgtgaccggtggcatcaagtccccctgctctggattccccaccatgatggacatacccatgcactgtaggctaaaataaattcttaattctcccttaagttgcttttccaggggtgtattttttttttaatcacagcagtaggatgaggaaannnnnnnnnnnnnnnnnnnnnnnnnnnnnnnnnnnnnnnnnnnnnnnnnnnnnnngcgtaggctttgccaagttctctaacctctgtttccttatccataccatagctagtcgccagtgactatggatagatttcaatgatgtaatgaccttaaggagctttcagtgcctggcacgctgtaagtgcaataaatagccattattatttgtattctgcagggtcaggaaaacagtgaggaatgatgtaagagggaattccccagagctgattccccaaatgcaagaagaagagttgaccttaaaatccactgccccaggaaggaaactcacttctgctctccagccatgcccaggttgacctaactgtatcacaaacatgaatcgtaacagccgtctcctgtgtgggcccaactgtacctctttctgggcctgtggagtcagtccccaggactctcatattgaggcctgaaccttcctgataaggcggtggggatgggcttaccagttctgtccctatctcttccctgggcttgcagccagggctgcccgcacatcaaggaaggatgtgtacctcgtcttttgtctccagcttagttcttctggctgccccttcactgggagccagggtaaaatgaatgggaggaagctgtcagctgccccggtggcctcagatggacccttgcggagctaaggggaactggggacttggaagacattggggactgttatggactgtgagcatacttactcaccaggctgttgatctgtagatcacaacagcccaggggatgagctcttaccatgagcttcatgttttacacagacttgcttaactctgtatgtttacccaaatggagtcctactgggtccttgattttaagacctattgtatttcccttggaaatataacatgggcattatcagaaaccattcaatgttattttggggccaaaaactatataaatattgaagttatgggtttctttttttaatgagatcatacttaatgtataactttaaaattatttgttgtgctagcttagttttttgttgttgttttgtttgtttttttgtcttcttggtaaaaactagagtcacttaggaaaagagaacctggattgatgacacactaccatcagattggcctgtggaacattttattgattaataatcgacatgagaggcccaagcccactatgggcggtgccagccctaggtaggtggtcctgggttgtatcagaaagcaagttgacaaatcccaaaagagcaagccggtaggcaccattcattcctccatggtctctgcttccattcttgcctttaggttcctgcttgaagttcatagcagactatgaactataaggtggaataaatcctttccttccctggttgcttttgtttgttatgcaataggtagcaaagtaagacatttgccatcagcatttttccacattagtccatctgtagtggtgtgtgtgtgtgtgtgtgtctgtctgtctctctgtctgtcttattggtatgtggtatgtgtgtagtatgtgcaggtaagtgtatgggtacatgaacctatgtatacaaatgagaagtcccacattgggtgtcatcttcattgtcttacacatgataggatcttccgctgaactggaagcttgctgtttgggctggctagtaaactgttgggatcttgtctccaaaccaaaatttgagttttcaggcatgaatatctatgcctggagttttgcacaggtgttgagggtttgaaattatatccttatgcttgcagaataagttcaataatccactagctactgtcccagccctatttttattctttataaatggagacacaggagtccatggtgattaagatggatcagaagttactgtttttctagtaagggagagtcgagtttctgatctctcgttactacaaataacactgcagtgacaggtgtaagagtctttaagtgtttgtcagatctttctataggactgatagagttataagaacatatggtggttatatttgaagattgtaccatttcacttgtatatgtctgtgagaatatattatggatacatttccatatgtacttaggatcatttaaaaatgtttatgtgatattatattgactacttatataagataacgacacagttatcttgtatttttaaatttaattttagtttttgagggtttacttatttatttttcttttatgtgtatgagtgtttacctgaatacatgtctgtgtactatgtatatgtagttcccatagaggccagaagaagtcattagtttcccttggactggagttaacagtgtttgtgagccaatgtgtgggtgctgggaattgaacctgggacctttgggaaagtagtcggtgttgttaccatttggccatctttccagccctccctgacaagtaacacttcacaattgttagttcacaattcaaatttcaatttgtgagcctgaaaagtgatcaggtttacaaaacgccgccgccgccgccgccgccgcatccttaatagttgttttactaactgctttgctcactgctgtgatgaaatacctgggaagaagcaacatatggagggaggctttcatggctttgggtctgaggggatttagtctaacatggcgagacctcatgaagtaagcatgagttggtcacacctgggtctagtcaggacagcacttccctgacagatggggatcgggtcaagggaacttgccagtcacacttgcatttctgggggcagattgccattggcctctctatacctttacacgcttttttcccatgatcccatccatggtatcctttgaaacccaagcatttctacttctatttcacatagctttgttgataccaactgtgcatcgacaaccatttaccttactcatttaagacaattagtttggtatttttttcattgggcagctaccaccataatctaacctagagtcatttccttcattccaggaagaacccattagcagtgttacagattgaattgcatcgttatctgcctacatgcttatgttggagcctgactcctgagtaatcttatttggaaattgagtcacatgtattttgttaagatgagtaaggtggactcctaatgcagggtgactggattccgtatagaaagggagtcaggacacagacatgcaaagaactgagttctaatgccacaagttctttccttctaccctttgggacagagggattgaacttgggtaatcaggtttggcagcaggtgcctttactcccctagccatttgctgacatgacaagatttaaaaagttaaaaaccttacatgctattgctcttgattgtcttaaaataaaattagatggggaaaaaagaaggaaccaggctgggaagggctctctctgtctctgtctctgtctctgtctctgtctctcatgtctgcagtcaccataggaacatgaccctgctaacctcagactgtggttataaacgtctgggttttgagccacttaatttgggatgctttgttaagacaggccttccccttcttcccctcatcagtctataagccacagacttcaacttgctttttctagattttcccagtctgggtgattcatataagttcattaggcaatataccctttctctttctctctctgtcccctgctcctctttcctgctctctatccccccttctaccttttcccctttgctccctctgtctattccaacccacccctttgacacagtttctcatgcagtccaggctggactcactatgtagctagccctgagctctggatcctcctagccatgagctccggatcctccttggctccattcccaagtgccaaagcaacaaggttataccatcacatctggcctctgggctctttcctaattgggtcttttacttaggtctgtgtttttgaggtttatgcatggcatcgaatgtcttgttgttgttttttaagttgctgtatatattctatcctatatgtacaccagcttataatgtcccatttatctaccagttgatagatttccccgttgaccctcagctaactttctgctctttgacgagggggctgctgattgggtacctctgtatctagctctgtgcttggcactgtgtaggaatgggaacagttatatttgccctctgtaggagagataataacaaagcagagctgaataaagtgctgcaaggccagaggagagagggtgtctctgtctgtaatggggtcctaggaggattccccgacagggcactcacttggagctcagtctttggggataggggctgctttggatgacacagaaagaagggatgaatggaagaatcaggaaggaattaagactgggaagatactatataaatatttggtctacaccaaggacctaagtcttcatcatctgttaggaatccagcatccctaagtagccattgtttgtcctcttaatgatgtgttaaagttggggaagagaaggttggtttccccttcctcagctgggcttccagaagattcaagtgacagacagctcaatattcctctctttcactttagcatttgagttgggttctcttgtttggggccaagcatacagccagagaggcaagcagagcttctagaaagatgattgaagaatatttgacaactctgctttgaatgggaagcgttttttttccccctccatctttcctagctgaagcgaaatgtggattgaaccatgggggtgaatatgtgtctggggattctaggcattgcaaggagctgagtacaaggctaagatggtgtcctctcagcttgagtgggtgggatgcatatggatggagggatggatggatggatggatggatggatggatggatggatggatatacatttgggcagagcactgttaagtcccaccaccttctcctttcttttctcctatctctaagaccatgactcttcagctaggctccttggacatttgaggatattttcttcctttaaaattttctgcttgggcaatgaatcatgactgttctgaggggaaacctgtgagaggtgaaagcagcattggggaccctggagtaacactgtcagggaattgacgttttatccaggaggtattttgattttaaggaaataagctttgcattgtctccatttagggcttagtcacacatatgtgtatacacacacatacacacaaatgtactcacacattcgctcacatgcactctcctgattactaaatactaaatgaataggttctaggttgggggtgagatgtagtttctgcctaaatccagctagggatgagtgttagcttagagacttctggttttttttaatggaagtcactagggtcctgggttgagtttagacaattcattgagaatctctctctctatctctctctctctctcctacccttcttcccttccctccttcccctcttttctcccctcacctcaagttgtgtgtgggggaggtgggtgggtgctagtggatgaccttggcggttgggtcttcaaggaccactcaccttttataatttttaattgtttttgacacaggacatcttattgttctgaagttcccaaagtatttggccattgaaccccaggaatcttcccacacccccagtattgagtgagattaaacctgtgcgccaccatacctgactttttaaaagtatgtatctctggggattgaactccggtctttgtgcttgccttgcaaacacttcatctgtgtgcaaacacttctccccagccttcattaagaattcttcattttgtccttctttccttctgtcctgtcattcagcacatactgtgagtgccaactgtgtgtctgatattcttgggctaagtagtggcaaggacattctctgacatcgagggatttcgtgtcgagtggagaagacacagacaattacagtagagcaaggtgagctgctagggtggagaaaaacagaaggtgctcttgggagaactgatctactgacctagatcaacgtcttaggaacttcttagaacaagggggtgaagaaggagtgtggtgcagtctgctcatgatgactaaatgtctgtgtaccatagttcttgtaagaaaaacaaagactaggtggaagatgctaagaaattatactctctggttaggacatcctgagcagaggaaggaagtgaagacaggcccaggggtagggggtgggggtggggaacacataggcacgatttcctgaagagccttgccagagtttattttgagagcaatgggaggtggtagaagaggcggataggacagacagctccaaatacaccttatgtctgatatggtgacaagatgacccatatggagagggaaggatggattgctggtttataagatggagtcatggagatggggagatagagcaaatataggatgaagaagagggtagacagacacaaggtcttactgtgattttccattgagtaacgagtgagacatcagtgtcaagtcccagggtttgtccttaccttctggtgggacctgaaataggtcaaattcttactcagatcttgttttctctcgtttgatgaagtaatgactgtcttcattctgagagtcacgacctctgtgggatcgaagcaagatctgctaaggaaattgctgtaaaaactcaacctgtgtccccatcacccacacttacctcccctagttgccctgtcttatctgagttttggtgttcgagtgtgtgtgtgtgtgggtggggggaagtgtgggattcccatgctcatgtagaggacagaagttggtatctgttgtctttctctatcgctcatcgtctccttgcttccaaagataaggtcttatcaagttgggagctcgacagttgtctagcctgtctggtgaacaaattcccaggcgtccttcagtctccgtgtctttcagtgagtgatgggatctgaactcaggccctcaggctcacacagcaagctcgttacctgctttgccatctccccagccctcactcttccaaacttctcagtacctcacttctcaggagcaggcctctgcttattcaacagtagagacttcacttgggagccttgctggggcttggaagtgtctcatattggcttttgtggcaaacagcaatacctctgagtggatgaagtttagctaggcactcctcagcttcttgactaagccgggtggaagctgggtctttctgatttaagggagtaaggctcttttccggtctcttcatggcttccatgtgtccccatggatttcctcccctccccccaggtagcgtgtttggagaaaactggcagggacctcatagtctcctcttgcatcagcctcccttgggagaggtccagatgggccaaggggctataatggctgcattatatcaagcatagtttctttttttcaaaacctttcaggagaagggagttctgggaaaaagaattcctttggagagacactgaatcataaaggaaagagtgatctaagcttggaagggccaacaggggccctgtttttctggaagctctttatttcttgccttaaccagattctagatttagggtttacacaaaggtcagactagattgtgagatatgtagtataacaatgtggttgggacgagtagagcaagagactctcagctcccagtgtctaggccagccttaccttcagcacacatacacaaacttgacagtacccacacaactatacacacacacactcacacacaggaatacatatacgcatatatgcacacttccctcatagttttataactagaggaaactagaggtcggctttcataccagttctaaaaagaaggaaggtgggtttgaaatgggtctgagtttctgggggactttctggtaaaacctgcctccacgtggcctgtcagctcttttcaggtattttcgtggatcatcttcatcctgggagagaggtaggtccccgcagggtaggagtgataccagcctttgagggctaatgctcaacaatcctctagcacggtgcctggcatatggctggccttagtcaatatttgtagtgtgaggtgggttgcagacgtaggtcctggagccaagcacttaaagtaagtgtatgacgaaatcaggacacgaggaacccaggctttcctacagcctctaatacatactacgagcgaggttggacaaacgcccttcctctgccaactcctgacctagctgccaccaggatttcacatatccttgtggactgagacttctgtgtttggaaacagattagaactttcatgacaatatgttacttttactcttttcagattccttatctgtaaaagggaaagactgagcagagaggttagggcataaaggttttttcattattatggtagatgccttgctttggactggatccggggatatcggctggctctttgggatctgctgctgggcagggcctctgatgtacttgcagtgtcactcaccatgaccttcagagctgagaccttccagtcctggcttgtgaccaggtcatttggctaagttagagcaagaaccttggccaattcctagtatcctagtctgcagtgtactgagatgggaggattcacctaaattcaaactaggccactgtcatctggctagaacttggcccaggtgctaggcagggtaggatagtagcctactgtggtccatgaggggccctttcagtggtcctcacttgtgttctgagatgctaagaatcccagggcaggtttagaatagttctcaagtatttagccagaggcacccacctttgagggtgctaagtttgtgttttcagatacccactctgtcttgtttcagggtcagatatacctggtcccctcttctgagtttcttaaaagatctggtggcttcttggagattgctttcctccgctcccccaggctcagtcataaagtctctcttcatagtatggcagtcttgtcctccccccccccccagtactcctccccaggccgctgtgacttcagctaatctgatgaacagcaaccatgattatttaccaaatactggttactatacaggttgctaccatggggatatttcttgctctttaaaatttggtatttctgagaaaattttatttccccgaaccattcttaaccaataaatgttcagttcaggacaggctttgtagggcatccttaagcaaacccacaaactcttatcggtaagccatttcctgggcccctcaggtgtcttgccagctagctaagcttgcctgatcatgagatgtcaggccctctttgtactgatggatattcatgttcatactcacagtggggagagagccatggagaggattaaatagatcctgctggctaaaggatctggttatccagacatgctttgggcataacataaaaactgcactcaggaccaggagctattcagaggggtgtgaggtctctggaaaccagaaatacaatgggaagtggctggtaaaggggactgttgctttgatgccttgtgtaaagatgtcctcaataggctgctaaagacaacatacccaaaattttggctttttgagagctgggctggtgggtggtaccatcttgcttaggttggtccccgagacaacaggggccttgctcaaatgggaggagggctcagctcttcactataggagcaaccttcagccttccagggcccttctgagccctcacaaaggaatgctggtgcttgtgagcccctgaaagatcagtgccttatttggcaatggggcttttgcaaatctgtttccattcctttagagtcagaggtagaccaagcaaagtgcaggctgatttggaaaatctggttctttttctctccttacgtttaccctactggagaaccaacataaaagaaaattatacgtatgatttctttttttctaattctgcccaaaatgtgaagtagcacaggccatttcattagagtaacagtctgcctttcagatacacttcctgtcctggggagttctaggtggcaccctttacgtttaatggaaacctggggttattgttttccaactgaatggaaatatttgcagttattgagtcttacactaaagcctttatttacctgtgaacacctgatgttacagggttgtgtgagcggtagcctaattcactgtgagtagttccctgaagccaggacactttgatatagagtcttgacaaactttggtaggccttttcaagtctgagtcttgacagagtatctcccctcccccacagtcctcatgaaccatggtcatccttgccgtgtgccatggcttggaaggagaggccagtgcagcgggcactcaatccaaagccttcagggtatatacgaggtgtgtgctattggaagccttctggccacatagctatgaatatagctggttctgtatttgtagacaatgtcctagtgcagtatgaaaaccagggacagctctgggtccttctctgatgggctagtgtcatcattagatcctttttttaaccctcacacaaagcaatacctatttctaggttgttttgagagtttgtggagaggtgactagaaggttagggagggaacccagaaggttaaaaagttaaaatgagtggggcagtagtggcccatacctttaatcccagcacttgggaggcagaggcagaggcagagaggcagagagagaggcagaggcagagaggcagagagagaggcagaggcaggcggatttctgagtttgaggccggcctggtctgcagagtgagttccaggaccccccagggctatacagagaaaccctgtcttaaaaaaacaaaaaaccagctggacaaggtggcgcacacttttaatcccagcactcgggaggcagaggcaggtggatttctgagttcaaggcctgtctggtctacagagtgagttccaggtcagccaggctacacacagaaaccctgtctcaaaaaacaaacaaacaaaacaaaacaaaaaaacccagaaaccaaaaaataaaacaaaaagctagaaagaacctaacagagcagggtggttcccagagcacccccccccccccttaaaaaaaagcatcacctggaaaaaactattaaagacgcagatttcttactatggggctggaggacttctggggctttgtattttcgttctcaaagcctttcctggtgtgattgggccagagtctatgaccttaagagtgagagttaaaaatggaaggcagctatatatctgtccctgtcctggacagggtaaggacccacccctaaccaccttccaaccccctacctaggccccagatcaatagtgagagtctggtcttcgactccatgtgtccagacacttggatactctcaggactagacgcactaggggagggcagcaataaaatcagcccgggaaggagcagagacacgtttgttcatgcccggcacgtgggatgagggtggttttcaaggtagtttgtaaactgtctttgtaccaggttgcctatgtgatgctggggaacagtgacctggacccctggacctggaggaacagacagttaggagccaccaagtgggtgttgggaacttaacctgggtcttctataagcagcaagtgattagaaacatggaaccatctctctagccccctcccccctccccgcaagatggaggttctgtttaaggactttggggtctgggagactaggggtttgcccctgattagggctgcagtgtgcttttgccaccatgaggacaaagacaccatgaggacagcagatcctcttctgctactctcggcctgcccatggtctccttagggcagaagagacaggactgaagataagggagtacagcagagtgttttctctatcagtcagtgggggagggggaggggagggtgggaatcttggataggcttcccctcttcctggatctccacacacaaatcatttcctgaaaaccctaatgcatgccagtggtaagagacagcttcctgccaccatgctgagccagccccctatcagagagatgagagaaagatgtagttggagaagggacatctggccactcagtgtccatgtatgtggtctcttctctgggaagacgacaacaacttttgtcctgagcacagtgccagaatccccctgcctggacacatgggaagattcagccttctcttggggacagcggagagcctttaaaagcagtgctttgtccctgttggtaaagttgtacagatggtgatgaaacatgacccctttgcttctagaaggagggaccttcctggctcacatccttagcccattcagggaaaaggttatttagctagaactagcccagaatttcttactttaagctgtcttgctcctgccctgtgcttagcttaccccatggctcttcaatgtagacattaatatccaagtgggcatagttgccttgatcatgatagacattcatcattatcatcatcatcaacaacaacaacaacaaattaaaacttgatctccaagttccgggcaatggtttggtttcatgttttcatctaagatagagcaacaaagtgcctaaagactctgtctcacaaactcgaggctgaatggagctccaacagtgtcatgcatggtcccttaaagtgacctggccccctgtctacaaaatgggaacgggtaggaatccctacctctcaggtgtgcttttaaggtgtaaactcgttggctttctcaggtctgcaacaatcaggatgtggtggagacaggaagctgagggggcttgggagtcagaccatgtacatatgtttctgaagttgtttcagaaacttgtggtttagggtatcggttgtaggcttgttctcacctcaggattacctgggggtgggagagaagtgctgttaagacagaatgctaggccccagcctcagtttctcttttgatgttgtaggtctgaggtgtggtctcctcctttgcattttgcttgtggagtttgcttgggtaacctgaggtcaacggtcggttgttctctgttggtctccaccatatgcttcgagataggacttctcacggagtctgtagctcaccgaattctgttagattggctgggccacacccaaaaattctagggatcctcctgcctctgcctccctagcacggaggttagcagacatgtttctgctttctatgtctggcttttttacttgattgctgggaatcaggtccttgcttgagccacctctcccactcctaactcctgctccaccccctctctctggtcttgtgagacagggtttctctgtgtaaccctggctgtctcggaactcactctgtagaccaggctggccttgagctcacaggatttacctgcctctgcctcccaagtgctggagttaaaggcgtgcattaccccagcacagtttagctttagatcctatgagcaggtgctgcatgcagagaggtcatatttaatccagggtgaggacttgagctacagaggacacgtagtcagaactggagtgggtggtttcaggagcccccgtcactgaaagtttctcttattgaatggctgcttcctgataggttcttacaatacataggaggttcatttgttcagtaattcagttatccacttagtcaggctaaatgtttcttgcctgctttaggagccaggaaggaggagtttgcagctgaggctccaagagccgcttgctgacgagggcaagtcctcagataagctgcaaatgagttatcttctgaatacgtgtgcctgaacgtgtgtgtgtgtgtgtgtgtgtgtgtgtgtgtgtgtgtgtgtgtgtgtgtgtgtgtgtatgtatacctcagaggctcagtttggattcctctctttggcccatcccccatcttcctcacttcggttcatttgaatgatgctgctgggtaggataaggagctcccccctcctaaaaccctgaatatgcttaaagtgtactcacctcaagtgcatttcctgtgggaaaatttacatctcttcactagcacccagggcacatcattacactctgacctctcagccagccgtccattactcagtctgtgaaaatagattcttggaatgagctaattgcttttcctctcctctcttaagtgatatatgggtgaattaatcggcgaggagagctagagagagactcgagtgaaatccattcatttttctggattctttcatcctaaaccttgttaaaagcactaccaaggagctaggggtgtagttcaattgctaaggaaatactgccctgcacccatgaagccttgaactcgacctttagcaccctataacactgggcatgttgctccacatctgtgcctgcgatcccagcattcgggaggtggggatgggagggtcagaagttcagggtccatcctaggctatataatgagttcatggccattgtgggctacatgagaccctgtttctaaaagttaagcaatgatgataattattaatttctacctagctcctctctattatgattggagttcagcttgctctctgtattattaaattgcttgattcagcggtatattgcccttactcatgggaagaggaaactgaagagaaagtaaccggctagtggctgtagagacaatactctgtctttcagaccccagaccctgctctaagcccctggtaagctagagtgctcattaattccctccctagttaactatatcatccatttagtaaacttgctggaagacacaagcaggcctaactgtggggcctgtgcccttgggagacttcctgttgaagtcctatgaattcagtcagacctgtgaatgactccctctgaatctctggatgctaaggcgaggtaggcttggcgacacattctgcaagctggcagctgacccagagtctctgtggctgagtgttcctttgcatcagctggattttgtgtttttctgggtttacatatccctcttgggtggtttctccgcaagactgaatgttaattcttaaggcatctgctgtctgactgcatccggagatgggaagagtctagcctagactttggagccatgtcccttcctctgggaaatatctcttcttcccaaatctagtatctcttctgattcctctgactccgttctgtcttcagcccgtgttttcttctaaaaaacagttttgaattaggttttctgttttcagaataaatatttgatcagaccctttcttttctttccttttcttttcttttcttttcttttcttttcttttcttttcttttcttttcttttctttccttttctctttctttctttctttctttctttctttctttctttctttctttctttctttctttctttctttcttttattgcagcaatatgtaacttgccttgtaaacatctgccctcccctgaggtagccaccagtgacagtggacttctgccttgccagttgtttttaatacttgtacctggggtacactgattggcttttcattaaaatggacttgagaatacatgtatttctgaaatgtcctgtacctaattcctttttagatttagatctcgctctctctctctctctctctccccacacacacatatatacacacacaccatatatatacacacatatacacacacacatatatgtgtgtatatatatatatatatatatatatatatatatatatatatatatgcatttctttctgtcagacttgaatttctaatgttttgttccattaaaatcagaaataactttgctccctggccttgcctttctggagaccagttctgtcagctgaaaaatccgttagattcttttatttctcattttacttttggcgagattctaggaagctcgttctgtatctcctagccttcggggagggatccttaacctcggctttaaaggatcagcagctccatgaacaatgactgtccctgacatttgttcaactcttgcaatactactcactccattggccatgcctaaaacacaggccaaggccagatacgaccccttcattgacagcctaccaaaaatatctagcagaggctattctcataaagaaaaaatgaggtgcccatgctaaagtttagcatgttccacattggaaggaccatttgaattttacaatcgggtcctcagtctcacagatgttgtgactgtgtttgcagtttttgggtctttctcaagacccagaaaaacaaaccaacatgattgatttaggattgtcaactcctggatgaagtgatcaatgacagatttcctcctggctctctttttgttccttagtcccctaataaccaccactttcttctagtcagggtaacctttcgtggttcagttaaagtcactgggcgccattgccaggaagagagaatccatcactaaaggttcaaatgtctgctcttctttttttcaggcacctttttgctccagcctacacagaaacctgctacactgcaagtggcaatcctcaaaccagcacgctgaagtctgaggtgagtcatgtagacatgtgcccatcagtagctgccccggctaggtgggaataaatatgtggccccttctctgaatacctggcttcccctgaccaagacctcgggcccaaacagaggcgaactctgttgtctcatagttgctccttgttctttgccagcaaaaatgacaaagcagagagaggtagaatgtttgagggtaattcgattgaaattcgtgtaaatcattacaaagtactcatactgttaggcctatgttaattacccatatattaaaaatcattgaaaggattaatttactcatcatcctgccatctcatccaagtagatgttgattaatcttttttttaaatgtagggtttgcagttttaatcactgtgcatacaaatttatattagcatactataatatataatattaacaaaatgatataacaacaaaattatagtatatcttttgatgcagttggggtttgttgttcgtttgtttgttttgttttttcaagacattgttgccctgtggatctctggctgtcctggaattcattctgtagttggggctggccttgaactcagagatctgcctgcctctgcctcccaagttctggaattaaaggcgtgcgcccccactgcctggctccatcaggctctgtaaaaataagctgttgtcttaatactggaccttaacccttgagagttgtttttagtaggaaagttttgcacatcgtcccagagtcatccagtttggatagtcatccagtcatagttttacatcttcatttatttcaccatatcctacgagtggacctttaagatagtaaatcccacctgttgcatgattagtcggctcttcccttggagatttctgttagaatgcacaggcttagagcagaggagccctggatcagaccgaggcttcggaggctgggctcttgagaggcgtaggaaggagaaggacataggcagctacattgtgacttggctcctggtgtgtgacacggagaacaggaaaggctcctctgctcaggattccactcacagtaactggaactagatctccgtgcaacccattcctcacatacctcagcctgcgcgtgaatatttaacaagatagccatcgtcagtcactatcaggctagcttgtttatcagacgtcctggaacggggaaaaggatgggtcacttaagtttggagtcaactaagaaaatggttctcaacttgtgggttacgacccctttggcaagctcctatctccaaaaggatttacattataatttataaccgtagcaaaatggcggttatgaggtagcgatgtaaattttagagttgggtctctacaacctgaggaactgcattaaagggtcgcagcatcaggaaagttgagagccacagcagagtatatggtacctgggaggggatgctcttttgggttctgggtcagaaggtcaatgggacttcttcccaagactttcctgggtgggaatgaagttggaagtgtggccagtgacagcagcagacagactggattggatcagggaaactgtccagctgtgacccacatctccacaaagcttcttgccccacgcttttcccttcttagaaagcccagagcccgtagccattacaatttcacagaaccaccctcctccgagctcagcccctcctacttccatacccacaactcaagaatgggtctcagggcacaagttaactatgagctcatgcttcctgctgtgaaagccccctgggctgaccccctcagcctgacaagctgcggaatgcaatgacttcatggccgatcctgacttgttctttgtgctctaaactgtgcaccaagcagaaatgcgttaagggtctttcagagcagaactctggaagaggatgtcccctgatcccacgaatccccctccttcctgaaggcctcactggctgaagcacatccttactgaaccctgggccaagatcattgttttcttccatccaccgctgttggattcttgcaaagtccccacccaggcccagggggctcccagtcagccttctcgtttggaaactaagaaatcaaggagaagcaggaatggagtcactcatagctgttggcctaaatgcagaggatgggactctgcctccaaactaggcaggcattctggaaatcttatcaagactcaccagctagacctgtaggttacagacctaatctaggtcaggttactgggggaacaggtttgggaatgtgttccaacagcaagacttgcaagggttgggatctgaagccaggctgtggtcttggctctcactggctggatgaccttaatcaaccctttggaccatactgagttctttttttaaaatctcaaaaattagatgagctgatcagtgagtcagcgctgtggaaggttaagaggagtcgctgatttttatggggattcataactatgatttctaactccataatttacagatgaggggactgaggagggagctcatcccactgtgtgctagagggtagaaaggctttggtgacgagtcagtcaggtgccaattcggccttggttggggatggtagagggtggggtgcagggccaagttgctggggttcacgtctctgcttaactgagtcagtctctcaagctctttatatccgatcttagtccagaagctgacgtcctttaaagtagcctttggttttctcctttaaaattgtgggagtaatatctacctcatgaagctgtgctcagaattaaagtaaaaattagcaactgtcgtcaaagagtaaagacccgagtgacaaataccctggtcacatgtgctagtgccctttgtaaattaaggagcatgtgacagttgtagtacatgccactgcagagagcatggggggtggggggtggggggtggggatgcactctgtgacggccgtcagtcagagagccgaagaggtctgaggcttctccattactacttctggatctaacttctccataccgtgaaggaactggcattttgaaacagtgtttgacctatagttctgaatgcttgcttgactctcagtcattccactgacgacaaaccctcgaaggcctggccccttgtcccggggagaactcgtctttctcactgtcagcacactgtgcactgggtctgtaatctccctcctgagttctaaagaccacactcagaacttggttgttgatctgcttctagttcacctggtctggggacagatggagaagtcacatggcaggctggcctttgaaaaacagtgggacccttggctagaagttggtccatacatatgttgcctgccttcctagatttgcggggtagcagtggactttggctagaagccaggctgtgtgtatgttgcctgccttcctaggagccgagggatgacctcctaccacagtcgggtttcctttgtgctcacaaagcagtcatgaatctgactttgataccaagaggagactgctgctatctcccctcctggctgtgtgttagtgtgaatgggtagatgacaggtgctgcttggccaatgggccactcgtagatgaaagggtacctgcgattcagagaaggaacccaggttgagtgtgggtcaggcttgtgcttcctggcatggctgcatggctcagataaataggatggaggacagaaacagtaaaggttgtggatctgggtcaacccttttggtgggcttcggtgtcctcggaggccatgttttatgcctagtgaaagaatttagtgaaaaacatagccactagtgttggctgtctatctctctgggataaggagcagtctagctagctcttttgtgtacaggtctctcatggccctcagaggttggaggttaaagaggtggaaggccagagaagtcatgtacactgctagcatatgtggggacctggatttaaggctgccttggctgggccataaatgcttcagtttaattaccaggttgtcccaggactagagatgggagagaagtggacgcccccccccccatgggtttgccttctggatcctcccccaaggagaccgcacagtctggagatgagatccttagatcgttatgcagggaaaacttgagcgtttgtgatcattccttagcctcagggtgctgaggaagcccattaaagaaactgattttacttctagttttttgtttttgtttttgttcttgcttgtttttcgagacaggtttctctgtgtagtcctggctgtcctggcactcactctgtagaccaggctggcttcgaactcatagagatcttcctgcctctgcctcctgagtgctgggattaaaggcatataccactgtcttagtcagggtttctattcctgcacaaacatcatgaccaagaagcaagttggggaggaaagggtttattcggcttacatttccatactgctgttggtcaccaaaggatgcaggactggaactcaagcaggtcagaaagcaggagctgatgcagaggccatggagggatgttctttactggcttgcctcccctggcttgctcagcctgctctcttataaaacccaagactaccagcccagagatggtcccacccacaaggggcctttcccccttgatcactaattgagaaaatgccttacagttggatctcatggaggcatttcctcaactgaaggtcctttctctgtgataactccagctgtgtcaaggttgacacaaaactagccagtacaattgaccccttgtcaacttgacacacaaaaacatcactagtaagcctcaacccttacattcttattcatccccaaggtctaaataactttaaaagtcccacagcctttacatattcttaaaatttcaatctctttaaaatatccatcttttttaaaatccaaagtcttttacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctgggctcctccaagggcttgggtcacttctccagccaggccctttgtagcacacacatcatcctctaggctccagatgcctgtaccccactgctgctgctgctcttggtggtcatctcatggtactggcatctccaaaacactgcatgaccccttcagtcctgggccttcaattgcaactgaggctgcaccttcaccaatggccttccatggcctctcacagtaccgagcctcagctgctttgcgtgaccccttcatgccttcaaaaccagtaccacctgggtgaaccttacatattaccaagtcctgctgcagcaggagtacaaccttggccatctctggaacacagcctctttgtgctttcagaaaacacttcccagaagatgtcacctcaatgatgctggtctcttcttaatcaccgctaatttcttagctccagctaaccagcatcaatagtcccagtaatgcaaagtttttgctttggtagttctggtatcttgttaatcacagctgattcttcagccccagctaaccagaactacagaatcttcacaatcaaaacagcaatggccctgaaaagagtctttaattttccctctgaaatttcacaaaccagagctccatcttctgcggtgttctcaacattatcttccaagctcctacacaacatctgacagagctcttaacaacggatggatcttcaagcacaacgttctaaagtccttccacagtcctccccaaaacatggtcagattgtcacaggaataccccactctgctggtaccaatttgtcttagtcagggtttctattcctgcacaaacatcatgaccaagaagcaagttggggaggaaagggtttattcggcttacatttccatactgctgttggtcaccaaaggatgcaggactggaactcaagcaggtcagaaagcaggagctgatgcagaggccttggagggatgttctttactggcttgcctcccctggcttgctcagcctgctctcttataaaacccaagactaccagcccagagatggtcccacccacaaggggcctttcccccttgatcactaattgagaaaatgccttacagttggatctcatggaggcatttcctcaactgaaggtcctttctctgtgataactccagctgtgtcaagttgacacaaaactagccagtacaaccaccatgcccagcttttctcccagttttgccctctctgtgttctgacctccttgggaggagtgttttctcctccatctgaagagagccacagttgacttagcacccagcactctcagaagcactgtgcgtgattcctaattgccacgattagcctagtgatcaaacttttctggcaccacaaagctatttgtagcgctgtgcctttgacttctgcatccattgcttttcgttactgagataaaacagcaagactaaaagcaactttacaaaaggaagagtttatttgggtttaagattccagaacaatagtccataatggtaggagagtcactgcagcgggtggccagagcagcaggctgagagaacgcatcttcggttccaatcatgaagcctaagagagtaaactagagaggaggatgaggctctgaaatctccagtcctgtcctccagtgaccttcttcctctatcaaggctgcactgcctacctgagtcacatcactgaggactagcaagtattcgaacaactgagcctgggctggggccagcacttctcattcaaaccaccacagcttcctaattattaatgactagctttcacaagggactggagctatgtgtgcattttctcattgcatctctgaagccttgctcagcgcctgcttatggtagtgcttggttgccagcgtttataaagattagagggatctggctgggtttgggggaccactcagactagagagtgcaccaggcttcatggagctagggacccaggaaggaaggtgcaggtgtggagggattcgggaaaggaagagcatcttgagctgagatcttttatctttttatcctaacaaagcactgtgaactctgaggttaagagagaagaaatagattctctctccattttggaggctaaaagtccaaaccaagttgttgaaagagccgcacacactctgtaagctctccaggggagagtcctcccatttctaattcctcagtgctccttgactgcgttacatcattccaggttttgcctctgtcttcaggtgacttctccccttacatcctttgtgtcctttcatccaggaaacatatgggccgttagatttatgacctgctctaatccacgtggccatatcttaatttaattacatggtcaaaactctatttacaaatgaaatcatattctagtctctgggtggacataagagttttaggaggacactgttcaacccattacagggcgttcgttacagaggtgccatcattgagagaatggctctctctgaagactattcctgaggctgacatggcagatttaaaaaccctgggttctccaacctagcaggaagatctttggcaaatcttcttgtccctgtgagctcaacattttttgtctgctcagtagaggtggtgatgtctgccctgtgctaggccttgggtttctataagaaccaaaaaagtggaaacttggaagccttttgcaggtaagagctatgaggtcaggggttgggaaggaacgagtccgtctcctgtcaatcaatgagacattaacattgccgagtttatcagtgccatttgaccgagtgcttcctttctgtttggcaggatcactgcttttaccacgggactgtgagggacgtggatgagtccagtgtcacgctcagcacctgccggggaattaggtaagaggccctgaagctgctggggacagctggtgccctctcctatacgataagcaagaccttgcaaacaagaggccacgcttgtgagataccagggaagtctcagataatctacacgtatacctttcctgacaaattcattgtattaaggtagaaattgttgctgggtggtgctggctcacacttttaatcccagacctcaggaagcagaagcaggctgatctctgagttcgagaccagcctagcttggtctacagagcgagttctaggacagcctgggctacacacaaagagaaatcttgaaaacaaagataggagttctattatttaggaataaggccaacaaatcaagagacaattatgacactaagattagtgtcaatgaagagttatcagatgtaacttgaaggctacaagtcacagtaaaaagaggtgtgcaaatcatgagggatgtagtaggaaagcacagagtgtgaagagacaggaagttgggtccgtgtgggctagcacaggaaaggagtgaatgagttcgaagggcagactgaggagtagctagtataaatagcttcagtagtctaggacacagggcccactaagttgtctggtaaccatcactatgggtaatgaatagtggtccaagagggtgagaaaccaagacgggatccaggtggctggaccctgggctatttgttggcttgtactacaaggcatagtagctagtaaaatgtttgccatctctaggggttgggtaaccatggggacgcagttcctccaggaccattgaattgagcttctagaaatgaaagcagtgagagacagcaaacaggtgacatgccatttgtccccaggctgagtcgcaacattcttcactctgtggttgaatgatgttcaggtgtctagcagaaattgaggagagagaagctaatggagagaaagacaaggataaatttcaagacaaagtcaaccggaaagttccaaccagatgatgtttggtaaaagggtggcccttctgtttctataccaaaccagctgggtttgagccaggagcaccaggagcctgatgggaggtggaggaaggcaccagatcccttagaagtagagttatagttggttgtgggccaccatgtggatgctgggaaccaaacctgggtcctctgcaagaacaaagtgttcctaactaccaagccttctctccagccccctgctgctactttccatgcttattggaaatatctgggctcttatttacacaaattgcctgggttttgagcacctccactgcacagctcctgaactcaaggtggcgactgactctaggaataacaacagcgaaagtccatttgcgaaagtccatttgcggtagccaataccgcgaaccatatgctgggggcaggactctcacctctgctaatgttaattacacattcagtgttctcaaaggcagggctgggaatgcaggcccactgttgtctctcaggagctagtaggaagggctttctttccctttatcagtggctgcttctctcattcatcttgggtgcttgctgtatgcccgtgccctactttggtgtaggataaacaagcatcatcaaacaagtttggagccttctgtatcctcatctttttttaaaacagatttatttatttgttttatgtatatgagtacactgtagctgtgctgtactgatggttgtgagtcttcatgtggttgctgggaatttgaatttaggatgtctcctcgctgtggccctgctcactctgctccagcttaaagatttattttattattatatctaagtacactctgttgctgtcttcagacacaccagaagagggtgtgtcagatctcattacagatggttgtgagccaccatgtggttgctgggatttgaactcatgaccttcagaagagcagtcagtgcttacccactgagccatttctccagccccctgtattctcatcttaacagacctgccaatgacagatatggtagaggccataacgaactaaggaaacacaaaccatgagttctgcagccctttaccagcatataagatttgttccctctacagcttagctagcttatcccatcccaccttcacccccatcccccaaatatgactgagggcccttctgactgcaggtctcatgtctgtttatgtgttggttcccatccctgaaaggttgcgtggcgagtggcctgagggaattaggcaggaaatcggttttggctgggaggtgattaacagtggcctcatatccttcactcaagtggcctcctccagccaagccaacttgcttctcagtggtgtttataggctcagccagggccacctgtggccagcaagtaaacaatgactgtcccaggaaggaggaaagggagcaagcaggtgtgaccttctccgcccgccccttcctttcccccctctgggtctggagcactgggaacttacttggcttggcctcttgtaaatcattccagcagtcaggctgatggggaagctcaccaagctgcccatgtgtttctggttttcatgttgcttccatctgccgaggtctacatgtttgtctttcccggccctctcttccctccacatgctaaggaacggaggttgtagccaggatgacttgaaagctggagacttgaatgcaccatggcattcccagagcagaagcaggaatgacagtggtgctcaaacccaaatagtttcccaagacccctgaatcctcatatttccaaagaaggtctccatggtaaccattcatctctcctggtactgtgctcctctgcttggagaaaatggataaaatttatgctaggctggcttttctggctgaacatgaaagagtcaggagagcctccagacctgtggttctcagacttcctaatgctgccgcccttcaatacagttcctcctgttgctacttcataactgtaatgctgctactattatgagtcctaatgtaaatatctgtgttttccaatggtcctaggccatccccgtgaaagggttattttacatgctcccctgactcccaaggagttcctacctacaggttgagaaccgttgctgtagccattgtgagggtctcttctctccagagtactctataggtcagtttatcattacagaaacagtacctagtagaataaatctaaatgtttataaacatttaagggcacgatgagaaatactttctcaccctgctttcccagatcttaccccgtttctggatgcagccataaactaccagtttcttatgtcccccatactcactcctggcaaaaggaacttcgatacatgatataatgttttataactttgggccctaaccaccttgggaattgggttaatcagtgactgcggatcttaacaaagacacagcaaaccacagccaaatgcttcatgtcaacaactccaacagggaagatcggctttggcttggggtttcagaggaccccaagcttcactgctgcctctgtccgtctggaatccatgaccaggatggactaaggcaggacattcttggtagcggagacagtagtcctaacaactgccctccccccagatcttcttgctccaggcaggcctcccgaagtctccagaacctactccaaatagcatcccagctaggggccatcttcactgagggtgtcaggtgtccacacactccagccttccccatgctaaaaatccatcccataaatgtgaccacgacatcttgcttgcacagagacttcttcataactgaccaacagtctaaatgtaaggtctgatgatcgtttatgggaaagtatgccaatattgggccgtgatgtctttgactaaacctgtgtgtgtgtccccatccattgttggtgaggtgtttggttggttttaattcttaatgcttattggaaattgccatggtgcaactcattcagtttcagagataaacatccaaacacaggagtgtaacctaaaaacaagcttccacacaaacccatttctcatctgggtaatggttggaatatgcctgatagggatgtattgtctattacgtacaagagagaccatcttgcacatctaggtcggttttgtgatgtgtttccaacttagaactaagccttaggtacacatgtatctgtcagattactttaatgggtccttaaactcttccgtactgtctggtgagctgaattatagtccttcagtgacatacaatccatatcccttacagatccacttgagggaccagattctgtcactgcagttctctctgtcaagatctggagttctcacagcagttctgccttgacaggcaggcaggctggctggctccggactccgatcctgtactccagagagagaatctgagattgggtactggagagtatatccaaatgtgcacaccatggactggaatggctttagaactgccattccagggccctgagtttgtgtcagactctacacttcctgggggtctgactcccggacttctgctctccatacttacttttgcctttggctccatcttggccacactggcttccccgtgggcctcactgtatagactgccaagtacttgactttgtggataatgggattggcgagatgctcattccagaatcaatgactctggaaattagcaaccaagaatctgctgcaggtgttatgttaactcactctgtgactcttgaccaagctccctacccactaaaccttaagtagactggatcataaaaaggatcctttagcttgggaaatcctgaactacaagaaggagcagagtaggaaaaaggaaccaaggctggaggtgggagatgttcccccaaaagccatgtcctcctcctgcaggcctaatgataattccttctgtcagtggaataagcccttggatggcaggacctttacgctgtgacaagtttagattctagagacagaccattcctggtttaaaagctgacaactggggccggggaggtaactcagttggtaaagtacttgccacacaggcacaaagatctgagttcagttcccaggatgtaccagggcaggatgttgcatgcttttaatctcactgttggtgagacagaaacaagaggatctttggagcttgcaggccagccagtctggctttattagtgagcatcaagccattgagaggcttagtcttaaaaatcaagatgaacaacaacagagaaacagcagccaaggtcgtcctctgccatccacatgctccccacatgcacactaacctgccttctaacacagttcttttaaaaagacttattattgtgtgtgtgtgtgtgtgtgtgtgtgtgtatgtatgtatgtatgtgtgtgtgtgtatgtgtgtacatacatgtaaatgattgtggggggggaggcctgtgtgctataaggtgcatgttgaagtcagaggataactgtatgaagtccattctctccttctatttagcatgggttctagggattgaacccaggattgtgtatctgaagcctttccctactaagccatttatttcactggccccagatggtgctgatacattcctgaaatctcagttttctgccctgtaagatgggagcaatgatactgaagtcatcagggctcacattagagggttagcctcacctccttgacagcacaatgtttggttggatcaccgaatccctgggggctagaacaggtgggaagtgctctgtgtagatgtactgagtggctccccaacaaaatggtttgtaccccatttatacagtatgcttccatggctgctggcgttcttggagaatcttccctggttgtgagtgagcactgcgtaattactttagagcagtggtccccaacattcctaatgctgcgactctgtaattctgtccctcatgttgtgcccccccattaagtaattttgttacagttatgaattataatgtaaatatctaatatgcaaccctaagggtgtcaaactcataggttgagaaccactgctttagactgtcctgtgataaggctgtgtcaggagacagcagagccaggattgtaatccaggatgtctccttactgagcctgtgttctctgcctgtgctctgtcccagcaggaactcagcatcatgtgcctttcttccctctgtgctgccttggaagttccctatgacccgttagtgtaggtacactttggggaagtggtggggaggaggaacccagggctgctacttcttaggatctctcctaatgtggagaaggtggatgcataactgtgtgtcccaggggcggcttccttggggagtggcatctctctcaagtcttgaaggatgtatttgaccgagtccttcagtcatttatgggttaagcatgaatgaacctcttgtttcctgactggctggcctgcctgggttcttctatatgatcttatctgtgatttatttttctcattctcttaatgatgaggaataggtttggagagtagcatcctggctctttgcctcctaggtcctctgtcctcacctctaatctctgcctctgccagagctaacatttagcaaattggatcagtggaggcccttaggataaatgatggagcagggggagatataaggtagcttgagggtggtagcaagggagagcccccagagcttcattcttagaaacttgccatcaataacgctggggaccactgtaatgtgcttggttgtgccaactcttttcagtctccaagtaatcccaggggaggatcagtggtcgttaggcctggggtgagtccccaagggctatagtgacgggagaaaggagagaggtcgctgaatcctggtgctggaagggataacctcagtggttatcccaagcttgggtcattcagactgcctacttgagatgatgtctcaatcatgtgccatagagacagtcaggagcatgggctcctgaagttcctgggtgtggctcggcagagcatttcccataggacttagtgtgtaagggtccatgatttgccgaagaatgataacccagactcatgctagactcaaatagtatgtaaacacaaagagtgttttattctgtagaagtccagtgtgctggggtctcccattaccagaatagagagatacccaagtgagcttgcagacctgatttaaagcacattatggaattctatgttaatttgttgggtccatctctatagacattccattatcagggtgtgggagctggaaacttgctgggggaggtctggaaactgctgctgacccattgtccttgcctcaggccattggtggggcagcttctgaggccaaggcttgcctggaatggtctgttcttggaaatggagattaagcccagtctccttaactgccgatttgaagcctgtcttggaatcagctgagccttctcaagtgcagactcttggtccagcaagcagatcctgagtctactgggatagcctgggtactttctgaagattgctgaatagcttgaaaactctggtcctgggctctctgagcacaggcttaagcttactagtggagctacatagagcctaagggaacagactatatctgttaaccagcagccacaggtgaaagcttctgattctaatctctctgaacctcagtttcttcactgataaagtgaggtctgtaattttgcctgccttacaatgtgctggggaaatttaaagagagtaacatctgccatctatgcggcacatggtcagttagctgtcagcaaacactagctgacgataaggttgggcggatccctcctctgccatctaccagggaacttggattccacagacaggctaggtgcatccttgttgatgtttgatcttttgctatgcattgtaataatcttgctccttaatttaaaactggtggttaaataaagatgccaactgtcaaaagctgggcagatgagacatgtatagggtttgtggttcactgggcttggggtctgaggagaaccatgaggggagaagatggagagaagaagaagtcaccatggggataggtgaatcaaaagtttttgccgtgagggctagccagttggaagtaagagcggcccagatggaacatgacaaattataaaatgggattattgatagagaaatagattcaaatagcatagagggtagatatctgcccaggtctagtgctaactaaggcttattataataattaaatttgtgtgtctttaatcaaggaactgaatgatcaaaggcagggcaaaaacctctgattgagattaaatatttatacaacaaattggtgcccaatgtgggtcttgaacccacaaccctgagattaagagtctcatgctctaccaatggagttagtaaaattaaaaaataatgcttttctgttgcccaaaaccattttgctctaggaaactgtcctgctgatcactgtggggacccagagataggttggggcagagttgttttgtttttatccaacaaaaaaacaaagctgtgctcatgaaagctaacatggggtagaatttcaagctgctctgagcagtcagcctgtctccttagaatgtggggctcccatgggagaactaatggcaggttgtgagagctaacatgaaaatgaatgtcatactgctatgagcaaccagtctctataaacatgagcttccatgggagaactgattacagctcaacctagcacattatacaataagggagagggaatttaaattcagttgaataaagagaagggtattaaataaatttacatgaagaaaaagggggatataagtatatttatctacaggaatgctaatttccaaagaaaggagagaaaatgagaattaatataaatgtttgaagggtatataaataaataaatccaggcctttgatcttaatacttggaagataaaggcaaggacagacaggttccttgtgagtttgagtttgaggccagtctaatctacaaaacacgttcaagttgtcctgggctatacagagaaaccctgtcttaatacataacaataattgtttttaaaatgttttaagttatcaaagatattaatctctaaagaagagagaaagatatggaaattgatttcgatgttttcaagggtacatagataatgaataaataaatccaggcctttgatctcaatacttgggagactaaggcagggacagataagtaagttccttgtgggtttgagaccagcctaatctacagagcaaatccaggtcagcctgatctacacacacattaaaaaaaaatcctgtctcaataaataataataatcgttttaaattgttctcattgttttaaattatcaaaatgaaggtggttataagtgctctctctggttgtgatggcattacaaatcctctatgagagaagtcaatctagagcagacctaaatttaaaaagaggctgctaattggatcagtctatactcttaatgatttcaaattgccggaccaaaggcatgctatgatagctcagccgttgagggttaggctcacagccaaacatataagcgttcagttcccatccctaattaatgctgtataatgtttgaataaagtaattggagtgagctagctggctgtcaggcttccccgggaggacgtacctctctgctcctttggaaaatgagggcttagcatcttggtgagcttctctctattgctgcacctacaaccaacatcaatcaacacatcctggccggtctcacttgagagagtcactgccgccatcactgtagccatatgcatagtcctgatgacagaagatgaggtaacagagaactgcccactggacatcctcctaccttcattgtcagtagtgaagtcgtggatagtgagtgctcactgaatgggggtgtctttctgaaccattctccaggtctattatgaaagatgataaaaagtcagggtgaaggttgtaggatgaggaaccagattgctgaagctcacccctgttttaactctttactacttgtgtgaatttgggctggtcatggaaaaaatatttgtaagggtcagagaagttagttagaagttagctctcatcagcttggtgcccagttcatagaaaagctcaataagttatagctactatgatgataattaccagccctgctgccaagttccaattggtactttcactgattcctatggggaactttccattcactgggtgtaatattggtgcacacaggatcaccagccagtctgtggtccacatcatttagtggccaatattatagtcattagaggaagctggggtggtgggcgaggctctggtcagctgggatgaagagatagcttgggaacaggatgccaatattgccctggcctccgttctttcctgtgcagagtagggaagttgctgtgatccctgctctttgccctccaccctagctgttaagggaacaccttaggtgtctcaccataggccagatggcggctgctgtgtcagccaggatgcagccaggaagttgatagtcttcccggtactggaatgaggtcagcgagggatgggatcaggaaaggtctactgcccaccagagtctgtcccaagagaatcatgagctcttattaaaggacaaaacctgggtgggcatcctgagagggcagtggtggctagaggttgagtggcccaagaaagaagcgctgccactcatggtgccagaggctgagctgagaaggtctttggtttggagataaggtcctgagtgacttgttgccaaggtcctggggattcagtcctgggctcattgttcccagaatctggaacccatttcttggctgtcttgtttatctctctgtgtggaaggtggcagtttggagagtgggtcagaaggacagactatatttactcatgactatagttgatgatgccagcaacactcttcagaagtgtggctgactgttgcagggttcccagtgggagataagatgacaaagaaggcatttggcccccttccatcctcagacacagtttacggaaaggtaattaaccatgggacgcacagttggcagacattactgtcttttcattcctacatcacagtgttaggttggcacatcatagatcttagtggataagatgacagggggctaccctgtgagcatctccccacctctgttgataatggtgaagccagaggcagtaagtgctcactgaacctagagagccacagaggcttcagtggtacagtaccctaagcagttgcatctaatccgtgggtgtctgtcaaggctcaggctaggtcatgggtcacagtgactacacccattctcagcctgttcttcaccaggacaggcagcttggcttgttcatattccatccttagcaactgccatggttgtagatacatagctagaatggctgccttcctgccaaccgtgaatacagttattctctgtgctcctgcattccacctctgtagagttaaccaattatggatcaattattttagaaaaaaaaagttttgctcatatatgttttttcttgaccttagtccctaaataatatagtatatgtaacatacctttacatttaaaaatattatttgtttgtttgtttaatgtgtgtgctcctgagtgtatgtttgtgcaccatgtgtgtgcagtgcctgtagaggctaagagagaacatcagattccctggatctggagttagaggcagtttgtgagctgcctggcatgggtgctaggaccaaactcagatttagagagagaagcaagtgctcttaattgctgagccatctctccaggcccaacatttacctttgtttgtttgtttgtttgtttgtttgtttgtttgtctagctggttgttttttcaagatagggttctctatgtagccctggctgtcctgcaacttactctgtagaccaggctggcctcactcacagagatctgtctgcctctgcctcccaagtgctgagattaaaggcatacatcaccaccactcctggttcagcatttacattttatttgctattataagtaacatagaggtgatgtaaaatatacagaaagaaacaaataggttatacatcaatagcacaccattttatatatggcttggagtgtctggcattttttgtttcctttggagtctggacccaagtctctatagataccagcaataagactatttgtgtttgaatgatatctagaactcagtgaaatctcagtgagtgaaaaaaaaaaaaacaaaaacaaaataacccagcacatatctttgagttcagtactgggtgaaagattgttctatatggttagttgtgggtgtcacctgaccagatagctgctggcatggggcagttgatgggtagggatgcttggctcccaggcactaggacacttgtctttcatttagttactcaagagccccgtgagttagtacattatcatttttattttagggatgaggagattgaagctcggggtcatgagatgtttcttgagcatgtgacctttgagtgccacagctaaattgagaggctggctatctagctggcaggccagagtgcttcctctgatcacatgttactttttcagggcctatacagtttaatgattgtctatggggtctatggggtctacgattgtcatgggtcatgcttgatttggtggcctttaggggtcccagtctaaagcctgaacttagggaggtaggtctaaagtgctctgagattctgtgccccacagtgtatttctctacagagggtctaagcttacaccaggccttcccagagggcctcgtgacccagtagaacgtgaagaagcatggagcatttgaatctgcacaagggacttttccggaagcattgaccgaagcttccatttctcttatccacagaggactgattatagtgagaagtaacctcagctacatcatcgagcccgtccctaacagcgacagccaacaccgtatttacagatccgaacatctcacgctgcccccggggaactgtgggttcgagcactccgggcccacctcgaaggactgggcccttcagtttacacatcagaccaaaaagcaacctcgcagagtgagttttcaggttcccagtggagctggcagactggagcctgtcctctctgcacccttactttggttccaggggtatttctagattgagagagaagggtaagaaagagggaaaagcccacctctctctctctctctctctctctctctctctctccctctctctctctctctttctctattgttgagtgagatacctttgtaagagaatcactgtttatatttaaaatattctaagatactggtttaaaacactgtgtaaggttaaaaaaaatgtcacttcccctcttggaatagctacctcatctgatgtacaatatttgttttgttcacactgagaacagaggtctgtggtctcaaagttacttgggaactaagctgtcggcatgttcccttgtggggtgctggcctcaatttttgcctgtgctagccagtttggcttctttgttttttgagactagaggattagatcccatggctcagaaaggccttgagtaataacccgttgcagatggtgatggtgggctgcagccagaactgtccctaacgcctaaatgtaaaagaagtaaaaaggtcacagcttattaaccaatgtggttctcagctgccttttggaatgagctggagccagccatttctactgcactgacctgcttctgtctcttcttgtccagatgaaacgggaagatctacactctatgaagtacgtggagctttacctggtggctgattatgcagaggtaaggggtcagcaatggatttcagcaaacagaaaacaaaacaaaaaacaagaaacaaacagacaaaccttctctcttgaaagcaccaactcatcacattcatctttttctagtttatcatataaatttgatcctaaatctgaccttaaatctagccattttctatttttggctgtgcgcctagcctttaatggctgagccatctctccagccctcttctagccattttaaacagtaaggaaaaaaaaaagaaaacagcaaaaagccaaggaaaggcactcctaggacagccacggaagcacgggctttgcttagactggatctcatggtcctacagtttggatgctttctcttaggactgtctgtaatccttcagagaatcctgtagacttctgttttacaaaggtatcaggcgcctgccgcatctgatcagatacagtcttctcacatgtgtatctatttttataaccatgttgctgcttcctaaatgtccccagagcagcagcatctgtggcacctgggaactgtgaaaaaatgcaaattttttagcctcactccagatctctcgaaccccagatcatcagggtgggggtcccacaatccatggtttcataagacatcggattggttttgatgcatagcgggtaagcttgggaaacactggcctaaaagagcaggatagtcccttgactcattttcctcgaattggacaggccccaagatttcacagacacctgtccacctggcccagtcatttgtctcactttttcaggcgacttcctgattttttctgtgccgttccaacatagtgcttggcatcaggatgcagccgtgagccagagctgctcttgaatctgaactttgctgtagaagcacaaaacccttgtagctctaggcatgggagccactgaaatgggcccttggtgatgcttaaaatgcacacagcagatctggtgtggtttagagccttggtagaccctctctgatctggtgatgccaaagatggcaggtggcgtgtaaagaaagcttgaatggagacttatcctggagtccaggagttctgtttcctcctggaagccctccatgcacccaccacccatatttccattaaccatgcattaccttcaagtcccataccgtgtggtgacatgaccacagccaaacactctttcctgtgccctggctgagcactgcaaaactccatgaaagtgggggtgggggctcatcactgtatcatggtctcctgtcctctctacttggggctaccagcttccccagtggcctctttctttgcagctccacagcgtgggtcggagcaatgccagcgggtgagggagttctagcccaggtttgagagcttattttcagagctagaggtcggaagagaaggatctttagccttctttcttaaagacaggaggagttcactgggcagcgaagtggaggtgaagggctttcctgggagggaacattgtgtttactttcaaaagagtttagctttcttaagctgatgttggcattgttccccccaccccaccccccagcagtcaggaatgggtgggttctagggtttttgttttctttctacagattgatgtgtagatgggggagcagcaacaaaggttggcttcaaagccagccaagtaacccacttagccccaccccatagcggcacctttggctctctgtattgtgaaggttcctgggggaaagcaaggtctttcctcccagagagttctccatttaagctttatatcttgtatcgtctgatacaaggtctttcgtcatttttcctaagattgttcagataaaatgtcctgagactccaatggagtgaggcacttagaaccgccccccccccccgctccagtttaagggaggagtattattcttttgcccagtgggtccttggtgcagggttttacaagccacttaacctgtgagtctccagcaggcatagaagaggaggagttggggagtggtctgttgctgggtagctagactcccagcaaaccaggcaagaaaaggctctgtttgaaggtgtgccaccatggctgtgggaccacccagaggatcttactgatgcaggggagtgaagcaccccttaaaaagcaccagtcagtcacatagacatcctcacccccttagctacaagtcacccccatgactcgtacctcttgctgagtcagggatctctcagttctcagtgtcatgaacatctctcagctgtaggctttgaatgattcatgtcagggttggatcaggccaggcaagatttgcagcccagaatctgctggcagaaatatattcctggtcgttaatctgagcatgcaggaagatgaatcaagggaaggatgtagtatttgtgatttatcccccagtgctgagacacagccgctatctccgggctcggaactcacagcagccagagggatgcttcgagtgggaaagcaagctctgggcagtgaggttgtgctattggcatctagagagagctgtcagcagtaagcaagcaagcaagcaagcaagcaagcaagcagtggctctctgcctgggccaagatcgaggtgggagcttctgggatgattctcagcatgtccattctgtaggcaaggaggcgtgtgagagagctgcttgggtggatcctggcacattccctcatttattaagtgaaatagaatgcaatgggagcaaagaggggggcttacgttgggggaggggaaagaatgggtttagacatagggctgtaaagaactttggtggtaccagcaggatgtaagatatctgggaaaggctggcctaccgtgttatatgaccggggttgcctcagaaagggtaacactgaagcacatattttttaagactggaggttgtaaactacagcccatgtgaacctatcacatgttcctatgagtattattctggagcagggccataccatttgatttatggtatcctggaagcttctaagcaaccaaggagaactgggtagctgtgctccaccaaggcagaactgagcagctgtggtctacgatcatgtggtctaccaagcctcatcatgtttactcagtagcgctttgtagaataagcttaccaactcctgcttcagagtcttctggaaaacatgacacactgtttcaactatggtggcctcactgggccttactgtttgaggataggattaatatatttggaagccagaaatctcttcccaatgcagtaataaatgtttactaaataagtggaaagactcttgccacaggactagtttagaagtcaggaggtcttggtaatagaaacttctagattaaacagtttgcaaaggtctatgcaacagggttctagaatttacctctgtaggagataagggtagcaaaggagttcttttctggtgagtgtcagttccaaagaagtcaaggactgttgcagaattaatacaagagggaggaagtggtgtaccagagctgggagtcagcccttgccaaaccaatactctagggcacctcatttgggtattctggaagagctggaggaggaaacctgtaacggcttgaataaggaatacccacctaacaataccttcactagctatccagattctgggtcaaaatgacagcacacagggcatgtctatcctttagggcagggggaggttacagttctaaaatcttttcgtcttcccatcctgacaatttccctacttcattattgaaggtgaaagaggtctgtccttttcagacagaagtggtaatacaaagcctcctaatggggctttaggcagacattctaatcaagttcagcacactcttctctcctatgccccattatcgatgtctgatttcacagtgatgatgaagtcaaagagtctttctcaccaaagaaggcactgcctcttggaatcatgtggaaggcaaaaccatgttgatgccacatggccctgttggcagcaccccctatgtgacatttgcatgcccccccccccactgcagttagtccgtgtaggttctcagtgagtttcttagctcttttttttttttttttggtttggtttttcgagacagggtttctctgtgtagccctgactgtcctggaactcactttgtagaccaggctggcctcgaactcagaaatccgcctgcctctgcctcccgagtgctgggattaaaggcgtgcgccaccacacccggcttcttagctcttttaaattgtgtccttctttcttaagtagaggatttgttgttatggttatttctggctctccctccactgtgactgaagctcttgtagggtgtcatcaagacctgacatccatatgccccttttgtgctaagcaccacagcttgtccatagagcagtttagcaaccattagatcagtgacaactgaccacatgtaggagaaagccttataagatgtgtgatggtggcttcctattgggttgatgagcaaagcaaagagaccattccctcctctgattgatcagtgagctaaccggaagcattgtaatataaagtcaggaaaataactacctgaaggggctggaagaagataatcacatctgctctggttgcttccttgccctgggagatggaggtagccaagatagatctcactcaggttcttcctgctgagagccatgggaagggctattactgaaaaatgactgcacacggaagacccttgggtgagagctgtggaggggtctgtctcacctggttctgtttgtcctgtttagtttcagaagaatcgacatgaccaggatgccaccaaacgcaagctcatggagattgccaactatgttgataaggtgagaccaggtgtgtactttctgggggagattgctgcacctcagacagtctgcagggcaagaagtcacacacacctgagctcttgttgctgatttgggaccctgagctatcaaccagaggcaaacaactcagcttcttgggtcaggtttttgtcttttgttggtttgtgtgagtgtttgggggccttttgtttttctctgttttaatttataaactacaagcactggcttaagtcagtggctttcagttatgtttatagttttctgatggaaatcatgtttcaaaaatgacatcttgtgcccctgcccatgtaaaagtcacatggaagcagatggctggaaacagacatgcgcctggctctgaccccctgacctttctcacaaatgaagtgggttttgaggcacactgagcaagggagagcccagtttaaaaggcatcaaggatgtgttccctctgggtgaaagcccggggattctttgacttagatgttgaagtggatcgggatgtttctagggagactacgaatagttatacttcttcagtcgggttgtttcaaccatgcacttaggaaattcacagaagtttgagctgcactcatggggtattctcagaccgtgaagtattctatgcgaaagcaagttctagcacaaaaggcagagaacaaaactttgcaatggcagctcctctccacaagcaaagctttgacgtgtttggtcatgtgcctccttttaaggggcagtcctggtgggtagaactaaggttgcatgtttgccagtggctgacagtcccagccctggggtctcttgtctctttgagactctgataaccacttcaggacctgtagaactttgaaggctttcttggccagcgagaggttcacggatcctagatctcaggctggagagatggttcatccgataacaaatagaaattagaaactttcaaactgggcggtggtgatacatacctttaatcccagcactggggaggcagaggcaggtctctgagctcaaggccagcctgctctacaaagtgagtttccagaatagccagggctacacagagaaaccttgtctctaaaaaccataaacaaacaaacaaacaaatgttaaaaattaaactttcagggcttaaaaggcagagttggttgctgtggaattactagatgaaaagttcacagccttgtatttttttttctctgccctcaacagctgtggaaagaggccactggtatgtaacaggtgaaagccaaacactagcctttcctggagggaaggattctagggacacagtagagtcctgtgtccagctcctaactcaccagcaatagcgtctcagcgatcctgtaaccaaacacccaacatctggagaagtgtgttttccctggggatacaggaagctgatcctaccgccacctgtgtagcaaccattgtcccagacccgactcaggggaggtgcagggcttggctggctggctctaggaattttcttcctgcactgggtgattagagcctacctctaagcactgatgagaaatggaagtggtatgtcagtaaacacatcaaacaaataaacaataataactacagaaaaagcaaagatgcggagggaaaagagggtagccgcacaccccgggtgtcggtggaaaccctgtgccttgtggatggtcatccaagcccccaacttccctccggcacgcgtggtttagggtgaggcacatgggctcctcctaagtctgctgagccagttacttggactgaacattttagagctaaaactggaagaactctacacatttgctgaatcaggggcccaatccacgggccctgttttctctgaggcgtaagaaaagccaagttgacttcccttaaaaagttcctgagtgaagcaaattcagatgcttcgggtttttctgtgatgatagatgtggcaaagacagaggaaccaggagcccatctagactgcagtttcctgggggcaagagaaggatgcgaatgtgtgcgtgcgcgtgtgtgtgtgtgtgtgtgtgtgtgtgtgtgtactttattgttatatacatattatatgatcccagctcttcagcagcagatggtcacaagggccctgggagtataatctggttcatcttggctccagagtgtttctgctgagattttgggcaatgtctcaactcctctaagcctcagtacccttccttcttcatgacaagtgcttgatgaacagcgggaccaccagttattaattttagctgggaaggaacccaccatttttagattggggtgatctaatccctttgtggcttctgtgttatgtggttttttttttttttttttttttttaagtcactcatgggctggggagatgacgcagtatgtaaagtatctgctgggtacataaggacctaagccccaccacccatctaaaagccaggcatggtgtcatgaacctatagccatgtggctggtgggggaggcaggggacagagacaggccatccttggacctctcaagccaaccagttagggttaatcagttagttcctgatttagtgagagaccctgtctgaaaaaataacatggagaataaacggaggaaggtaacatgaaccttgggacttcgtgtgtatatgcacacacagaagacacatgtacatgtattatgtgcacacacaggtcacatgtacatgcaacactgacacggtagcattggtcaggtccaccaaagaaccccttgatggttagggtgttgttccctctacttttttttttaacctgttttctaagccagatactccagtttgaccaccagaatgcatccctctgaaggtcgtatttcccgatttctagagccagagagcaatctcagcatctgtgctctgagctcctaggtcggatggtgagagaaactggccttttggtgtcttttcagttttaccgctccctgaacatccgaattgcacttgtcggcttggaggtgtggacgcatggggataagtgtgaagtttcagagaatccctactctaccctctggtcctttcttagttggaggcgcaagctgcttgctcagaagagccatgacaatgctcagctaatcacgtaagcagcccttttctggtcttgtggtatcagctttgtctgcagaacccctgcctgccgtaaggggtgcgaaattcacccttcctttcacaggggccaatgttggttgtgcaagaccccaccctgctccctgggccacataaccaggctttttcagactcaacacatcttgaaagaatgttaaaaagcctaagaatgataacagtcctctgcagagttccacgtgaggcaattagcctcacccgtaatcagctgagcagctgaggcacttgggagtgaatattaggggaatgagcagatgactcttggtcacagttgctagcctgaaacaggcattcttgagcacagtcagttgacctcccactgcaggatacaggaaatgggtcttcaagtccttcacaccgttctctggggtctcagggctgaagtcctgggaaggtcaaaatggtagactgtaggaccttcgtgctcaacaaaggcacagagatgataaactcctttacttgtttgtatttatttatttatttatttataacataggcgagtcagtaattatttcatccttgataccttgatttaccctttcataataactgcgatttccaatatttacctgtccctaaaacctagactcttagtggtcacttgaggacaatccactcactgagaaagtctttgtttgctgaaacatttggcctgcacttttggattggacactttgaatctgtttatggtagtaaagcttcccagagctaagtgcaagtctccgaaatgccaagcagggcttcatacactcagatcggcatatattgaatttattaagcaaacatttatcaaacatccatttattctcctcgcctactctgggtggatgagatggagaagggataggttaaactggaagaaactggctgttgacaggttagggccatcattttggagcagagatggaaacagcttagccctgcacccagctgcagtttgtgaggctcccaaagggactcagctactttcttggtccttgtgtgatgtgtggatcacagcctcagccccgcagctgcatccagcatccttgcttttgcccccaagacacatgccactgatggtaagacctgagctgctggccactggcggaaatggacatgattcacttgggcatcacagcctggaccacacccttccctgtgacccctgtgtctggccgttttctatgaatcagggatggggcacagcttttcaagccctgcctttttccttttggagactttgggcactttctgagggggaaagtgacctttttttgctactatgagaggaagtgagaggaggtgagaggtgtggtatcctgaaagaaatccagttggctgggttaacaggcttgtcctcttgggactaatctgggaaggtcaggggatcggtgcacatcatggtagccattcactcctgcccctggggaacagttctctcagcccccacctgaattacatgtcttttttcttcctgcaggggcaggtccttccaaggcaccaccattggcctggcccccctcatggccatgtgctccgtgtaccagtctggaggagttagcatggtgggtctcagacaagacaatgatgttgcgcaaggggacaatggctcccaagagaggaagtcagctttgaaaagccgatttgatatttatagtcacagaagaaaaaagcattaaagagagcaaatgtgtcagatgaaattcttaggttcaaaggatagtagccaggggtaaaatttcattcatctttgtgttcatttgtaagcagtggtaaaaatggccctccagatcggttgtgtattattccatagcgggctggaggaggaggcagagcaggagctgagggcaggggagtgaacagagatagaagtgtttctcatctgggtcttgagtccttaggtaccgcattgtgaaatgagatcctgtctcaagagtcaaagttaggaaattgccctcttttgaaattctgacttggcaagagtagggtttttttttttttttttggctatgaagctgttgatggcctggaactcattgtatagaccgggctagcctccggcttgctatctagctcaaaatgaccttagggttctgttcttcctgattccatctcttgagtgctgggacgacaagtgttggctaacataccaagttcgatgtggtgctgggatcaaacccaagtcttcacgcatgctcctccagtactctacagctacatccctagcccctggattttggcttgtctcttctaacctggacgagatataaaggaagcctcgtctctctgctcatttgttattttatccctctacccatcatgtatttttattgacaaggtagcatgaacgttaaaccccagattctagagtcaaattggtttcaaagagcagccatgcgactttggagttaatgtgtgtctttagttgtaaagatcatggcttatgatcttagggtaagagtaaacattaagtgagataataaaaggaatatatatatatatatatatatatatatatatatatatatatacacatacactttttgttgttttttggagacagggtctcactacaaagcactgactatctcagaactcacccatagaccaggctagcctttaacagagatcctcctatctctgcctcctgagagctagtattaaaggcatgcacaaccatgcctggtataaacatccattttgctgcttttgttctactgtttggttttggggaatgggtctcactatgttgcccagggtagtctcaaacatctgggctcaaaagaccctcctgcttcagcctctcagttggctggggctctaggtttacatcgctgcaccagccctatttgttctgctgatgaggaccacacactgtaccagttttgtctggggtggccctttctgcaggggtgctctcagaaagcagccagtcaagtgtctctgttgctcaattcaaggtgatgcatccgagagatgcatccacaggtcattcgtggtctgcatcttttaagaacacaggtagcagtcttttgagcatttgcttttcaaatgaagacaagtggctttagatttgttataagcaaggtatgaagagccaatatgctcagcgttaggggagatcaatggagcgctgtcaggctcagataagaaaaagtcatgcaggccaggtggtggtgatgcacgcctttaatcccagcactcaggaggcaggggcaggtggatctctgagtttgaggtcagcctggtctacagagtgagttccaggatagccagggctactcagaaataaagcaaaaaaaaaaaaaaaaagagagagaaagaaagaaagaggaaggaaagaaaagaaaaggacatgcaaagcagaaagaaccccctgaccttgaatttgaaattctctgaacaggaccactccgagaatgccattggtgtagcctccactgtggcccatgagattggccacaactttggcatgagccatgattctgcacactgctgttctgccagtgcagccgatggcggctgcatcatggccgccgccaccgggtgagtcaacctgaagggtgccggtggggagaagagtgagctgagaggtgcagggtcagatggcctagatggccccagggaaactttcaagctgttgatgaaggcagtttaaatgatgtttagatgaaacagaagcgagcagatgtgttgtgggacgctaagttcctcagagagcaggtggtctggattgacgaatagtttgtaattttcagctctaaaactggcttcaacgtgttttgtttgttttgtttttgtttttgacatcacctgtgagagtcttgctcagtcaaatcttgaacttgtgaatttaagcaactctcccacgtcaactactaaagtctttggggctttaagtatgtgctaccacacccatatgcccagttcaaccacaacccttggtcttgcctcttcgggagctttgtagtttatagagtaaaaggagaaaggggccatccagtcactcttaaggaattccatgaaacaaaggtactgagactccaacacttacaaggattgtctaaaccagagcttttggaagagggttatcttgttcctgaatgcatacatcatgccattcttcaggacttgagccactccctggaaggcaatgtagtaggatccttattacaccccttcattccaaaccactagggtttgcttgtgcttcccagagaatggtggttcaatgcagccttctcgttcatagtgctagtgtttgctcgctacttcctgactaccgtgactccaaaggatggcagtgacatgcgggatatgacatgcggcataacttttgagtttgagttcatggttaagcccacccctttctcagccaatcccaatagagtgtgtgtagacaaatgggcgacagctaaattcatgactactctagctgttttttaagttattcacacactgtcatagctgaatggttagtagcaaagtccttggggacctactgtagtactgaaagaagccctcaatgtttaacctttcgttgttttagagacttaagggcagggctttaccagggtctctttacagacccatgttgtgatatagaagttttcccatatttacatcttgtgaggtatttctctgtggttttcctacatacatctgtgatctatgatgagtttaatgtataaagcaggcacagtcagaggttaaaaacaccaactcataataaactagagcatttgaaatagtgatgatgataataaaaatatattggtccgttttgaatgtttcaactcaatagtttcagatctctgttgactaggggtaaccaaaaccagggctggcagctacgaataaggaaccggctgcacttttcgtttccataggtgcaggcgactggagctttcgtacatactaccgtgataaagcccacacatttgggtgttgggcagtagagttggctatgaaaacagagatcagcccctgagtgaattaaatctgtggtcttgggctttctggttctgttttttgtcatgagaagataaatacccatctgatgtgttcagctttcagtatgaaaacctgtcttttttttttcattttttaaaattagacattttctttatttacatttcaaatgttatcctctttcccccctccccctgctcaccaacctacccactcccacttccctgtcctggcattcccctacactggggcatcaagccttcacagaaccaagggcttctcctcccattgatgtcccacaagccatccgctgctacacatgcagctggagccatgggtccttccatgtgtactctttggttggtgggaaacctgtcttaatgtacctctcaccctttacctacctcagcttcctcactgaaaagacagaaatgactgttctgtttctcaactgcctttttcatttttaagaaaaacataacggtgtggcctattcatcatctcatggttcagggtgaaagaattctaagttggtgtactgatgaatgtcctggtgaggcagagggcgtgtgtagggttttcatccaagtgaactaagcctcttgagtggcaggcaggacagcaagctgtcggtgtgcttcagctccgctaacgcctccttcttctctgtcaggcaccctttccccaaagtgttcagttggtgtaacaggaaggagctggacaggtatctgcagacaggaggagggatgtgtctctccaacatgccggacactaggacgctgtatggaggccggaggtgtggcaacgggtacctggaagacggtgaagaatgtgactgtggagaagaggaggtaagtgtcaggaccttactagagagagggacgaatctgtattgtcttcagagcttaaggacatttgaaagcacaatgtgacagataagttcctatcaaaaggacaatgcggtccttcctatggaaaggacaaagggacagatttttcccagttgccagcacttcttacacatgactaccgaaggccctctgtgtgtcagaggcagacagtgagtctgccaggtggaccgtttcgatggcctctgcagctgtggtcaggacagtcctatccaggatcagggtggagcccctttgagcagctgctctagccacagaccatgatcccagggcacgtagctctctctcctcctccccagaggagccccagatggcgtctttggccctccagctgcactgaatttatttctggaggccacacagctggatgagctcatgaccatgagcctggtgaggagccctaacccaagctcgtgctgtccagcccggagaagagaagatttgaagggagtgttggaagtactgtcaggtcaggggagatctgccgagaaaggagaagcagaactcttggtggatagtcctctcctcctatcagggcttcagagcgagtgtggagagcgcacaccctagctctgtcatctttattagaaggatgtttttctgaaaaagaagaagaagaagaagaaggaaagcagaactatattgtttcgtgtctattttttgaagatcagaaagtatgttaacccatgcttgacagttagtgaactgtaagtaagcagtgtgtagctatgggactgaggtagccatattactctccatgtcgagatgccctcttgtttttattttgcacgtatttcatgtgtgtttgtgtgcgtatgttccccctctccaacttcaccacctggcattcagggaccaaactcgggctgtcaggcttggcaccaagtgccttcacccactgagccatgttgtgaccttcttttaaaactctaaccctgtaattttcagaataaaagaactagtgaaagaccaatgaactaaaagtgagggtcagccctggcctttcagcatagggagagtcctttgaagggtgacgggcatggtggactttgcaagctcagtatgaccacataagtatgggataatacctactcgaaatcaccacgtagtcccatttacattgtggtgtctccgaggatggagcacttgtgtcttttctcttacagatactcattaccttagtaaagaagtgcaagtgatgctctagggaacgggaagcagagcgcgccaggcaggccggggaatggaggtggcaagggcgccccctgctgggctctgactcttgcccttctgctgcctttgtaggaatgtaagaacccttgctgcaatgcctccaactgcactctgaaggaaggggcagagtgtgcccatggttcctgctgccaccagtgcaaggtaagtgtctcctttcctctgcctcaggctttgaggtgacagcctagtgggtggcggctgggtttcagcctgcatcaaaaatttcagacacagggccggggagggtggttcttatcactggccacttgtggtaagaatccatgctttcatgctcagggctctggattcaaccccatcactgggaggaagagaagggagaaagggtgggtgtgtgttagatatttggaactgagaatgtccctttaactaagcctaccaattttctatcctgggcctcattatgctcaaatcacctcatatacatataaatacatatacacatatatatcctatattaagatatgaatatataaatatgtcactaatatatatataaatatataagcagaaatataaataaaaatatacatatgtatgtacgtataaaatcaaaataaagatatatacacatataactgtgtatatatctttttatttaaatagttgatatatctgatatagggctatatacatacatatatatgtgcatttgtagatatatgtacatatatctttattttgattttatatgtatgtgtatatatatatgcatgtgtatatatatgtgtgtgtgaatatatgtatatgtatgtatattcttttattttgagacaagacctcactaaattgctcagggtggctttgaacttgctctggagtccaggcaagtgctgacatcatctcccaggagagatctaaggcaccaggcccagtgagacttcatttttccttgaacacatgaaaaagcaaaccctgattctgatgaacataaatggccatcgtggtggatgtcgggcaccaggaggagaattttatatgctaactgactcagtcttccccacagccccatggggtacacattactgcctctgttttaaggtgaggaaaatgggtcattaggagatgggtggtgtcaggacctgaacccaagttctccctgactctgaagcatgcattcttaatatcaatgcggaaaataatctattaccattaatagtcatatagcactgaatttgagaacttcttttttggggggtggggtttcgagacagggtttctctgtgtagccctggctgtcctgggactcactttctagaccaggctggcctcgaactcagaaatctacctgcctctgcctcccgagtgctgggattaaaggcatgcgccaccacgcctggcttgagaacttcttaatccaaatctgacaagtcaggaagtcccaaaatatataaataaaaaaattaacagatttggtgataaaatctgacctaaatggatatcagactaattatagtttttataaaaagattacctaaaataactttatttcatcataatataccatatattaatatttttggttataaagcttatcctgagccttgttaaaggttatgtagtatatatttttataattatacacatctatcatattcatatagatttgttagatgcacacactattatgatatttgaacttttgagttattaacctgaaactctgagtactagagaagtttgagtatggagctgtggcctgtcccaccctcagcttggcgagcgcacacagtgctcacgtgttgttcaagtaccctactgagcatgcttgctcttagcagccagagagagggctgggatctggaatcatgggcaaacaagaaccaaaggtcaaacgcacagtaggacttggctcagtagaacttggacaccttctgttttgacatggaagcccccagggaggctatgctgagttgagttcttcaagtctcagaccaaggctggagaataagcacggagtgacctttcactcaactccaggatttcagactgagcctctcaaaggattccttgacttaaagcgctacctgtgtgaacttggggaatttttaaactgccggagtctcagctctgtctacacacccgcatgagcatcagaaatgctgatataaagtagctatatcagtttcatggacattgtgaggggcagatgagagaagtatttggataacagtcagccccatgctctgcataccactgagggtgtgctgtttagagccacaagctggatgtagtgagacatgtctacagttctgctattccagaggcttagccaggaggattgccctgagttcaaggccagtctgtgttaaataatgggtttgaggctagtttcaagaacaaaccaagaagttgtaaacttacatgaacaaagcagtaatgttgtaaattgaaaatctacatgaatgccaattttctgtgtgtgggtatatgcatgtatgcatgtaggcatgtacccttatcaggaaactggtctgccacataccacgtgactttgaatatattatgtcttgctcctttagttatataagactataatgcaaactaataaagtcgtagtgacacttaagtgaaagatggttgtaatggcagagagaaaactatagattgttagagaaacattatttctcaactgctgtgggaaggaattgcgttgagttggtccatgtgggtacaagtttgaaggaactcagtcactgtttatgcgaaggccgacgatggcttgagctcattgaagtcgtgtgataagtgcggtgataacaaggtcgtcaaaactgttttccacagataggatgttcatgagctcttggctgaaagggttgggggcagggaagaaatgactactcttctcttctcattcctctacctagctggtggctcctggaacccagtgtcgggagcaggttcggcaatgtgacctccccgagttctgcaccggcaagtctccccactgccccaccaactattatcagatggatggcaccccctgcgagggtggccaggcctactgctacaacggcatgtgcctcacttaccaggaacagtgccagcagctgtggggacctggtaagagccctcctggatggagagcatggtctcttccgcccaccacctctgagcctgtctccccgctggccctttagcttggcctagaacaccttcaaataccacatctcatgctcttagctcaagagtgacagtatttctcatattcccttgaagcttttagttctaacactggacagacagttaatagtactccctccccaacacaccaatgaagcagaaatggagaataaaagaaaatgaaaaagacccttaagctacaaaaaatgtttagcttcagtcatattgagagaaagcaaattgaaactaccatcaagtggggttttttcatggatcagatctcaaagacagcagtgatatagtaataacaacaaccatcctaatatattagcatggagggtatgtcttagtcagggtttgtattactgcacaaaacatcatgaccaagaagaaagttggggaggaaagggtttattcagcttacacttccatactgctgttcatcaccaaaggaagtcaggacgtgaactcacacagggcaggaacctggaggcaggagctgatacagaggccatggagggatatttcttactgacttgcttcccctggcttgctcagcctgcttccttatagaacccaggaccaccagcccagggatggcaccacccacaatgggccctcccatccttgatcattacttgagaaaatgtcttacagctggatctcatggaggcatttcctcaagggaggctcctttctctgtgataactccagcatgtggttttgacacacaaaaccagccagtatggaaagaccaatgtagaaagcattttagagatagcaaaaattttaatgtatttaccagttccattaattacattaggcttaaattgttttccacttaccctttttttttttctgagaagtttttacatggcatggaacaatttgtgagtatataaaagtaggtatatacagcaaacatttattgataataaatcacaaggaaatttattttaaaataatctttcatatataattttaccaaagcaaatgtatactttgacaaatcggtgtgtttgtttgggtttttttttttttttttttttacataaagaattaagtcttggctaaatggttgaaagtgcaggacataaagggtctgaaacagttttcaaagttggctgattttatagttgtcagggatgggaacaccaacccacatcgatatgtggtgtaaaagtgatagaagtatgtttagggccttaccaaaaatggttggaaattctaatctgacaccaaatcatgattcgttcagtgacttttatctttatttttttgagacagggacagggacagggactttattttttgagacagtgtgtgtggcctgcttgcctgaaacttactacgtaatccaggctggcttgcaactcctagagatctacctgcctcttcctctctagtgctaggattaaaggcaggcaccacactcagctagtgttttgttgttgttgtttgttgttttgtttgttttaatggaactgaagtcaggaacgcaaacagcaattttataaatcaaactttctaacataatattaacattaatctgaagtttatctgctgaggaatgacagtagggaaaacattttttgttttctttaatgaatccattgcataagagacaacatacatacaacaaaaatataaccagtcataatataaagtagcctcaagtctgagcttgtctcagtagcattcatttgttgtgtgcatctgtgttgaaagccaagctgtagtaaagtcacgtgacacttggcatgggtgaactctgaattcatgacacattctgttttcagttagttttgggtcattgcacatttagaatctctttagtgttgccagtttttttttgagctccatccccattcaggtgtgggattctatctgcctccgttttcagaagctgggcagtacactacttagaaacaacctcgggttgtatttgcttatggatgtaaagatgctttgtaagatgttgttacactgttgcaaattgtagcggcagcatccttaagtcagacaactgaatgccctgaggctgaattctgtatccgacaaactaaaaccccaaagggcagagcagaaagagaagagacgatgcttccgtccttcactgcgttctttcaagaagatgccccaagatcaaatctaagggatgcaaaaggtagagaagacattttcttctctaaaagacacactgctaaagattgttgcttttccatgatataagagggaaaacaaggtggatgtgaaaggaaaaactcccaaaagatctattttagctcttttaatgtttggggcatgaattactaatcttttacggtccagaaataggatagctcttcttccattagctagcaggcttagcatgcagctgccatagatacaaatcttcaatgaagggttaaaaaccaggctaaaaatattttctctgaattggccttgatggatggtggaagtgtcatgcatgccgttgcccaagcctagctggctctgtcacggggagccgctggcgggcttatgcactgacaaatgtttcttgcatacctaggagcccggcctgccctcgatctttgctttgagagggtgaatgctgctggtgacacctatggaaactgtggcaagggcttgaatggccaatacaggaagtgcagtcccaggtgaggaccacagctctgacccggtgggaggaagagtggccaatcgatccctgctctgacctcttcattcccacctgacttggtgtggatagcctactattggcttttaaacacaccagtttaagcctctctctgttctctacctattgcttggtgatgcactcactgtttggttggctctaaggaagtgaaaaagaggagtgggcagcattgcttcctaggaagctgatcaaggctgctttggagtctctggcctataagtgcaggacaaggtagttggacatgcctttatcccggcaccggggagtcagaggcaggtgatcatgcggatctcggtcagtttgagaccagcctggtctacaaagcaagtgtcagaatagccaggactgttacttagagaaatcctgtcttttttctttttaaagtgaggcaggagatgactgatctgagatgacaatgttccagcatctaaatgttgtggatcccagacggctcttttttggaccatttttgcagagtgctaaagttatgcctgctcctgagagccatctctgattcattcattccagccacccactcactcctctgcccactactgtttcagattcaccacatgcaaggtgctgaattgagtgtctagagcaatgtggttaactggtgtaacagttaacggcctggagcatcttcccaaggtgttctctagctgagttctagagcagccatctaaatgaatgggggaggagttgcactagtgtgtaaaacagtgttttaggctgagatattagagaaaaaggagcaattgacgaactgatagagagcaagctacaatttgtgggaagacatgggcgggggtggcaagaaaaatgagcctgggcagaggaaagcaggaactagatcctgagagatataaaggcatctctggatgatctggacccctcccatggatgctgcagtgagggggctctgtgtcttataggccaggatagaaagggagtaatatatatatatgtatatgtatatgtatatgtaatatatatacatacacacacattcatacatacatacatacatacacacacacacacacacacacacacacacacacacacacactcacacacacgggctggtgagatggctcagcagataagagcactaactgctcttttgaagttaaatcccagcaaccacatggtggctcacaaccatctgtaatgagatctgatgccctcttctgatgtgtctaaagacagttacagtgtacttacatataattataaataagtctttttaaaaaggggggataagaatgtaagtcagggaagctgtgtaggagggaagattgacagggattgaaaatgctcaaacttgggaacaatgaagaatggggaggcagagggagacctagctcctagtttggagtgcctggggaatggatttgggacaaagatgaccaattattcatgtcattcaggtgtccttgtggttaggacatcctaagttgagctcttggcttaggtctgctgagacacaaggaacctgccccttttctgggtctgagtctacctttggtctctactgccgggttccagcccactctctggtcctttgccctgctccaccgaagcctactgacttggctcagactgaagctctccaatgtccccgctcttccccagtctctgatcctgtcttctttcctggcccagggatgccaagtgtgggaagattcagtgccagagcacccaggcccggcccctggaatccaacgcagtatctattgacaccaccatcaccttgaacgggaggcggatccactgtcggggcacccacgtctaccggggtcctgaggaggaggaaggggaaggtgacatgctggacccagggctggtgatgactggaaccaagtgtggccacaaccatgtgagtccctccctaacctcactcagaaaccaagaggcagaggcagaggcagagactgagaagtgtgggctccggaggagtgatgcccagctctcagaataacagcatcccacctatgactatggacctagtcatgtaaacgcaggcatcactgtcatgcatgtcatttactatcctcatagaaatggtctaaggctgggcgtggtggcgcacacctttaatcctggcacttgggaggcagaggcaggcgaatttctgagttcgaggccagcctggtctacagagtgagttccaggacagccagggctacacagagaaaccctgtctcaaaaaaagaaaaaaaggaagaggagaaggaggaggaggaggaggaggagaagaaagaaagaaagaaagaaagaaagaaagaaagaaagaaagaaagaaagaaagaaagaaagaaagaaagaaaggaaaggtctaagatttcagggagacccaaggaaaataacgccaccaaccccatgctttaaattgtgttaaattataaacacagaggaaacctatggtacgatgcccagctgaaagtaagctcctgccacaatcatgatttttaggcatcatcctaaacttagtccatattcattgctggatggaatatagtcagcatgacgctagactataaacgtgtcctagttgttgaatgtaccatttcagtaatgtttgctgctccttccctaatcacaaagacaacagcagagttcagttacccactgaatcttttttgaggccttttgcatttctcactagatatatagcccccagctatgttttggggttcccattcatcctaaggacaaacctcccacaccctaagcctcccccatgcccctgtgtcccgctgatggctgcccttctatgttgcagatttgcttcgaggggcagtgcaggaacacctccttctttgagacggaaggctgtgggaaaaagtgcaatggccacggggtacgtgtgtgtatgcagaggtctgggttcctgggtgttgccctgtgggaggtcacagctctcctgggtgctgatgcgtctgcggcccctcactctaggtctgcaacaacaacaagaactgtcattgcttccctggctggtctccacctttctgtaacaccccgggagatggtggcagcgtcgacagtggtcctttgccccctaagagtaagtgttctgctttgtgagagaggaggaggagaccgtggggataaggggtaggttggcaggagcctctagtcttttgactttgcaatatggcatcgttgtctacaaacctgttgggctgcattcatagctattcatggggattgtgggccataggctgggtttgcccgttgcagaaagtccaaggtaagctggcttcactctccagattctacagggagggagccaagataaagacgctgagtgggaggatgccaggtcttcctatggggcctgggcttagtcaccttcctgtccttttactagaggagagaggggcaggggtagatattaagggagactgaggccactggatagtcacaattatttggaggtagtaactagtaattagtccttttagggacacttgaaataattacaatcttggggtgcattgtattggttattttaccttttgttaaataaggttaagaaatgggaaaacaggcaagttttacagttcttaggggtggtctcggggacttgacccctgtggtttccagattgtgtctttgaataatggcaaaagtactttaaaaaaaaaaggctaaaaactgggtgtggtagttcctacctgtaatcccagcatttaggaggctgaggcaggagaattgctgctgcaactttgaggccagtctgggctgtaacaaaatgaaaacagacaagaaggaagagcctgactatgcaatgaccatgaacagagcaagaggagcttcagtgatgcaggcacactgtgtgcatttacatttatgactcgggaactgttgagatgggctttggacccaaccgtgaggctgagggcccagggtgagagttctagtcctaaaatgtctcaaccagtattttctggccattgctctgtgtccaggaaaatcgtggtgctggctgactttatgaaagtccatgaactgctttgggaagaatctctgaggcagctggacatggggactgtctttaaaagcccatgggtgggcctggctctttcagctagtattaggacaccaatagagtatgatgtgcgttgcatgtatttgtgcttgtttaaactaagtcggcgggaatcaaatacctggagcggaacaaaggctctgtcattttactgtagcctgatcagcctctaattctctcacttgtgctgacttccggcaggtgtgggtcccgtgatcgctggggtgttttcagctctcttcgtgttggcagttctggtgctactgtgtcactgctacagacagagccacaaactgggcaaaccctcggctctccctttcaagctgcggcatcagttcaggtgggacagggtgctgtgcctagcccttgtggaaaggttggtggttatgggtctaattctgggatgatgaaggcagggaacatgccaccctcaacccttctgtcctctcagtcaccatgacagacattagtagataatgactgtaagtgatttctactgagcctggccattaacttgaattcttcccaatagaaagcccttagccggttcaaactggggtatgacataaaatctatttaccgtcccctacctgattaacttatcttgtttttaaagtgcaggaagctggggcgacagagagggatgacaagctcaatcagtcacagagataactagacattagcccaagaagacgaatgattaattcattgagatattgatggagcatgctctctagagtttgttaaatgtacttgcatggggatcccgcatccttctgttatccatgccagtgggggtcggggtacatggtggttagtgatattctgtctcctaattgggatggaggggtctgcttgtgcaaggcagaagccctcccttgggcttctccactggccgtgtgtgcgcttatctattattcaggagatgggttttagaggattatcccgctttcttcagaggagggttagatttgtccgctggcctgggtcggatttgcttagtccacacacaccactgaacactccttcccccatgtcccctcttccttgtttccagttgtcccttcagggtatctcagagtggtggaactggccatgccaacccaactttcaagttgcagaccccccagggcaagcgaaaggtaagggctttgcaccattgaacttgactgagttcccttgagatccctgttcggctttcttcggtacttatgtgtgcccacggggttggtaatgaaagctatctttggggcttgaagttggttctgaagcctggaatccaaaggtcagcatgtctgaaagtcacctcattgagacacacacttagggaggattccttatctcagctgctctgtgtctccttcatataggtgactaacacccctgaatccctccggaagccgtcccacccccctccccggccccctccagactacctgcgcgttgaatcgccacctgcaccattgccggcacatctgaacagggctgctgggagctccccagaagctggggctcgaatagaaagaaaggagtcagccaggaggcctcccccaagccgacccatgccccctgcacctaactgcctactgtcccaggtaagtggattctcgccaaccctaggctggggacatcgcccatagcaggccatcagcaatgagggggcgttgatgtgatgcactgattggatctgatcatcctttctttgttctggtaaatccaatgggcttccagaggtttagcaataaaccttcccagccaggtggtagcagtacacacctttaatcccagcattcaggagtagaggcaggcaaatctctacattcaaggccagcatattctacacagctagttccaggacagctaaggctacacaaagaaaccctatcttgaaaaaccaaaatacttttattgctgctgctgctgctgctactgttcatcatcaccatcatcatcatcaccaccatcatcaccatcatccctaagccactaaagtgatgcttttctcctatttgatttccacacactttgtaccccaaattaacttctttcggttccccgagagctggtcctcttcaggtcaatgcagatgctgtttttccccaaacacaccacacacacacacacacacacacacacacacccctgcctctgcctggcctgttcctattcaccgtcaattgtgactttagataacactcctcctgaggggtttctctcacctagtaaggctgatcttagtgccctgtgcttctcccatcgtattcagccccacaaagtgtatctactagttagcttccactcaccaagggtcttactgaagggtgcaccacgatgcctcgcttgcctgagggagtctctgggaggtgatgggtctggactgtccccttctgtgtagctggtactcacaacttggagctgtgacagagtggcctgttcgcttagcgtgtgtactctggtataggttccccagtgaagacatggacatctcttgggcagtggcctctaaaactgattgtgtctgctttgtcttggtatggcccaaaggctttcccagggccgagtttctctgctcacaaccaccccatggtcagcttcagaccctagggcgtgaggacagtgagggtattgggttgggttctgtgctgtgaagcagccccttcgcaagtgcctgtgtgtggggccaggatgagacatacaaatccacgcagagggggagggatcgactgcatctgatatgttccggtacaagctcagcatacccagatcactcccgcttaaccactttaaaccctgttccatgacattgagccatgcatgccccgaaatgggccagctcttactatctttgtaaacgatgaccttaaactgcgcatgctcagggaaggtacatctaacaaatgtgaatgtactcactggatagagttggccttgctgcctttggaggggcgtggtttagcagatcctcatcatgttctcctgaacatgcagggtataaactcacacatgtacataattaaaaataatacgattagccaagtgtggtggtacatgctgttgatcccagcacttgggaggccaacacagatggattgctgtaaattcaaggccaacctgatctacatgaagagttacaagatagccaaggctatgtagaaaaaccctgactcaaaacagcagcaataattctttatactaaaatatttaagtagtacagaagtgtgtgtctgttctgagaagtttgattagctctttgtttatgttcctagtgttgagttaccttcttcctgagtcttagtgctccccaaagcctgcaatgtctccatgaatcagacagaaaaggtgccccaccccggctggaaataaaagcctggtaaattatttatgttaatagggataaaagatatgatgagaaataaactaattaaaaattaggcttaggggagccacatgtacatacatacacacacatgtgcatgcacatggacacaccacacacatacatacacattctctctctctctctctctctttcacacacacacacgcacacacacgcacacacacacacacacacacacacacacaccactcattccgtcttcctggttcatgtccacccacgtctgttcatcgccattggctataggcagggatgtggtggtctgctttgcatacacgctcctctgtcggggccatgtcagcttgtctcgcagctgactgtcctcattagcccagatgccctactttactctttacacacactgtagcccacatcactgggtaagttatacttttctcccaccgtggctattttggaagtttctgagttctctggtattataaatcatgtgtacatagggacatccttgcaaaccagccttctgcagctctctaacatggtcaaacagaagtgggatttttcacaccaggaaaagacattttcttcttctttttttttttttttttttttttggttaaattttgggacagggttttgaattcacagacccacctgcttctacctcctgagggctggaattaaaagtgtgccttatcatgccatgcccatagctctaattttaatagacagccaacttgttttccaaaaaggtcttatttttttcttagcatgtgactacattataaagtagacccccgcataggagagtcctttagaaatggaacaatccggtacgtaagttattttggctgtgacccagaagatactaggcatactttcttttgaagggagaccctcaagtcagacttcttgcttcctccaggacttctccaggcctcgaccacctcagaaggcactcccagccaatccggtgccaggccaaaggaccggtcccaggtcaggaggcacctccctgcttcagccccctacttctggtcctcagccccccaggcctccagcagtgcctgttccaaaggtgagtccacagaaggacccagaaggaccagagaggaagtgtgtggctgagaaggcagtcccgtgccccacgctaggttctagaacagaagcagaaatgaacacgtagcctcgcttggaggtctatttggctgtaccttacatgagcaaagggaggtttgaatttccttgagaatgaaagcgtcacacagaagcctaagctctggtggctttgatggcacctgaacagataggccaccttgagtaaatccttatctcttgataagaaggcttaagattggccggcaaggtggttcaaggtaatttttaaaaaggccagagaagcagcagggaccagctccatgacattgctctgaaggccattagtttatacaagcctgtcaacatatgtccctttccttaacgcttctctctgcctgccatgtcctcggcttagtctggggagttgggtcagaaggggtgaggcaagaaagctggttgccagcccgtatcccctgaagcactagggaactagatgtactgaaacttgatggaagaggggaggggctaagtttccagctttgggggtggccacacaattgctctcactacaagggccaatggccctggaatgcagccgcggggacagacttctgagcaagaggacacttgcccacagtcccactgaccagcactgaggtcacatcgttttttgtttttgttttttttttttcctttccagctacccgagtaccgatcacagagggttggagcaataattagctccaagatctagaagtgtcgagaagtttcttgttccgatggaagactccggatgccatggaaggtccagaagaaagacgccttctcacccatcctgaagctttggcagccttctggaacgtccctcatccccagaatctcccttcttacccgagtgcctcctgcttcctccgaggcccagggggactcatatccaatggctcctaagtgtttgtcctgtgcaatatacagcccagggagggaagggaagcacggcgaggagggtgggaaaggttctccctcagcccactagccaagagctaccagcgatgctcagggaaggcttgagctggggtcctcctctgcggagcttggagaaggtacccatcctggtcctatgctggcaggaacacacgcgagtgtcactgattggcctccttctgggatcccaggctgctgaggaagctactgctacatccctaccccaaggggcttggtcaaggtgcctgttcctggctctctggctgcatgtgataagccatgctcccctcccctgcctttcttcacattcccactcccatatttacacgggtcactctgactcagacaggtactatttgtaagtagcatagacagcaggggggtggggtggtcaacctgtgtcccctctgagccgttatgccaaaggtcactaaggacatttagaatccccatccatccatccatccatccatccatccatccattcatccatccccagtgttccatgtgtcaccttctccttttccagcatccctatcctatggtgctttggtggtgaactatggcagtcctgacttgctgatgaccatatgctggtgacctacaaatcgggatcctgccatatggggtcgccactggactttctgcactggatctcaagagcgttgagccgagtgggcgtgtatgtgtgtgtgtgtgtgtgtgtgtgtgtgtgtgtgtgtgtgtgtgtgtgtgtgtgtgtgtgtgtgaaagagacagaggcaatgagagagacagacatgcaggcaggccgacagctctgcatgtacttgtgttttacggcctcaagcagaataagggacctcctccttatttctgactcatatctaagtaaggttccccaggacagccacagttgtactgaggggggctgacatgtttggcatcctggctatagtattgtatacacagggccaccagccccgccctagtggtcagctctgaggggggactggtgactctgaacagatcgatgtcaacagccatggtgaaccagatctgggcagggttccccaaactctattcaaccagagttttatcacgcacctcatcgggtctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttagctcttggaaccctccagaggaagaggcaagcgtttgacttcccctttaccacctgaggcctccttatatctcttcccagagtaagctttgggattgtagacatgtgggagctatgacagacgtggcctggggtagaaagatctcaggaaagcacctttctccttttcagggtgaccgtgctcttcacactctctgaggcctcagtccatgtcctatatcagtttctcttttgtgtgctttaccaagtggccggtgactacaggccaccccgattctcaccacaaagttagaaaccctccactttctgtcccttgaaccatatcagaaaaagacccatttccttgctctttggtaatcacttctgtttttttctttttcattactttgctaccacctccatcccatgacattatactgtgaagtgtaagaggacggggtttttttaaacttggtagaaatgtcggcagctgctctacacacaacttcactcaaggctttgtttccagaggccagctaggctgtcacaggcaggaatcccttcccatctgctttgtgaagggtcccatacaggtgtatctagacttcaaggacagggtttgtctcacaggattgtcacttaggagatgaaagaatattaccacatgaggaggaggggcagttgcaacagaacactttggtcttcctacaccaagtctgtgagggcatccaagactgaatgaaagcgcttttcttatgcatacaatgtgagcaagaacaagaactgtttaaggcacctctgttcccagccactgaagagagacgtcagaagatgttagaataggtcaaagccaaggctctggtgggctgagggaaggtttgtagctgcgtttagtggtatacatctttagtcccagcataggcaggtgaatctcgagtttgaagctagcctggtctaaaaaggaagttccaagactgccagggccacacagaggaaaaaaaaaaaccctctagaaaaacaaaaatgaagacaggatctcatgtatcgtagattggcctttaagtcactttaccaaggatgatctttgaactcctgagtacagactgcgggtgtgtgctaccatgctttatgtggccctgggttcaaacacagcccttcatatgtatatagccaaacactctacaactgagctacatcctccagcctaggctgtaaatgttttttggagctagattagctgcctgccaaccttagaactgcaaagccattcctgacctgtaaacctcagctctccatctctataagaggtatagcctgggctaataccgtccaagttacaactccttgcttgctttctgttccttctagccttggtgacttccaccaggaagagaataccccctctctacccctgctccaagacactgtagatgctagtgtcggagtgttctctgtaacgcgacagttccttctgttgcaatagcccccctgcaacactgcaataatccttcagtgtctcccctgggctcaattcacttccttatttgacaaagtggaggtgagacttgtattcttaaaattggaggctagttattttgtcaaatgcatgtaatgaacagacccgaaggaatcctccacacacaagccagggaacaccaactggaaaggtaccccgtcccagggaagcctgctagggagaggttctgtagaatccgagcctagcaccccaaagtcatgcacccagtatcctcttgtatgactgtatatgtctatgtctgggatccagggcaaatgtgaattttcttttgatttgggagattgttcacaggaagtagtcctcccctctcatgtcctcctattgattgtttacaatatttgtacatctatgcaaaatacttgaatgggccatggtgccttgttttttgttgttgttgttatttttttctccttgtttgtatttaattaaaacaaattgtcatgaggaaatgttctctgtttggatggctcttttgtgtgtgaactgtttcggtaatcccactgccaggaccacttaagacatgtgatgtgaacgtctcagaggactcatacagaccaacagccttccagtcggccatgacctgtgccacagtgatgccccggggtttcccatggccagtagtcagggctgcctgctttgtacctgtgctcaagatagtctggtttcattaaatcttggattaccaaaggctttcataatcttttagattctagaacattcttctacactattaactttagaagacagctgagatactctgtgaccaactctcttcactagggggtgtgctttaatgaagaggagagacttagtgtgggtcccgggctgagtgggtaggtgcagggaggccagcttgtgtgcacttaagatttcccaggtctgtgtggagactgctggtctctcaccaacttttacccatttcctcccagcctctgttttgaggttttctaagattattaataaccacaggagttttactgtgtaggtctgaatgaaaatggcccccatagaatcataaggagaggcattaatggaggtgtggccttgttggagtggatgtggccttgttagagcaagtgtgtcactgggggcgggctttaaggtttcagaagctcaagccagactcagtgtctcttcctgatgcttgggggtccagatgtagaaccctgagatacctctctagcaccaggcctgcctgtgtgctgccatgcttccctccatgacgataatagagtagacctctgaactgtaagccagctccaatgaaatgttttcctttataaaagttgccatggtcatggtgtctcttcacagcaataaaaccctaagatagtcatctcattgaaccctcatgtaaatgctaagaaagcatcatccttcgtatttcatatgctttttgccatatgcctggctcctagtaaggtcatcacctctacatgaatggtactaagaaatacagcaaccttccctgtttgagtgagggcagatcttggaagacacaggagggctttgctttggagatcagggactggcatcccagtatgtgagaggaaccagtggagtgaatttgctccgtgtacatggaaggtcaggacatttgtcaagtaaacacaccctgaagtctttattactgaccccagagcccacgttctcagaaccttcagtttactaacccccccccccaagatccagtgtgttgcattgatttcagtcacagtcagaaatccacattcatgaaaatactggggattgggaaggtatagggcccagagtgttgatctgccctaagagcttgtccaaggccagaaacagtttgacctgggtgtggttgtacttaggggatcagattcgaacacaggatcgtattttgacagtgctacgtacactgaagatcaagtttccccttccccacaaactggctcctaacttcactctcttatgctccttgtgtcaagtctacactttcacagctgtaagaactggaagaaaaggctctctctctctctctctctctctctctctctctctctctctctctctctctctctctctctctccagctgctattctctgactgcttctggccaaatgtaaggtcaccaaaagtgaccctaagagcaggtgatggtggaggactcatggcatgctgtttccagtgtgggcagctaggttgtcaatggagataaactcagttccagttgggccaacaaggctgtgtcaagcctgcactcccatttgattattgggattctaatccaattccactagatacagctaggaaatttccccagaggtctggtccttgctcgaatctgagtcaggccaaacattatgtccaggtttccatagagcccatgactccattcagacaaccatgacattgtgtcttatactctccccctcttccccaagtcatatcatagtcaatttcttgatgcaaagaaattgcattctgctaaattccagcatgacagcacagtgctgttctcttcccagaggctgctaggtgaacatgggtttgaacagcggagctggactaggaggcatcccctgctgttggttctaaggctacagcctacacgtgtcagtgactggtatcttgggatgggcagagagggaaggatagtagtgcctgccactggaggcacagacaacaagatgtgacctcaagtgcttggagaatgggccagttgaaacttccctgagacatcaggtggtattcacagtaagaaggtcagctggggtcttgcttctgtctacaagaaacaccaggctacttagtatgtgctacacaccttggcatgacgaggcatgcagattgctctgcactcccccacaagctccattcccgggctaaggactgagaagtccagcctgacaggctaattggtgtgaaggagttcccgatgaccgatagctgagggaagttcttgagctgggctacattcagcaggtcaaattctaccaacaacatggtggtgttgagggacccagaggggagaggctctggggacttgctggttctaacagagacttgtggatttagtcaccaaggctgtatctccaggaagtcctgcccctaccttactgggtagggatttttcttcttcgtctaggaacagcagtgaggtataaatgaatatctcaaaaaaagaaactagcccttggcaacagatgtgctgaaagtaaccaggtagttgtgaacttgagaggtcaggctggaccattggctgcctcctcttactcatgcattccaggctttaagaatcggtcataaatactttgggcttctgttggggtgatggtgtgctggcaagttctatgttatctacaaggacattcttgtcttctagtttaatgactgtgggctctggggcgggagctggagttgggtttttgtgcgtgtggggcaagctgatttggttgatgtccaaatccttgaaagcgtgaagcataaaaacacccaggatgatggtgacgaagccagacagggtgcccacaatgtccacagcagacatggtataccactccttgaagaggacgatggaggaggccaccaccaccgtggtgaagaaaacgtagtagatggggaagaccaatgaggtgttgaaaatatccagtgccctgttgaggaagttgacctggatgatgatagaaagacccaggatgagggacaggatgtaagggagagggtgccgcacaactggtaagccctggaagaagttcctaatggtgacaccaagccccttgacggcagtcacggagaaggatccgatcacggagcagatgatgatgtaaatgaggatattcctttgcccgtaacgtggggcaacaatgaagatgaggatgaggcaagacaccaccagaaggacagcaaagacgatgaacccttcaggaaggatgggtaaaagttattcagcaaaggactcaagggtatctagggccccagacttatagcccaacagaggtgggttctagtcccagcctcagaccttatagtaaccctttttagtaacttatgcaagttactaaactctttagaccttagtttccccatttgttaaaaaaaaaaaaagaacaaaacaatgggattccttttatcttgaagagctgttctatgagctgatgcatcgtcttgcataaaatgttttataataaaaataatgtgtatttagagacatgcctggcacatgataaattataaatactacgtatttacatcaatccgggaagccttgcaagcaggtaccatccagcttcctctctgctgttcatcttttcctcaagggggcagcctgaagatggccagagcccaattactctatacacaattcatccccttgtgttttctgcaaacccagtgcttgaaacctacctgtgtctttcatcttggaagccatctctgcaacagtggtgaccttctcctctttgggggcatgtatgaccatcactgtgctgccagccatacagatcacacagcccagtttccccagtagattcaggctctctcccaggcagtaggaggaaaagatggcactgtatagggggatgggagagagggattgaagggggtgcctatcccagacctacaaaagacacactgggggttgagtgaatacttatggagaacaacagtccagaactcacttctctctgtagaaggcttcctagattccctctgtctaaccccaaacctttcaaaagtagaaacacacttctaggggattgtaatgtgtgctggacaagcagaaatacacatagatctccttggttggtctattgtcaagttgacacagctaaagtaatctgagaagaggtgacctcagttcagcaaatgcccccatcagattggcctgtagacaagcaatggagggcattttcttgattgatatggatgaactgtgggcagtaccatccctggatagtcctggggtgtataagaaagcaaattttacaagccaagaggagcaagctcctatatggcttctactttagtttctgcctcaaagttcttggctttcctccatgatgcaatatgtaagcccaataaatcccttcctctccaagttacctttgataatgatgtctcatcatagcaataaaaagcaaacaaagacaagttgaaagagcctttcaaagtactcttgtctgactccccattgactgaacctattgttcggcagtattgccaggagatgtttttcaaccatggcttgtatgcatctggttgcatgaagcaagccaaatgcgtacattgcgggttcacactatgtaccccacatacgttttctgtcaatttctgttccttgttccattcctgttccttgggtcatagaatatgaatctacttctctttcacttgcatatggcaatataaatcaccacaacaataataacaaacactatgtttggggccatgaatttcttaataagttctgtgttagagtcaatctggcaactctgtgaattaacatatactgctcccactttacagataagaaaactgagctcatagaagtttaaatgattcggcaaagtcctttgactggtaagtggcaaaggcaggttttgagcaatactttgatcttattacaaagctagtgagttttcctctatgttaaagagaacttttatgctttctagaatctttcctgagtaaaatccttctagctccttggtgatatcatttctgttctttctgattgtctaggtaagggaagaaaaagggggactgggcaggctgggaatgagccatgagctcacttgcattatgaaggcagcattagttcacactaaaaatgtattggttgtcctgggacctaggtaacatcaaaaagtcttggcttgtaagcaagcctgtgggacattttcttgattgatgattgatgtgattcggaccactcagttccctgtgggcggtgccatccctgggtaggtggtcctagggctatatgcaaattaggcaaggctggagaagcaagccccaactatttcacacaggcaccaagcagttaagaatcccatgcctcagggggctggtgagatggctcagtgggttagagcacccgattgctcttccgaaggtccggagttcaaatcccagcaaccacatggtggctcacaaccatccgtaacaaaatctgactccctcttctggagtgtctgaagacagcgacagtgtacctatatataataaataaacaaaatcttaaaaaaaatcccatgcctctcaaagcaagccccaactatttcacacaggcacatcccaggaatgggatttgggaagcacctctactgagcagagacaccagtcaggccagttgtgcactgaagagtcggaaatctacttgcttcacaattgtaaatgttgtgaaattatcaccaagtgaaacaacacagaagatattatgggtgccaggtgtggttggctgcggtttaccagagctccagaggtagctcctaaatgagagtacccttccgatgtggcttaaggacccccacagaagtacctacgtccatagcttgagagaaatggggtgatgagaggcacaaatgcttaggcgtaattattttattgtttgggttgtttgggggtgttagcagtcaaacccgggcatactaggtgaacactcctatatcaccagctctaccatcttttagttttaaaattgttgtttgctaagtctttcacgagaggcaacatagtatatagcacagctgctcacatctggcggggaattatcccgcatagggtggagcctggcctggtagcagagtcttcatattgccatacgcaagtagaaaaggggttgctctaccacccaaggaaaagaaataggtcaagtagaacttgctagagagttactttggccaaagcacttaaaccctctgggtcttgggaacaaatggaaggattaagttagttactacacgggttacactcagacgatctaatgggtagttttcctctgtaaattgtagccgcagctgcttggagctagtttttttttttttttctaaatccattcactatgttgtagccccatttagcagtctgggtgtgtatcattagcattctattttgcatatgaatgaattaaggcttgactgcgagacttttgaatccataactgctaaggtttaggtatggattagtacttgggcctgggaaaatggcaagcatgaggacctgagttcaaatccccaggacacacctaaaaactaggtgtgctggcttgtgcctataatccttgtgctggtgaggcagagaccagaggattcctgagctgattggccagtcagcctaaccaattaattggtgagctccagactagccaattggtgaggtccaggcagtgagagacattgtgaaaaactaaggtagaaactaaggaagacaatgaactctgccctctgccccccacagtcagcttacacagaagtgtaaacagatgcacgtgcaactgtatgcacacgtattcccgtatacatgtactacatgtacactataaacaaaagaacactagggctcatgttcttagttcattgaggggatactgaggcccatggcagccatcagtcttagggcctggagctctgaatagcatggtccttcttcccaggcctggaccagtttggggttgatgctcccactttggtaaattcaggtctcaacaaattgaaaacaggaaagaggtgtcaaaagaggggacagtgaccttatgaggacgctcagtgctcccagcggtgtgacaaccgtcgcaggtgcaaatgcataggccccgaagttggcaacttctccagcagacactaggaaattagaggggaaaagaggccagtgtaactccaaggcaccacgtccattccagatgaatctgggcagagatggcgtcggtcagttcaactgcaaactaaaacccaagaccagcactccctcagatcccatccggatgctgtctccttggagacaaggtcagacccagactctgtgttctcccactgtactataaaggtggcaaggcccaagtcctaagctcacagtgacctgaaaagctgccatgttttggatgtcctttaactttcagtacatactctgtaaagtgtgtatcacaggctgacatgccttcatgtctatctttaaaataagttctagaaaatcagttattaaataaactttggattctttgagtaccacttggtccatcaactattctttactaggggaactgtggacagttgtgctgattagttgttttgttgtcgttgttgttgttgttgctgtggttgttgttac

SEQ ID NO: 84 - DNA, 4212 bp, Mus musculus
gggatgtgggctgggtggcttttaggccggcgtttgcttgaaaacctccgccgccgctaggccgggggcaggcaatggcaggggatgtgtgattgcggacagtgagagggccgttgctatcatgcccgggcgcgcgggcgtcgcccggttctgcttgctggctctcgctctgcagctacattggccgctggcggcgtgcgagccgggatggaccacaagaggaagccaagaaggtagccctccgctacagcatgaactcataatacctcagtggcggacttcagaaagccctgggagaggaaagcatccactcagagcagagctcagggtcatggctgaagggcgagagctgatcctagacctggagaagaacgagcacctttttgctccagcctacacagaaacctgctacactgcaagtggcaatcctcaaaccagcacgctgaagtctgaggatcactgcttttaccacgggactgtgagggacgtggatgagtccagtgtcacgctcagcacctgccggggaattagaggactgattatagtgagaagtaacctcagctacatcatcgagcccgtccctaacagcgacagccaacaccgtatttacagatccgaacatctcacgctgcccccggggaactgtgggttcgagcactccgggcccacctcgaaggactgggcccttcagtttacacatcagaccaaaaagcaacctcgcagaatgaaacgggaagatctacactctatgaagtacgtggagctttacctggtggctgattatgcagagtttcagaagaatcgacatgaccaggatgccaccaaacgcaagctcatggagattgccaactatgttgataagttttaccgctccctgaacatccgaattgcacttgtcggcttggaggtgtggacgcatggggataagtgtgaagtttcagagaatccctactctaccctctggtcctttcttagttggaggcgcaagctgcttgctcagaagagccatgacaatgctcagctaatcacgggcaggtccttccaaggcaccaccattggcctggcccccctcatggccatgtgctccgtgtaccagtctggaggagttagcatggaccactccgagaatgccattggtgtagcctccactgtggcccatgagattggccacaactttggcatgagccatgattctgcacactgctgttctgccagtgcagccgatggcggctgcatcatggccgccgccaccgggcaccctttccccaaagtgttcagttggtgtaacaggaaggagctggacaggtatctgcagacaggaggagggatgtgtctctccaacatgccggacactaggacgctgtatggaggccggaggtgtggcaacgggtacctggaagacggtgaagaatgtgactgtggagaagaggaggaatgtaagaacccttgctgcaatgcctccaactgcactctgaaggaaggggcagagtgtgcccatggttcctgctgccaccagtgcaagctggtggctcctggaacccagtgtcgggagcaggttcggcaatgtgacctccccgagttctgcaccggcaagtctccccactgccccaccaactattatcagatggatggcaccccctgcgagggtggccaggcctactgctacaacggcatgtgcctcacttaccaggaacagtgccagcagctgtggggacctggagcccggcctgccctcgatctttgctttgagagggtgaatgctgctggtgacacctatggaaactgtggcaagggcttgaatggccaatacaggaagtgcagtcccagggatgccaagtgtgggaagattcagtgccagagcacccaggcccggcccctggaatccaacgcagtatctattgacaccaccatcaccttgaacgggaggcggatccactgtcggggcacccacgtctaccggggtcctgaggaggaggaaggggaaggtgacatgctggacccagggctggtgatgactggaaccaagtgtggccacaaccatatttgcttcgaggggcagtgcaggaacacctccttctttgagacggaaggctgtgggaaaaagtgcaatggccacggggtctgcaacaacaacaagaactgtcattgcttccctggctggtctccacctttctgtaacaccccgggagatggtggcagcgtcgacagtggtcctttgccccctaagagtgtgggtcccgtgatcgctggggtgttttcagctctcttcgtgttggcagttctggtgctactgtgtcactgctacagacagagccacaaactgggcaaaccctcggctctccctttcaagctgcggcatcagttcagttgtcccttcagggtatctcagagtggtggaactggccatgccaacccaactttcaagttgcagaccccccagggcaagcgaaaggtgactaacacccctgaatccctccggaagccgtcccacccccctccccggccccctccagactacctgcgcgttgaatcgccacctgcaccattgccggcacatctgaacagggctgctgggagctccccagaagctggggctcgaatagaaagaaaggagtcagccaggaggcctcccccaagccgacccatgccccctgcacctaactgcctactgtcccaggacttctccaggcctcgaccacctcagaaggcactcccagccaatccggtgccaggccaaaggaccggtcccaggtcaggaggcacctccctgcttcagccccctacttctggtcctcagccccccaggcctccagcagtgcctgttccaaagctacccgagtaccgatcacagagggttggagcaataattagctccaagatctagaagtgtcgagaagtttcttgttccgatggaagactccggatgccatggaaggtccagaagaaagacgccttctcacccatcctgaagctttggcagccttctggaacgtccctcatccccagaatctcccttcttacccgagtgcctcctgcttcctccgaggcccagggggactcatatccaatggctcctaagtgtttgtcctgtgcaatatacagcccagggagggaagggaagcacggcgaggagggtgggaaaggttctccctcagcccactagccaagagctaccagcgatgctcagggaaggcttgagctggggtcctcctctgcggagcttggagaaggtacccatcctggtcctatgctggcaggaacacacgcgagtgtcactgattggcctccttctgggatcccaggctgctgaggaagctactgctacatccctaccccaaggggcttggtcaaggtgcctgttcctggctctctggctgcatgtgataagccatgctcccctcccctgcctttcttcacattcccactcccatatttacacgggtcactctgactcagacaggtactatttgtaagtagcatagacagcaggggggtggggtggtcaacctgtgtcccctctgagccgttatgccaaaggtcactaaggacatttagaatccccatccatccatccatccatccatccatccatccattcatccatccccagtgttccatgtgtcaccttctccttttccagcatccctatcctatggtgctttggtggtgaactatggcagtcctgacttgctgatgaccatatgctggtgacctacaaatcgggatcctgccatatggggtcgccactggactttctgcactggatctcaagagcgttgagccgagtgggcgtgtatgtgtgtgtgtgtgtgtgtgtgtgtgtgtgtgtgtgtgtgtgtgtgtgtgtgtgtgtgtgtgtgaaagagacagaggcaatgagagagacagacatgcaggcaggccgacagctctgcatgtacttgtgttttacggcctcaagcagaataagggacctcctccttatttctgactcatatctaagtaaggttccccaggacagccacagttgtactgaggggggctgacatgtttggcatcctggctatagtattgtatacacagggccaccagccccgccctagtggtcagctctgaggggggactggtgactctgaacagatcgatgtcaacagccatggtgaaccagatctgggcagggttccccaaactctattcaaccagagttttatcacgcacctcatcgggtctctc

SEQ ID NO: 85 - protein, 914 aa, Mus musculus
MPGRAGVARFCLLALQLHWPLAACEPGWTTRGSQEGSPPLQHELIIPQWRTSESPGRGKHPLRAELRVMAEGRELILDLEKNEHLFAPAYTETCYTASGNPQTSTLKSEDHCFYHGTVRDVDESSVTLSTCRGIRGLIIVRSNLSYIIEPVPNSDSQHRIYRSEHLTLPPGNCGFEHSGPTSKDWALQFTHQTKKQPRRMKREDLHSMKYVELYLVADYAEFQKNRHDQDATKRKLMEIANYVDKFYRSLNIRIALVGLEVWTHGDKCEVSENPYSTLWSFLSWRRKLLAQKSHDNAQLITGRSFQGTTIGLAPLMAMCSVYQSGGVSMDHSENAIGVASTVAHEIGHNFGMSHDSAHCCSASAADGGCIMAAATGHPFPKVFSWCNRKELDRYLQTGGGMCLSNMPDTRTLYGGRRCGNGYLEDGEECDCGEEEECKNPCCNNCTLKEGAECAHGSCCHQCKLVAPGTQCREQVRQCDLPEFCTGKSPHCPTNYYQMDGTPCEGGQAYCYNGMCLTYQEQCQQLWGPGARPALDLCFERVNAAGDTYGNCGKQGQYRKCSPRDAKCGKIQCQSTQARPLESNAVSIDTTITLNGRRIHCRGTHVYRGPEEEEGEGDMLDPGLVMTGTKCGHNHICFEGQCRNTSFFETEGCGKKCNGHGVCNNNKNCHCFPGWSPPFCNTPGDGGSVDSGPLPPKSVGPVIAGVFSALFVLAVLVLLCHCYRQSHKLGKPSALPFKLRHQFSCPFRVSQSGGTGHANPTFKLQTPQGKRKVTNTPESLRKPSHPPPRPPPDYLRVESPPAPLPAHLNRAAGSSPEAGARIERKESARRPPPSRPMPPAPNCLLSQDFSRPRPPQKALPANPVPGQRTGPRSGGTSLLQPPTSGPQPPRPPAVPVPKLPEYRSQRVGAIISSKI

SEQ ID NO: 86 - DNA, 118466 bp, Homo sapiens
  misc_feature (1)...(118466): n = A,T,C or G
catatgaatattttctagttcccattgtaccactacctccaggcacagttgcctcatctgtaaagtaggagtatcagtagtacctaccagagaggataaaatgagataatgcactgggcacattgtaagctttgtccaatcaatagtaactattattattcagttgaaccatatgacattaccaatgcttaactgtttctgacctacaaaatcaacacttcctcatagtttaacctaagatctcttcatgggactattatgggcattaaatgagatgatgtaggcactgtgcttggaaccaatcagggtgctccagatatgatagtagttattatgcaccacgttggtgacagtacccaatgctgacaaatcaaaggacaaaagtcatatgtcaataaacttgatcctcctctgtaatcggtcacttaatttacttgtcagttcctatcagctcctttcttttatgcgcctccctctaccataattgttatagtggaaaccttatctcagaatctctgtagattttagcatatgctgggcacataataggtactcattgaatgcttgctgaatgaatgatttcaagagctttgtgagttatccagggtttagggagatttgcttctcttgtgaattatttaaaaaaaacagaaataaagactaaagtctttaatatatccataaaacttgagtaaaagactctatttagactttaattcctttcatcaaaatggatataatcatcctacctggctacatcatggagtatttgaagagcaagataattgctaagaagctacacatccattacaatggctaaaatcaaaagaactggcaataccaagtgctgacaaggatgcagagcaaccagaactttcataccctgcttgtgggaaggcaaaattttacaaccactttggaaaatattttttgcagtttcttgtaaagtgaaacatacacttaaccacaatacccattggaattgctttcaccctatagaaacgaaagattgtgttaacataaaacctgaatatatatatatagtgactttattcataatcatcaaaaactgaaacacccaaatatccttcacgggtgactgaataaacccacaatgatacatctatacaatggagtactactgaacaataaaaaggaaggaaatattgataatgcagagacctggatgaatcttaaatgcactaagctaagtgaaagaaaccatatccagagtctatatcctgtgtagttctatttatatgacattctggaaaaggcaacttgagacggacgtaaaatagaccagtgattccaggagtgaggggagtggctgaatgcaaagagataggaggaaagtttttggtgtggtcttgactgtgcaagtggttattccactgtgtgtgcttgtcaaaaatcatggaaccatagatttaaaaaatggagaatgttaatatatgtaaattatacctaagtaaacggaactttaaagaaaagagcaagttgctgagaaaatagttcacaaagcaaagttatcactggtccaacattattcccataacagggactcaacaaagatgattcttcaatgaggggcttgaaagtttgcgctgagccaggatgagataattattattaattgtttaattctaatttgtttaattaaacattgattgtgtctcccaaatgctggagggctgagtgaagaacaaggtccagctcttattcacaaggggctcacgatctagggagaggggataggaaaaagacaataatagtataacatgactattatcattgataataattagagaacgagtataattagactcttcacacattatacaactaaaagcacaagctaggcattataaataacaccacacctcttagtactcactagcagtagaaggagggtaattctggctagcatgcattgactgcctactctgtgatgggtgccattctaaatacccatttaaggctcacaaaaactgtcattatcattgtcctttatagatgagacaacaacatcgcagaaaaatttagtggcccaagttcacacagctacgaagggacagaaaagggatttaacccctggcaggatggccacttcctaagcataatattaatagtatactctagctagagatcaacagtgacctgtgtcacctcaacttccacattctggaactggttgctgtaacttcagcccagttttcccatcgtcagaggagaaagtcagccatatatacagaggtcaagtttgcaaaactctctgtttaacataccaggaaaaactctttttccttttgtgttcctttctgtttttaacacttgcccaccttcccatgactaaagtaatatagttatgtgtcatataatgacatttcagtcaacgagggaccagacagatgcctgatcccataagactgaaacattcctgtcccctagtggcatcatagcccatcgtagcacactgcgttgtactttctatgtttagatacacaagtaccgtcgtagcacactgcgttgtactttctatgtttagatacacaagtacttacaattgtgttacagttgcctacagtattcagtacagtaggatgctgtacaggtttgtcgcccaggagcaataggctataccatatggcctggttgtatagcaggctatgccatctaggtttgtgtaagtgcacgctatgatgttcccatgacaaaatcccctaatgatgggtctcagaatgtatccctgtcattaagcaatgcatgactgtacttcactattgtagaaaatgaaagagagagaaagaacaaacaggaaaacaaaaccaaaccaaaaaaacccctgtcatccatagttttaccatgcagaggtaaccactgttaacattttggcacagttccttctagtctttttaaaaatgtcttttatttacatagctgagatcagacttaaatgtaattttggaccctgctttttttcacctaccatcagagcagaaactcccatcattttaagtggccgcataataatccatcttatggatattctataatttatgaactgttctttcacagttgaatatttaggttgtttccaatattttcactattataaataacacaattatgagcattctagtccataaatctgtgtgtgcactgcagattatttttttaggatcgtttcccagaaatgtaattactaggttaaatgtcacgaatatctcaaagattatgtagcgacttaatattctttataaataacatatatgttctttacaaatacatgggaaggcttctatgaggtcaaagctgtatatatactcgttcctgtggataagtagggaggacgagtaggatgagacgacactgggaactctgtgacttcttggtcatgcatgaatcactggactttttgtcttgtgagctacctcccaattttcaggcctacatgctacttaaatattgatcagttgagtgccagtaaagggaagggaactttgagaatggagtttctatgtcttttgcaaggagacctgtctacaaagtcagttaggcatggcacttcagcattttccacttgtcacggaactttcacttccatcatctcaattgctcatcacagctcctgggtgagatgcactggcggcagcctttcccgttcccaagttattcagcagaaactcagtcccagaaaggagaagtcacctacccaaggtcacggaggtggttagagagaaaactgggactagaattttagtctcatggctctagggttatagccataattatagactacatttgtctctcccaccccccaaattcatacgttggaaccttaacccccaatgtgactggatttggagatagggcttctacagaggtaatgaaggttaaatgaggtcacgagggaggggccctactccgatagaactgatgtctttataataagagaggctgggcgcggtggttcgcaactgtaatcccagcactttgggaggccgaggcgggtgaatcagttgaggtcaggagttcgagaccagcctggccaacatggtgaaatcccatctctactaaaagtacaaaaaattagctgggcgtggtggtacacacctgttatcccagctactcggggggctgagacacgagaattgtttaacccgggaggtggaggttgcagtgagctgagattgtgccactgtactccagcctgggtgacagagcaagacttcatctcaaaaataaaataaaataagataaaataataagaggaagagacccaccagcgcatcccctccactctctctctgtctcactgcatgtgcagagaagaggccgtgtgagagcacagtgaggaggtggccattctacaggccaggaagagaggccttgccagaaagcaagcctgatggaagcttgagcttggacttctagcctccagaactgtgagaaaataaatttctggccgggtgtggttgctctcgcccgtaatcccagcactttgggaggctgaggagggaggactgcttgagcccgggagtttgagaccagcttcatctacatggcaaaaccccatctcaacaaaaatatacgaaaattagccaggtgtggtggtgtgcgcctgtagtcctagctactcgggaagtggaaggatcgtttgagcctgggaggtagaggttgcagtgagccaagatcgcaccactgcactccagcctgagcaacagagagagactctgtctcaaaaaaaaaaaaaaaaaaaaaaaaaaaatctgttgtttaagccaccagtctgtgctattttgttttggcagccttagcagactaatacaggttttgatcctgagaagtgggctatgctataacaaaatacctaaaaatgcagaagtgagtttggaaccgggtaatcggtagaggctggatgagctttgaggtgcatgctagaaaaagccaagattgctttgaaggactgttgatggaagtgtagatgttaaaggcgattctggccagggctcaggaagacaggaggagagctatagagaaagcttctgtcatcttagggaatgcatatatcaccaggaacagaatattagtagaaatatgaatattaagagctattctggtgaggtctacgatggaaatgaggaacatgttattggaaactggaggaaaggtgattcttgtgcaggggctaagggaaaacttcccctttgccctctgaagtttcagcaaaaaatcaactcacaaaaggcagattaactggagacaatgcatacaaatttattagcatgcatgggagagaatcacagagtgattgtccaatatcccattggggtatggacgtttatataccctacttcttaggggaaagggagataggggagtgcggatgatttttgggggatagtacttgatttttaggggaattcagtgggcttgaagaacatacaatggcctaggacagagtcttttggcccacagacctgacaatggtttgtgacaaaagtctgttcaggtgtattgacagacttcagtcttcctgcgatatgaatgcagttaatgaaaacacagggaaggcacccgagactgttgtcttctttggcaggtccagactttaggcacataagggaacttcagagaacaacttcatgctgtgctttgggagagacaaaggattgagagacaggagagtgtgggggaaggtcaaagagaccttaagacttctttagtttaatgtgtcaaagtgccatatcttgggatattggtttctgaaccccaatactacttacaacgtggcaaagggttcagctgaattgctgtgatattatgatacatatgtatattggttttaatccacggttcctggctcatatctcccatagcccttgttatagtcttttgttatgatgttggggcactttaggcctcagaaacaggtgtcaggaaacagaatctgaccttcttctgcccttctttcacctgcctacagcaggactataatctaattgtgagtcatagaccctcattgcagagatgatcctggcctatactctttattttttacttttaaagtatagaatgcatcatgaattttcatgtcatccttgcacaggagccagggtaatctctgtatctttccaatttaatagacgtagtgctgaagcaagctgccacatactggttgacggaaggaatgttgcacagagaggtcaagaagaatctgaagacacaggcctgctgggttcatgttaacaagtgcttctccgagttctgtgagctgctctggtaaactaattgaacccaaagaggtgtcctgggaaccccaactggaagccagttggtcagaagttctggaagaacacacgtctggtgtctgaagggggcccagtcttggaaactgagacctcaacctgtgggatctgatgctatctatagtgtctaaattcactgctgcttggtgtgtggggaaagcccccacatctttgatcacagaagtcttctctgttgattgttgttgtgttgagtgagagaagaggaaaaagcactttgagtttgtgttttctccaccaccaattgtgttctagtgttttgtggaaagtagaaattgcaagtgatgaacttaaatatttagctgcagagatttccaaagtgttgaagatgaggcctggcttctcctcggtacttatgtaaaatgtgagtggatggagataaatggaaggaattgctaagcaaaaaggaaacagaacttgaagatttggaaaattattggcctattcatattgcaaaaaataaaaaaggattttctggagaggacactaagggtgtggctggacaataacccatggagctagtcagccatctcattagaagtcagaaatagagatgggttttaccagcaaagacattgccaatttagaccaaaaggaataaagacaggatgaaacaaaggaaggcttttagaattttgttctacgggacaggacaatacagctcgcttcattctttaagaaaaatgattcacagatcatcagggttgccactcccaccacagcgggctgttggggaggcagggagtgaaagggtggagtctccttctcttgagcaggccaggctgcccctgcccagtgccttggggtgggggactgtgacaaagagctatggtgctggccactgcctggtgctgtgggggtgacactgctgacccagtgggcctacagggcagaatatccagccaaagaagattgttgtagagcattaagatctgatggaatttgccttgctaggttttgcacttttggggactgtcaccttgttcttttcagtatctctcttttggaatcagcacgtctatcctatgcctttcccaccacattgtatttggaagctgagaggaattttgcctcaggatgaaacaaacttcaagtctcacccatatctaatacagatgaaatttagatgacacttcagacttggaattaatgctggaatgagtgaagacatttgggctgctgggatggggtggatatattctgcacgcgagaagtgtgaaaggaaaataaatcttaggactcccaaatcactaagccaaggaaaaagtcaagctgggaacaatgtcaggcaaacctgtcccccattttattcttttcttctttttttttttttttttgaaatagagtctcactctgtcgcccaggctggagtgcagtggcgtgatcttggctcactgcaacctccccttccgaggtttaagcgatctcctgcctcagcctcctgagtagctgggattacaggtgtgccaccacgcctggctaattttttttgtatttttagtagagacagggtttcgccacattggtcagactggtctcgaattcctgacctcaggtgatctgcccgccttggcctcccaaagtgctgggattacaggcctaagccacaatgccaggccaccatcctattcttaaataagatagctacaaagagaaacagctacataccttcctcacaattttcacacaaggaaattccttgtggacaaaggacagacagaatttaaagccatccctctgaggctcaccggaaacaaatgcatatctgattgcttcttctgccctattgtttatgtaaaaatgtagattcactgagctagactaaattgtgtattcagtggaaggttgatcaaggactcaaaagaatgtaacctcttctgtttcttatctacttataacctggaagcaccaccctttctgcagcttggagttgtcttgccttaccggaccggaagcaatgtacatcctacacatattgattgatgtctcatgtctccccaaaatatataaaaggaggctacaccccccaccaccctgggcacatgttgggacctcctgaggctgtgtcatgagcacgttcttaagcttggcaaaattaaccttctaaattgactgagacctatctcagatatttcgggttcacagaaagatacgaattttacagcagctggagactaacggagtcccaaacgacattaatggccagaaccacttatttgatttccctcatgggtgcccatgagtagggtttgatagacctacctacccatcatcttcaggagtgcctcgccctctccaacacttagcacttctctagtcaacctgggtttgactaaagaggctcagaaaaaggaacagatggacgaggtttgaggctgggattctacaacgaggctttgctaaaacttgctgagggatcttaggcaagtcatttctctctcattatcagtttctccacctggaaaataaggtgtgttgcatcaggctctggagttatacggatgtgggtttgaatctaggcactgacattagctgtgtaatcttgggcaagtggtttagcctctcaggtttgatttcctcatttctaaaacagggatagtactagtacctaccccatgggattactgggctaatgaaaagagataatgtatgcagagtccctggctcataaaagttattttctccgattaattaaataagtgaatatgtgtaaagtgctgaagacagcgtttgacacttagcgttttatcagtcttagctatcatgattttcttattctagtacatagaaagtcctcaataagtaacagtagttattattatttttggtcacatgtccctgtgtttccctccaaaaccctaaccatccccaattctggttttctccccgcatgcagcccaagggttttcacgtcccagtgcgattgtctgggctgtttcctccgcctgatgttccatttctcctcctcccgatctcagatggcttctcctctgggattcctctggtcttcatcactccctcctcccaggcagaaggaatggctcctggatttgtgtcctgcttaaaaaaaaaaaaaaaaaaaaaaaaaaaaaaaaaaaaagaagtccatatagcacttagttctttgtgcctggcggttgggttaactctttctgagcctgtctccgagagtggcggcccccgggggacggcgctgggtgaatcacctctgagtgtcacccaaggcgtctggcacagtgcgggacagtaaacgggccgctgtgcggagaggggtccagtttaactcctagaagcccgagtccccgaccctctacaggccgcgttccaccacaaatccctcctcctggggggctcggattctcccttccccgcggtctccctcacctgagccagccccgctcccccgagtctcgccagctcctccccggcccctccctccagccccctccgggctggagcctcccctcctccatcccctgcggaggcccgggggctggaggcggacgtctcgnnnnnnnnnnnnnnnnnnnnnnnnnnnnnnnnnnnnnnnnnnnnnnnnnnnnnnnnnnnnnnnnnnnnnnnnnnnnnnngctgagcggagcgtctcgacagaggctggagcgggtggggaggcgcggggcgagccggggggttccagacgcgcctccaccgccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagtaagtggccaggcgcggggggatggaggctgggtggcccggagacctgggagtagccttgcgggtccggagcgctgggaccagcagacccctgcgcctcccgcaactccgcggggcctgcagcaccccgccgtccccagcctggggagcccgggctttgttcccacgttctgcgccctgggaggtggcagaggtcggggaaacccggcgcagccagaaaacagccggtccgctcactgggctagccttcccttctcgccttctccttcctctgtttttctgcttttggcttctctttccgccgttctcggggcttatcctcctccgttttctcacggtccctcgtgtccgctccgcctctctctctgtctttctctctaccgcccgctgcactcgccaacgccgagcatcccgagcgccctgcccgtgtggcctgggagcggcttcctgggaccaggctcggtgcctgccacactggtggggtaggacataaaatgcccgcggcagactgtggtagccttggctaggggatggctcgctgggtatctgcagccacacacttcggatccccgagctggcaggagccctactgaaggccaagtcaaacgcacccatttcacagatggggaaaccgaggcccacaaaagggaaaggacttgcccaaggccacgccacgggttgaggtccgcggtggcactggaaaccagggctctctttccacgccaacccgacggccgccttctttggtcctcagtttccccttctgtgaagcgaaggggtctgactcgatgtttccagctaagatgccgggtgatgtccgtgtttctcaggactagtttcccagacaccaatcccctccccggctccatccctcgggggctataagcagatttcgcggaaggcttggtcccggggggcggtgcccgggttctctcattatgaccggagaaggcttagccctggctccaccgctgcagacgggctgggctgactccagactgctgcttgggggaccaacagtcagcgttttcaaatagagcgagcaccggcggagcgagggtgggctggctggacccccgggccgcctcaaacccagaggctgagagctcttccgacagttcggaacttccaggggcccgaggtcgggcggtcctcccaaagggctcaaaggaaccgccctttgagctgttgttccgaaggggaaactgaggcacagaggaggttctagggtagcaccaggcctgtgtcagtgcttagtgcaggagaaaagcatgaagaaagacaaggaaagctagttactgctcctagcacaggcgccttctctgagttttgagtccttggagaacacttgctgtagaatatctgggaaataacgaaaagtgtaaaagaaaatgatctgcaacccccaaatccacagttgctgttgatattttgttttttttcccctccacattctttgtgtgttcctatggatatatattgataaaattggaaccatacccataagtacagtttcgtgtcttgcgtttttcacttcacaccatgagcgttttccacatcatcaaattctctgtaaaacatgattttaatgactctatacaaagttttcaaaagttaaaaacacgactcatacaaatgtggccaagatttattcaactcattaatgaggtagcaaacaggagagtaaagctgattcagggagcattagaaaggggtgatacaagcattggagaaagaatgttgaaatcatgtggcccagggcagatgcagaaatggtggatgccccatgaagcaaaccataattcttggttatctttcttttttaatttccttccttcattccttcttttctttctttttttttttttcagagtctctatctgttgcccaggctggcatgcagtggcacgatctgggctcactgcagtctctgcttcctgggttcaagctattctcctgcctcagcctcctgagtagctgggcttattggcatgtgccaccacacccggctagtttttgtatttttagtagagacggggtttcaccatgttggccaggctagtctcaaattcctgacctcaggtgatccgcccgcctcggcctcctaaagtgctaggattacaggcgtgagccattgtgcctggccaggttatctttttactatgctgaaatcacttacatctctgtcagacagaattctatagatatatatagattatataacttcacagagtgtagcttttaatcaatggtaaataaaaagtcaatggtacattcccctagataatgcagtaatccatgggtgagtctgttaaacaatgctctgatacaacattgagaagacatcttgcttgctcttgccttatttccaagttttggagaccttttcttaacatgtactatgttcctcttttggtgagattttagattgctttcactatttttttacaatcgtagatatcatttaattccattaaatgctccattaaatattatagaattcctttttgtttaaaataatatagacttatcagagccaccagggcaagagcgatgcttgtcttttttttatttctgagatggagtcttgctctgtcactcaggctggagtgcactggcgcaatcttggcctcccagattcaagggattctcgtgcctcagcctcctgagtagctgggattacaggcatgcgccaccacacccagctaattttcatatttttagtagagacagggtttcaccttgttggccaggctagtctcaaactcctgacttcaggtgatccgcccacctcggacctccaaagtgctgagattacaggttgtgagccaccgttcctgtcctgcagtatgcttgtcttgttcctccatgaatattaagcacctattcatagcatagtacttggcacatagttaagtactcagaaaatatttgataaatatatgaatgcattgtttctaatatttgcctgtctgatgaattggtgttggtccaataagattatttttaaaatctatgttgactgcaagtgcattatatcggtattctgaagagaatgttaataattactcataatcaccactctaacagaacaactatggccatctttttatcattcatattctgtatgattgatgtagttagtttagacagaatagattttggagtcctcagccccattcccaggaacactacggagaccagtctgtttaggtgtcgggaaattaccattttgttaagatagtctgccgccagtatttgagttctgcagcgccctgaacaaatctctcctatagtttaaattctctttcttgcaaaacaggactcctcccagtctctagtaaaaatacaaaaaaattagccgggtgtggtggcgggtgcctgtagtcccagctactcgggaggctgaggcaggagaatggcatgaacccggaaggcggagcttgcagtgagccgagatcacaccactgcactccagcctgggcgacaaagcgagactccgtctcaaaagaaaaaaaaaacaggactcctacttcctacttcccagggttgccttgagcatgaaggagaactggtttgggagagtgatttgggaagtagaaagtggaatacaaatgtaaacttgccattaggaagctccaattaatgtaacttgatgcagtgatgctctgcggagtaggaggcaatttcatattgactcttcacaataaagctgtgagatgggcaggtagcatctttgtcttcattttacaggcaagaaaactaaagctccatgggagcagtattcatgggcttgacctccagaatatgcccagaatcccaccgcttcattcctctccactgatgtcattctaatctgagccaccatcatctctcaccagggctccagcatatctctagcctggccttcctgcttctgctctcactctcgccgctctgcctcaccccacccccattctccaccacgcaggcagagtgatcttttttaaacttaacacagatcatattgctctgtatttaaaacacccagtgccttccaagtctatttataagaaaatccagacactctccgtggtctctgcattatcagacccatggctgtcttgctgaccacatctcataccaacttcctctttcatttactagctacccctaccttatgcttgttccttcaacaggccaagttcacttctgctcaggcagggccattgcacttgctgtttcctctacctggggcactcttcccccacgtttttgcatggctgccttctggctcctcaggactcaaatgccatctatgctgatcatcctgtttcaaataggcacctcctgatagatgtctctttactccatgaccccaacttattttattcagggtacttagcaccatgtgagaacatttgttcattgtctgtctcccacctttacaagtacagagaccttatatgtcctatttaccacaatatcaccgacacctagagtgcctagttcctaggaagtgccaagagcctgaaatccagcaagtcttctaatgacccagtgcaggggcagctcacagaaagtgcatgtgtggcttagctggggtatagaggtctgggattccaatggttttgcatcttgtattggcaggaggaagtgaggaaggcagccccaagctgcagcatgaacttatcatacctcagtggaagacttcagaaagccccgtgagagaaaaggtaagactcaaaagacctcatttacactggcaggagttgacaactgaggtttgggctacctactcaactttcttagaatcccagtcatcaccattagttctgtttctggcccactctgtcctctgggtgcccattttggagatcacagatgggactttccttccttgtatgacaaacttctagaacacttcccaatgctattagttgaggaaatgaaaattcacattaatgctgacacaagctaagtgcagatgtgttggtgtcacagaaatcacttagtcttgattggaattcattaaatattgtcattgttatttttgctctgcataatacatacttcattttcttgaaggaataatgtacttggagagaaaaaagataataatataaactataaactattttaataagacgcagcgtagagacctagtactggggaatgtatcttaaaatccagtaggctcccctggccagaacaccaggaaaacacataggctttatcaaagagattgggaagaaaacaaaaaacactgtcctgttcttgcagagaggacctgagcatttaggatattctttgtggttctggtttttttttttgtttttttgtttttgtttttttgtttgtttgtttgttttgacagagtctcactctgtcgcacaggctggagtgcagtgacatgatctcggctcactgtgagctccgcctggcaggttcaagcgattctcatgccttagcttccggagtagctgagattacatgtgtgtgctgcgaagccaggctaatttttgtatttttagtagagatgggttttcaccatgttgtccagggtggtctcgaactcctgacctcaagtgatccgcccacgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatataggagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaaaaaaaaaaaaaaagaaaattagctagacctaggggtgtgtgtctgtagtcccagctactctgaaggctgaggtgggacgatcgcctgagcccaggagtttgaggttatagtaagatatagtcgcatcagcatcactgtcctccagtctgagtgacaatgcaagaccttgtctcaaaaaaaaaaaaaaaaaaaaatcaggacaaataaaagcaagtaacattttgtcctaaaggcagtaaacgcatggaattcatttcatcaaaaagtaggagaggctgaaaatagcttcaggaaaagtctcgacaaattaatggatggtcatcctagagcagattacttttaacaattaagatcttgggtattgcaacctattcataccccctgaggaatggacctgctactttttatagaggcttctttgttctctccagatgtggatgccgggcatcctcaggaagggcctgagaacaaagcagaggaccagatcctgtctttgttcccaaccattgtctgcccagcatatgggtcattgtattctgtaggaatagtcagcatagtgcctggcaccgtaactatttgttcaatgaacaaatgaatgaatgttgaagagagagagactagaggctggatttcacttgggcctctcattctcatttatataattaattcactcattaaacatttttttcttctctttttctcatcactgacttaaagctcacattcattaaacattaactgaatacttatactgtatactaaatattatactagatcttagggggaatgcaaatataggacagatttccaataccctatggagctaaagatctatttaatctagactgaaggggaaagaatttttaacccatccctaggagaggtataaatagtgggtcagcttactgtacttcataggagaggagagctgatggtgcctcttcttaatacagagtggagtttcatcagaaaagctcatcagtagagccggacagaaaagcttcatagatccttaaaatgcagtttcattgttttgcttgaaatgccccatagaaaaagggaacatccttttttaaatatcagtgcctgagcaccttccagaatagagagaattatttttggatcacccacataaaaataaagattactactcctggcggggcatggtggctcacgccctgtaatcccagcaccttgagaggccgagatgggtggatcacctgaggtcaggagttcaagaccagcctggccaacatggagaaaccctgtctactaaaattacaaagattagccaggcgcagtggtgcacacctgtaatcccagctacttgggaggctgagcatgagaatggcttgaaccctggagatggagtttgcagtgagccaagattgggtcactgcactgcagcctgggtgacagagcgagactctgtttaaaaaaaaaaaaaagattactattcctgctgcagcttgtgtctctttgggggaggggaagatagtgctttgatttggggcagtattcattttctgtgggggcagtcacatggttacctacctcttggatgagggaattgctgtagctctgttgctgtgtcgtctttctttctttcttttttattttttttttttgtttagacggagtttcgctcttgttgcctaggctggagtgcaatggcgtgatctcagcttaccgcaacctctgcctcctgggttcaagcgattcttctgcctcagcctcccaagtagctgggattacaggcatgcgccaccatgcctggctaattttgtatttttagtagagatggggtttctccatgttggtcaggctggtctggaactcctgatctccagggatccgcccaccttggcctcccaaagtgttgggattacaggcgtgagccaccgtgcccggtctgtgtggtctttcttaaatgcccacttggagctggggtccctgatgctcagtgtgattgggcagggcactgcctcaaaaactccataaagtggcaaaggatctgcaaccagaataggtgttggcagagctgaatcagggcatgacaaacagagaagtgaatctcttagtgaaagttattggtcaaacatctccccagcttcctacttcggtgggtttgaaatgttccttcttgagatgaagtaatacgattaattaggcaatggccagcgttgcccaagagcctttgatcggaatgttgagatctcatcagagcccttggtgacctcaaagtctcagaaatgcccaaatcctaatgcagagtggggtttgcagcgaggaaggggaatgtgcttagacgaggtaggcttctaaccagaggtggcagaacaggtgacctactttctcagacatgcaagaagtaagctttgaggtcaaccttagaagggctagaagctctactctagcaatgattttgtggattgaaagggacttcaagaatttatctgctggatgaggtggctcacatttgtaataccaacactttgggaggctgagttgggaggatcacatgagcccaggagttcaagatcagctttggaaacatggtaataccccagtatctacaaaaaatttaaaaatactagcccagtgtggtggcatgcacctgtggtcccagctactcagtatgcttgagcctgggaggttgaggctgcagtgagccgtgattgtgccactgcactccagcctgcacaacaaagcaagaccccgtctcaaaaaaagttgtcagttccttagtcccaaaatagagagcttatgtttaaaacactccaaagaatctgttctgttttaaatatgtaaatatccttttttaaaaaaataatttatttcttcgaaaaaagttcagtagccttaagttgaattgttgaagcgtggagatttattatgacttggtttttaaatttctttgaaattctccacaataataaagtaaaaagagattaataaaaagttcttttcttaaactgtgaaagcaattgtaaacatgtggaaagatgtgcaaaagaaaacaaaattaactcatgatcccattaactatggtaatggttaggcttatttctctctacatttttccctttgcgaagtgtatttaaataaaatattcagtattgtattttgagctttatgactaatgattattgtgtacattttgtcagtaatttaacaactacttaaagttgctgcttttaatgatcattcagtgttctgtcatatgaatggatcatcatttatttaaccattctctaacaggttatatttaggacagttaggttacatttcattattcattactttttttttttttttttgagacagagtctcgctctgtcgctcaggctggagtgcagtggcatgctctcggctcactgcaacctccgcctcccaggttcaagcgattctcctgcctcagcctcctgaatagctagaactataggtgtgcaccaccacgcccagctaatttttatatttttagtagagacggggtttcaccatgttggtcaggctggttttgaactcctgacctcaagtggtccacccgtctcggcctcccaaagtgctgggattacaggcatgagccactgcgcctggcccattattcattattataagtaataaatgtccttatgtgcaaacctttgcctgtgcctccatttattcctttcaaacagcctcacattcctgagtctaaacatttttttttttttttgagagagagtgtctcgctctgtcacccaggctggagtgcagtggcgcaatctcagctcactgcaaccttcgcctcccaggttcaagcaattctcctgcctcagcctcccgagtagctaggatcacaggtgcccaccaccatgcctggctaatttttgtatttttggtagagacggggtttcaccgtgttggccaggctggtctcaaactcctgatctgcctgcctcggcctcccaaagtgctgggattacaggcgtgagccactgtgcccggccgagtctaaacatttttaaactctcagtgcatactgtcatgttatctttcagagagttgccgtcagtttaaattctcagtggtagggattgcgagtgcccagtttacagtgggcattgtgcattgtgatttagagttttagataacctctggcactttgatttttttcaaggtatcttattatttttaatttgtttttctggacgtggggaggtggtttattagcgatgtcgaacatagtttttgtgcttatcaaccactggtatatgttaagtgatccgttctggatatgtagcacctgtggccactaccaaactgcttatgtgtaaaatgtatctactttttggcctataaaaccttaatttgaggatctcttagttgcttcctctgagatgattggggttttccaaacggagagccaaaatgaaataagaacccactacgaagaggatcccctagtattttacaagataataggcaatatgtatcatggcttgccgtgtgccaggcactgtgatacattatttatgctcattatctcactcaatccttacaagatccccatcaaattgactattactatctctgtatcatacatgaagaaactgagatgtggggaggctcagcaacatgtccgacttcacacagctgcaggtgtcagagccggtgcttgaatccagatctgactctgcaggacatttactgctggagattgtgttttccagtgtttcccttcaccgcaccacatacatacacttacaccacattgcagcctggagtttcttctctatgcctttcaggagaaagcagatgggggaaggatttgggtcattctgggattgaggtcattttacatgtgggctggaaatgcaattgacctttgctcattcacttcctgtggatcaatgttggagcgctgtgctagatcctgtgcccgacccagggagcctggtgccggcttttaggaactgacattgttttgttgttgcttttagcatccactcaaagctgagctcagggtaatggctgaggggcgagaactgatcctggacctggagaagaatgagtaagtggactcctcctttgtctaaaatgaaacaaataacttctgtgtcaacgccggacgcaggtgtcgctgttctggaaggaagcagtcaatggagtgaccccaagctctcagtccttggtttctttcaggcagcatcttgcaaagccagagcctttccacagcctcttgactcgatgtgagattgctggactgctaaatgtgttgctaaaatttccttaggcagtatttcaggggcccctggagttcactgcgggcacacagaggtctgtgtatgtgtgagattaagggagtggatggaccagaggtctttggcagctgccttactagcgccagcctagtgtgtggcaggaaatgaaggagattagaggaaaacagcagagaggagcgagcaaagcagggtgtgctggggcttggagcctcagactcagattgttccatgtgttctggttcagccgcatctgagattttgtcaacagggcatcgtcaacagtctcctggctacatcgggcccggctcttccatcttcttaacctcattcatcttgggtggtagcctggctcagaggcacttgcacattgatttgccatcagatgcagtcatatctggattcatgtaatggaggaggtgaatgggcacgatgcatggctatgtctgtggctcattctttggccattccccatctacttagccatgaagagctctccttacttggccgggggactctgaaaacatttggtgtttccccactgaccgtcccacttttcgttctgccacacagacgtcgcagataaggctgcgtggcttggagagctgcctgtctcctcttggcagcctccagaaccccctggaagccaatgagtaatcaaatgcatcactgccaagaaaaggatgaagaaggaccttcctgtatacaaaaggatgggaatagcttttaggcttgggtggaaagggagaatataatttattccaaatttgggctttttgggcacttgcaaaggaggatgagtgctgtcccgagtgtggttaaaatacaactcacagcttgtgcagtggtggggcttcatccacatccttcctctgcctccaggacatggtggcctcgggaagccagaaagatggggatcacagtcatttttgttcctctcctcttgagagtaaagccagtttaggctgtgtttcttctctcctgtgtccctggaatagacctggccagctgcgtccctagacagtgcagcgtctattggccctggatttttccttgcattgtcttcctttggtcctacaagaaaaggcccttagagggtttgttcttgaccgtgtctctcgggggcctgcctttgttgctcacggcagctttgttcccattaactctagtctaagtgttccctgttgttgcctgtgtctaatctctcctgttctgcccccagtagagcctgtggcccttcagctccctctggtcagcccaagtgatagtgttggtgttgtgggaaaatgcttaggagttggactggccaagcaggagtcccaggactcaagtctctatccttccctcctattttgaaacatttgctacagaccataggaagctaaagcaggaagatgccttagaaaacactgaatggaatgatcttagaaaactctgaaattatggatgcagaagttttgattcagagagggataggcatttgtctgaggccacccagcaagtaaatgaaagagctgaaactaggatcatgtgtattcttggtgtgagtctggagttacagaatgtgacccagggcaaatggctgaatcttttggaacttcggtgtccttgtttataaaatgagggtaataaggccagcctcgtgggatggttgtgaggataaatgaggtgaagtgcaggaagtgcttgcacagcgcatggtgagtggccagccactgttgggatttttattgtcccacactgaggctccagaggagagcccggggctgtggttctagcatctgcttttccgagagcagctctcgtttcccattgagccgcatggggctggatgtggttcctggcctccttgaattggcagaaggcagcagagttggtaaaaatggaagcagcagagccaagcaatatgacctcaccaggtgtccctgggggacggcttcctgctattttcatccaaattgggctttttgttttgaacatgtgttagtgagcggaactccaactgcacacgacttcctagtgtgtttatttcccaaagccttctcattcatggtgcgtgcgagtccggattcaaaacagctttggagcgggggagatgattttctaatttttcaaatcactgtgttgaagtttctataatctcatgacatttgggggaaactaggccctgggccaagccatttctcagcctctggttcttaacctcctcgatcaacgtattcatttttttttttttttaatctacgtgcctctgtgacatttcaggcaccagtgcaggtactggggataaagctgtgaataaaacagtacagcctttatggagcttctattctagtgggaaacagtaagcagacaagtgagtgcaccgtccgtcaggtgatgggtgctgtgcaggagacagaggagcatagggagtggggccaggggagtgtggaggtagaatgggagctgctgtttctgaatggcagtcagggaaggcctttcaggtgaactgatacttgagtcaagacctgaaggaggtgatggagtgagccatatgggtagctgagagatgacaattccaaggagagggaacagccacgttccaaggccctaatagatgatgaaggtttccactctccctctgtacatttccccatacactggattctcaggtctcccaggagcggtgagcaagggcttctgggactctggggggagggagaggacattttaaatttctttttcatcatcctgccgtgtctggccttctcccatcaaatcaaagcccacgtattaatgcatggcccaaaatagcagtgagcaagcctttaatggaattcacacatggagagatcgccaagaatggtgaggatggaaaggcatggggcatgggccaggagaggagggggaacacagcaaagtgagcttcagctcaggcagcagacacactgaggtgtcctacaatagcgcggcagccggcagcctgtctctgctttgaagcaactcagcaactcacggatgacatccgtgagaagcacacattcttttctctattgagtgcaggtgaaaaacagtgaccctttagggataatctgagcattgcttttgtgtcggttattcctgtgttcagatcctggctctgccacttactaccttgtagcctctttaagcctcagtttgtgcatctggggtgtaattatagtcccatgtcatagagccagagccacagggaggatgaaatgagatggtacaggtgaaggacttagcagagtgccttgtttgtattccaagctcaaggtagctatgattatttcttgctcattgtttttaaattgcaaaagcaaagcatgctcattgtaaaacatgtagcaattccaaataaacaaaagaatgaaagtttccctcccacgaggaaaatccactgctgtttggtgagcaaaccctggaccttttctatgcatacaagaacatgcacatgaatcctcacagacacaatcacatacagacacagtcacacagaagctgctatttttgttggggagggaggagcagaaatgagattatgtcagacatattgctccagcatttccttttttgaactcaactggatgtcatgaagacagtcttctgctctaataaagtatatattacattgtttaatatttatacacacatgtaatcacataatttgcaaagattggtgcatagctgctgttggagaaacttgtgattgaggcagtgtggtacagtggacatagcattgacctcagagacagatgatatgaaattggtcaaaaagccagccagctcccctgagcctctgctttctcatctgtaaaatgcagattttggccccggataggctctgaaggctctttctgcactacctcttttttttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcactacctctttaaaggatgctctgtgagtagaaaaatgcaaaagaagtctctgcctcaggaaatttgctctacctgtggagacatcctgggaaatagtgggcagtgggataaaggaaaaaggtgccccaaatcacgggaccttgaagttggggacgaacttctaggtcagaacccgcaggttcaggcaacagaaaatacaagaagggaaactacagagcagaaattatagactgctgtttgcacaacccacagatttgagcattaatccatattttttctctatgttcttttccccatgtcctgagactacctcaccaacccaggaacccatatttgacaaaaacttgtttgctgaaatcaaatggaatcctccttagttagctgcaggcatccagggagatgaacagggttatgtgagccccagcgccatatcctgtcctttcttggctttttcccaaaaggagggcacactgaattgctcaaccagattcctggatgctcactgggccgcattactagtgagcaggatcactctattacaagatcaccttcaaaagcaaatgaatggctcaactagtaggcactttgcccagaggctctttggccatatgcttctgtcttctagtatcttaaacacattctaggactctcatttcttcaatacactgtccttcctcaagtccaaatgatgatggcttgagaaagggagagacgtcctttggtctaaccccatccatttgtgctccagcccagttagctaaagagagatcttatttgctcaagtttagttaataagaacgggcgtttgttttcttttgtgagtatgtctacctccaaaccacctggggaacagcaattgtcaaggcagaatttgggcatttagaggtttactgattttaatacctatcattacttccaactttaatctttcttcctatccctaacttcttatcagtccttcagtgatatcatagggaaggagaaggctttcattgtcctggaaatcaagctacaatctggaaaattaacattcagtgctaatggagtaatctagctccctaacattctcgtttttcctcaagtccattatacaatttggattgcataatactggtggaattgaggaagggcagaattagcaggcaggaaaggaatttttcagcaacacacggggcagattagttgccatctcttattcctgcacttctttttcaaggatacctggtagaaatagtagcagacccaaagcaaaactatgaataccacttaggcagtggagctctccccacctccaccctcccagcttcctcccaggtcaagagtagactttaacatcttacctaggataaaggacagctctctttgaccctctcttgtcaggagcttcatttgttgttggcaaaattcaatttcctggatcaaagagcagcttagaaaggcttagatggtatcccaatgctcttagtaaaccatgcttcactgagttgcatttaaatgagtcatagacatatggattacattgcacttaaaatacacatggctcaagaaattaaaggatatcattctttaaccaagtatttggcagatctaaagtattcaaaatgtttttccaaactctactcgcagctgggctccccattccccatggctaaggttgtataacccggggagacaggtgctgaggaaacagttggatgaatgggtggggacaccagaatttgatgagagctgcctgtggtgtctgaaattttcttcacatgttctttggaagtatgaagaactggtttaaccctgctgtgttgacgctgaaggcagtgaatgcatgagtggatttaaattccaagtgctttgctaggcacgtcattccagagagacctggtagtcctgtttgagatgtagtttctaattgtagctttgtagactgagaatgatttcatttgcatttcccatgttgtcccaaatgcctggagttgcagaacaaatggattgccagccagtctgatgtgattttttataagccaaactctcaaccccaccccagcataagcagggtctccatttgcaatgtactgaatgtttatgtctcccttcaaattcttatgttgaagtcctagtccccaaggtgatggtattaggaggtggggccttttggatatgattcgtttatgagggctctgctctcatgaataggattagtgccctgatagaagagacccgagagaattagctcaccttttccaccaggtgaagacacagctagcagctaccatctatgaaccggagagagggccctcactagacacgaaatctgctgatcccttgatcttggacttctcagactctagaaccgtgagaagtaaatttgttgcttatttgctacccaggttatgctgttttgttatagcagccagaatggactaagatgccattatttctaaaatattggacacatgatatcactttcttagggtccattgcttaagctcagactcagtaataagcctggtgatctgaagggatgcagcttcatgatacgcttgtctaaggtatcagagagcatccaaaattgaaatagcctagatgtgttgattctgaaagccttgtgcacacaagccttaaacatcctaatccatagagtagaacagatttggactttggtcccagagaccctgattcaattccagatactgacacttccggttgggtggtctttggtaagtcacttgccttctaagttttacttcttcatctgtattcatagtaatactacttggccaggtgcagtggcgcatgcctgtaatcctagcactttgggaggctgagccgggtggatcacgcgagcccaggagttcgagaccagcctgggcaatgtggcaaaaccctgtctctaccaaaaccaaccaaccaaacaaacaaaaaacccccacaaaaattagccaggcatggtggcacatgcctgtagtcccagctactcaggaagctttagtgggaggatcttttgagcccaggaggtgaaggttgcaatgagctgagatcataccaccgcactctagcctggttgacagagccagatgctgtctcaaataatagtaataatactcactgctttgtgagcatttgctgagaatggatacttcggaaaaggcacttcacacaatgtcttattgaatcctcatggcaaccctttgaatgagatattgttgtctgcattttataatgaaactcaagcatgaggagtttaaataatttacccagtattgggcatagccaggagtcaaactctggcctgcctgcctcttactacattatagcacttgcatagaaaatagagacattgataccttcattgcagggtgtggaaggctgaaaaatgcaccctctcccctccaatgataaccacattcgaatccctggaacatgtggcagaatctttgcagatgtgattaagttaaagatcttgaggccgggcatggtggctcacgcctgtaatcccagcactttgggaggccaaggcaggtgaatcacctgaggtcaggagttcgagaccagcctgactaacatggtgaaacctggtctctactaaaaatacaaaaattagctgggcatggtggtgcgcccctgtagtcccagctactcgggaggttgaggcagaagaattgcttgaacccgggaggcagaggttgcagtgagccgagattgtgccactgcactccagcctgggcaatagagtgagaccccatctcaaaaaaaaaaaaaaaaaaaaaaaaaagaaaaagaaaaaaaaacaggttataaaaaccttgctgataaaacaggttgcagtaaagaagagtcacttgagcctgggaggcagaggttgcagtgagctgaggtcacaccactgcactccagcctcagcgacagagcgagactccgtctcaaacaacagcaacaacaacaacaacaaaatcaaagatcttgagatgagaagattatcttggattacctggatgggccctaaatacaatggcaaatatatttataagagggaggcagaaggagatttgactatagacagaacaggagacagtgatgtgatcacagaggcagagattagagtggtgcagccatgagccaaggagaagctggaagaggcaaggaacagattctcccagagggcacgcagccctgctgaccccttgattttggcccaataataccgatttcattcttctgacctctcaagctgtgtgaaaacaactttctgttgtttgaagccaccaattttgtgacaatttattacacactagccccaggaaacacacacacagggtttgtgaggttaggagataatgtatgacaatgcacttagtacaacgtctggcacatagcaagcaggttttcaatacatgctaatttgtactaatgcaacgtccagaacaaatgttttcaggtgttttggggatgcaagctgtgacatgtggcccttgcagctttcttcaagcatgaaaatgacaagagaaaaaaacatattgagcaataatctgtgtggttattgcttatctacattacccaagttccgggtcatgttctctgatgctctgtctgcccttagggaacttctggctgaggataactaggaatgattgtcacatattaacaaatggtgatagctaaaaagtaggagatgcctgtataacaggcatcgtactgtggtatttatatgggtcatctacttcacttgtcacaaccaaccaatgaagagtagattcctatattagccctatttggcagatggggaccctgaggtgtggagcagtgtgacttgctaaaagtcatgtgggtgggaagagcagggccaggatgtgaaactagatctgtttgactcccaagtccaggcttttaactggggcagtatattgcctctcagatgcatagtcctggctcattatgctttgggctcttttttggttagcactggcatttcttcttcattgttctactctcccccttccctttcctcctacctttcccaggccctggttagaatttgcatgtcagtgtaatgtgatagtgtaatccaggcaggtgtgcatcccaagcttggctccttgcactacctggaggtgtaagctttggcaagtcgctcaacctttgagagtctcagttttctcatctacgtgatggggataataacctcataggatgtgtgtggaattcaataacgtaatgctcttaaaggatttacagggtgcctggtgcactatgagagcacaataaatagacactgttatttgtgttttgcagggtcagaaaagcatttaagaatgaagtcagagggaattcccctgagttggtttccaaatgtaattaagaagagttgaccttaaaacccattgcccctgggaggaaattacttctgctctccagcgatgcccagtttgacctaattgtatctcgaaaacactgctttgcagtgttctccagtgggccaaactgtacctcttttctgtgcctgcagaatcagatgaggccctgaactgtccaatatgaggttgggatttgttcactggttccggctctccttccagggatccgcagccagggctgcctgtgcagccaggaaggatgtccacggttttcttttgtctcaagcttatttctcctggctgctcttcagcaggagcacggggtaaaatgaatgggaggaagctgtcaactgccctgttggccttagatggacccttatccgaactaagggaagctgtggacttggaagaagtcaggatgcttgggtttggggacccctttatcatcaggctgcttaccttcagataacaacaatagctggcattgagggagtgagcatttaccatgaacttaatattttatgtagattttaaaaatccctatgtatatttatatacaaatgaggtcatagtgtattcttggttttgtaacctattttttttcacttggaaatatagcatgggcatttaaaaacatttaaaagattttacatggaactttttggaatgtttgacatttttcataataaaacttcagagaaaaattaaacaagttatagagtttttaaatgcatggtatcgtactttatatactattttataattggcttttttattttttgtcttcagtgtctttccacatgagcacatttatagacctgtttcattctttttaatggtgacataggattccactgaatggatgaatcaaaatttattaatttccttattaactgacagttaggtttctgatttcttgttattacaaataatcctagcaataggattgtacataatctttaagcacatttgcaagtatttctgtagcactgatacctagatgtagagttacaggatcctatggagtacacaattaaaacgcttttaaattttgacaagttgtacctctcactccacaaatacctccccaaaggctgaatgtaccattttgcatttatacaacaacagatacctccccaaaggttgaatgtaccatttcacattatgagcatattataaatatgtctccatgtacctttatcatatttaaaaaaattaattagaagttctatttttacttactttttagcccatgaaacaaatctcagtaattttatcttttccttttttaatttttaatttttgtgagtacatacatagtaagtgtatatatttacggggtacaagagatattttgatacaaacatgcaatgtgaaataagcacatcatgaagaaaagggtatccattccatcaggcatttatccgttgcattgcaaacagtccaattatactctttattttaaaatgtatagttaaattattatagactgtagtcaccttgttgtgctatcaaataataggtcttattcattttttctattcttttttgtacccattaactatctgcatctccccactacacccttcccagcctctggtaaccatccttctactctttctgcccaggagttcaattattttgatttttagatcctacaaataagtgagaacatgggatgttgatctttctgtctgtacctggtttatttcacttaacataatgatctccagttccatccatgttgttgcaaatgactggagctcattcttttttatggcagaatagtactccattgtgtatatgtaccacattttctttatccattcatcccagatagagacttaggttgcttccaaatcttggctattgtaaactctgctgcaacaaacacaggagcacaggtatgtcttcagtatactgatttccttttttttttttttttttttttttgagtagagtcccgctctgtcacccaggctggaatgcaatggcacaatctcggctcactgcaacctccacctcccaggttcaagcaattctcctgtctcagcctcccgagtagctgggactacaggcacacaccaccatgcccggctaactttttgtatttttagtagagacggggtttcaccttgttgccctggctggtctcaaactcctgttgcccaggctgggcttgaactcctaagctcaggcaatccacccacctcagcctcccaaagtgctaggattacaggcatgagccaccgtgcctggcccactgatttcctttcttttgggtctatactcagcagtgggattgctggatcatatggtagcatgacatagtggttgtactaatttatgttcccaccagcaacgtacacaagggttcccttttccccacatcctcaccagcatttattattgcctatctttcaactgggtgagatgatatctcattgcggttttttttgttttgctttgttttgttttttgagacagagtcttgatctgtcccccaggctggagtgcagtggtgcgatcttggctcactgcaacctccgccttctgggttcaagcgattcttgagcctcagtctcttgagtatctgggactacaggtgcacgccaccacacctggttaatttttttgcattttgtatttttagtagagatgaagttttgccatgttgaccaggctagtctcaaactcctggtctcaagtgatccatcccaaagtgctgggattacaggcatgagtcaaggcacccagcttgttgtggtattgatttgcatttctctgaagatcagtgatgttgagcaccttttcatatgcttgtttgccatttttatgccttcttttgagaaatgtctattcaaagcttttgcccaacttttgattggattattagtttttttttttcttatagagttgtttgagctccttatatagtcttgttattaagcccttgtcagatgggtagtttacaaatattttctcccattgtttgggttgtctcttcactttgttgattgtatcctttgctgttcagaagctttttaacttgttgtgatcccatttgtccattttttctttggttgcctgtgcttgtggggtattgctcaagaaattttgcccagaccaatgtcctggagattttccccaatgttttcttgttgcagttaaatggtttgaggtcttagtttttttggtcttttttttttttttttttttggggttggggggacagaatcatgctctgttgcttaggctggagtgcaatggcgcaatctcagctcattgcagccactgccttcttggttcaattgattctcctgtttcagcctcccgagtagctgagattacaggcgtgcaccaccacgccagctaattattttctttttagtagagacaggatttcaccatgttggccaggctggtctgcaactcctgacctcaggtgattcgcctgcctcggcttcccaaagtgctgggattacaggcatgaaccactgtgcctggcctgaggtcttagatttaagtctttaatccgttttgatttgatttttgtatacaatgagagataggggcctagttttattcttctgcatatggttttcccaccatttattgaagagactatcatatcattttcgtggctgtgtgatattatagtctatgtgtatgcatgattaactcttacagcttcttatagtgaaaaattatcaaacgtgcagagtagagagaatgatggtatgaatcactgtatacccaactgagtcaaagcgaatttacatgtaacgtggatatataaaggcaagttgcccttggctcctctgcaagtttatatctcactgcccttgttgagagatcctgttttcccaaacacaccattgagttgattattgagcttgggcagactctttaaacccaagctctcttgtctttttttttttttttccaaacagctttactgagatacaactcacataccatatagttcactcatttaaagtatacaatttcatctgttttagtatatttacaaagtcatgcagccatcgccataatctgattttagaacattttcaccactccaaaaggaaaaaacatcagcagtgttatgagttgaatggtgtccccccaaactcatatgttgaagtccttatccccagtacctcaaagtgaccttatttggaaattgagttgtggatgtatttagttaagatgagatcatactggagtatggcaggtctctaatccagcatgagtggtgtccttttagaagggggaggtttggaaacagacacacactctgggagaatgccatgtgaagattagagttatgccaccacaggcgaaggaactcagaagccaggagagaggcctgggataagccctttccttgcacctgcagagagaggatgatagcttgatcttggacttttagcctcaagaactgtgtgacataaacttccgatttttaagccacttggtttgtgatactttgttacggtagtcctagaaaaggagcacagtcattcttcattctcccccaccccacgtcagtcctatgaagctggcaatctgatgtctccagatttacttattctggatgtttcatgtaaatgggattatacaatatgtggtctttttgactggctactttcacttcgggtaaagtttttgaggtttattcgtgttgtagtatgtatcagtattcttattgctatatggtattacattatatagatataccacattttgttaacccattcattagttgatagatctgccttttaagctcgagctaatttttctccattctacaagtttgatttcaggggatactgattgagcacctctatgtagaatcctgtgctaggtgctgtagagactaggcatgaaaacaggatattcttaccttctggcagtttagactctgtgggagagaaaacagcatgcaaacagcataatccaaaacagattacaaatttacatggtagaattgaaagtaaagaactgcgaaggcaagaggaacgggaatttgtgactggggaagaggggagccttccctaatgagggttacttgaaatattgtcttgcagaatgatgggaggcttttgatgagggagggagatgagatgaatggagaatgagaaaggaattcagactgagaaaacaatgtgtaaatgtttggtctggatcaaagggaacctaaaactgtagtgctactaatcttttaggaatttagtatccctaactagccaaatatttgaattcagaagagtgatatgttgaggttggggaacgggttgctttttcttccactggtgggctaccagaggatttgagtggcatagagctcaatattttaattctcccatttttgactttgagttgcattctcttgcctcaggcagacccatgtggtcagggaagtaggtgagctacttctaggaaacatacttgaagtgcacttaaaagctaggctgtatttctacaccttggaagagaagtagctttcctcccacccctccccactgaagaacaatttgggctgagccaagaggatggaggtgtacttggtggatggagcccatggattggaaggggctgagcacaaggcattgatggcttcttcacaacttctgtagatggggaagcctcctgagatgcaaggctggtgggcgggatgcagacggatttatggatatacatttggatttgggagaggctctttcggccttctcttttctcccagctccgaggatgtgattaaactcttcatctaggctctctggaaattggagggtgtttcctactctttaccctttgtggttgggcaatggagcatgactatcctggagaaaaatgagaggaggctgacaatgtggcccctggacagattctgtcctgaaaatgaaactacatttacatttcacccaggagatgtttttgattttgagcaattaagatttgctttttctttatttagaactcagtgacatacacagacctttggctgaccccttgaataaactaagtgaatagtcttctgggtactatggggcaagttgctaggtcttgcacaaactcaactggggcaggtattgagtcagagaatccctggcttttctggcaagtctcttcccagtgtactgggcttgagttctggactactcattgagaattcctaatttatgttattcctttcttctcttccttcattaaacaaatattgtgagtgccaactatgtggcaggcactgggataggtcctggttattcccgggagaatcaatggtgatcagaatagtctctgccatcatggggcttagaacgtagtagaggggacagataattaaacagttacagaacaatgtgggacctgctaggagggaggaagtagagggtactgtaggaacatggggaaggggaacttcctctggattgggggcacgggaagtctgataggaggaagtaaagaaaagggggagtgtgatggtggtggagagtgtggcagagttggctcatacaatagggagtatgtgccaggcagcacagatcacaggatcaaaggcccaaaggcaagaatgacattgaaaatgaaaagttctctatagttagaacagagagcaggaggaaggaaatgatgagagaagaaattggtgaggcaggcagaggtgagtccttaaagggccttgtaggcaccttaaagagtttgggcttttatctctagggcaatgggaagcggatgaagaatattttaaaagtcacatagtgacagcatccaaaacgcatttgagaaggactaatttagggaagaggtagctgatataaagagaagaggatagattccagagatatttatagggtggaatcatggaaactgggaaatgggttgcatgtgggctgagggagagggtggtttcaagggacagtccaaagtttctagcttgaataagtagcaggatagttgtcttaattcattttgcattggcaaaacagaatcctagagactgggtcacttataaagaaaagaaatctgtttctcacagttctgctggctggcaagtccaacatcaaggtatcagcgtctcatgagggccttcttgctatgctaccccatggtgaaagggagaagggcaagatagcacatgaaaaaaagagcaagagagcaaacttgcagcctcaagcccttttataacagcattaatccactcattatggtggagccctcatggcctaatcactcctcatgaggcctaccttccaacactgttgcattggggattaagtttccaacacaggcttttgcggggatacattcaaaccacagcaatggtggtgtctgtccctggagttttccttagcttgtggtgggaccttggacaagccacctctttccttggatctttaggtttctcattagataggtaattagactcaatggactaattagactaggtaataattcctagtcaccaccttggcaggatcatcatggggatgcaataataaaacctgtgtgaaaagcagtgtcctgtactctttccataacgctgacaggcccagcagaagcaaaatctgtgcctcccctggttttctctgttttctcctccttatctaaaattctaagcacttggtctcttaggaactggtgagacctctgcccattccagcagctgaggcttcattggggacctctctagggattctgaaaccggcttttgttgaaaacaatgatatcattgagtaggtggagctgggccggactttcctcagccggttgaaggagaaatggggtctttatgacttctgtacttgtggctcttttccagcctcttccatggctcccatgtgtctcacttcccccctttcctccttgcagaaaactggcagtctccacgttttctcctcttgcatcagtctccccggggagagggccagaagggccaaggagctataatggctgcattatatcaagcatggtttctttttccaaggccccccttctggagaagggaagggcaagtcatggaaagggactcctttggagggagactggagtgctggggaaaagagtgatctaagtgttggaaggaatgtcaggctctttgtattctagaagctctttatctcttgactcactgatgctagatttggggcttgggtaagaatgcaaaggtcaaactggcctctcagggatatggtgataggaatatgggtttggagaaggagggcagccatgttgagtgagtatccttaattcctgatccctagactggccttgctctctgctctcaacacgcacacatgcatgcacacacgtgtgcgtgcacatatacatcccttctccataactgtgtagacagctttttaggagaaactagaaattggttaccacactggtttgcagctgttccaggaaggaagatgagctgtgaaacagtgccttctggggaccagacagtgacacctgccctctgcatggtgtcagcatttgccaagcacttgggagctgcaggtgccaagccaggagaggggcaggaaacctaggcctgcctcactggctgctgaagccccatcccctagcatagtgcctgcacatcacggacctccatacatgtttgtggagggtgcaagtggacttgcaggtgcagggcctgcaaggcctgatgctcagaaaggtgctgcgtcttgatcaaggacccccagcaaatagtgacgaaatcaagctgtgagaaactctggcctcctgatgccaggtggcctgcagtttgtaccacattacactgcttaatatgcagttattcatgagattgcatgaagagcctttctctctgcctactgggtgtgtctggatggcccaactcttggcttgtctaccactgacatttagcttactctagtttattgaaatgatgggtttagaaacaaaaactgtgtgatgctgggcaagttgcttttgctttttttcagattcttcatctgtaaaagtggaggtcagggttgggcagagagggtggtatataaataatgtttcattgcggtagactctgtaacttacacactaaccctcgcttctcctaaacaatctttttggaaaggatatggggcaacgcatagaatgagggaaaagttgaaaaactaaggtttggaaaggttgagatcctagaatgaatagacggtcccttcatgtactatcatcttgaaattctgagatgagatctgactgtccaggcatatcatgaagcattcatttggccaggcaagggcagggatcttgaccaactccaggtgccctagtcagcaatgcaacgagaggggagtatttctttaaatgcaagttgggccactgtttatctcaagaaggtggcatggatgctgggcaggctctgacaataggtatccactatgatctatgagggctttccaagttctgacatccttgacttatgctttgggtgcggtctgtgtcttagtatgctaagaaacattgggcaagtttatgaaagttactgggatatttaatcagagcttaaaaagggctaagcacctacatttagcaggctggtttgtggtcctcacctacctgttttatgtttgtttgttagtttcagggagtggtccgcttattcccttttttctaagcatattctcacagctccagtgatctcagagggtccttctcttcatttcccctgtgtcttatccacaccgtttttctttatgatatggcagtttcctcataccctcttacattcgtctttcccttcaggttttctgtggtatcggctaatctgatcaacactgtggttatttaccaaaaactggttgctagagaagttgttcctactcaccattttcgcttttagatttttctcagaaattctaaaggtagcacctcatttccccgaactgttcttatctaattccaacaaatacacataatgggctattcgggacactggaaaacaaatttgtgaactcttcttgggtgagccattttgagggccccgcaggtccctgccagttaagttgtctgatctcaagaagtcagctctatttgtgcagagaggttacccatcttcacagaggcagccacgagggaggcctgaagaggattaagtaaagaccctgctggccaaaggagtcagtggtgctcatccaaacatcctttggtatataatgtaaaagcaaaacacaggaccagaaactggtcggaagggtgccaggtcttgtgcggactgggagaagatgtcgtgggaagtggttggtgaaagggagtgttgacttaacgcattgtttggaaacttccttaataggaagttaaagaaaacatactgagtagcattggccttttgccaggcttctggatggcgccatttttgccttcggagtgttgcttccaaagctggtcctctggcaacgatggtgcttattcaagggagtccctgggataggaggaggtcccaattttttactctaggagcaacctccaaagttcccccttccttcgcctttctgttccctcataaaggaatgtgtctgcttgcagccccctggactcatcagtcccttatttggctttagggccatgcctttggcacgttggtttgtttccattcctttggagtcagaggtggaatgagtactgatgtagaaatcttggttctgaagcagctctggctgtctcttccctgcttttctttcagcatcttagaaaacaaaacaatactcactgaatttattttgtcccaaatctagactagtgcaggccatgacattagaatagcactctgcttttcagagacactttccagtacctgtctgtcctgggcattgccatttctgcttgatagaaagggaaactgaggctgagtagtttgtgacttgcaccgtatcacctagccagttaaaaaatattgtcaaaatttacaaacccagaaggagagagactagtattataaacctcagatgcccattacctagatttaacaatgatcaagattttgccacgtgtatatatagctagtgctggagaaaatgatagcaatatttgtaaagcacaaatactttctactttacaaataattctttcacatttgttcatatgatcttcctatatgccaggcactattctaacatcttacaggggcactgtgaagtagattttgtcattctcctcattttatgatgagaaaccataggcacggagaagttactgaccagtctgaattcacacgacttataagagctaggatttgaatgtattttctcatttgatcctcagcatcgctgtgatactgatggtgattattagtctgttcattttgcagtctagaaaatggagggggtttatgtggctcacgtgaaaacaatttttatacaaatacatagtgagcacttctcgaagttttatttatctaattaatgggctaaccagcaagatgataaaactggtttaaaattggataagggaaactaagacgtatttgtgtgggggtgtgtgtgtatttaatagtgaaaaaaggaatgctgagataagattgctaaattagacacaaaactagttaatatcctaggggctgtaaaatcataacctttggggttatcttttctactagatggaaatatttgcatttctgttgtatcttattaagtttttacaagttaacatctgattttacagagtggaacaagggctgtcctaattaattgtaaatagtacatctttcaaagccacactcttcccataaagtccagagaaccgtagacaggcctctgagagtctaaggcttggctgtgctcccttagtgttttttaatttaatgttttgagacagaatctggctctgtcactcaggctggagtgcagtggtgcaatgtcagcttactgcagcttccgcctcccgagttcaagcgattctcctgcctcagcctcctgagtagctgggattacaggtgcgcgccaccacacctggctatttttttttgtagagacgggctttcgccctgttgtccaggctggtctggaactcctggcctcgtgtgatccacctgcctcggcctcccaaagtcctgggattagaggcgtgagccattgcacccagccctggctgtacgcttgtgtgacattgagaggaaccatagtcatcttttgcttcatttccaggctttggaagggcagttgcctagtgcagctgctgcttaaaccaaagcattccgactttccctctatgctgggttagcaccatctttagacttttggaaggtgattaggaggctagaaataaaaaaaagaattaaaaatgttaaaattgctcaaatggagtagaataattcccagaacccgaaaacataaatcacctgaaaaaaaaaaaactattaaaaatacagatttcttaatccttccctagaaaagggaggggattgtgtatttttgaacagtctttccaggtgttgtgcagttgttgggctaagtcgcatggtgagaacattattactaacataggcaggatgaagaccctccaggtgaaataagagagaccagaaaagtggacctcccaaggcatcatcagggtataaatgcctggagactcttggaagaattagatagagaaaggcccagagaaaggaggtgtcagcaaaacttgctactgagatgagcagagtgatgctcgcctatgctgagctcgtctgcagagggtgtttttcaaggtaaatgggaaattgttatcactttatcttcactggtttgcttatctgaagcaggaggaagaaggtttgagctcccagaagatgttttgcaaattcattttagtgtcactgctccttcctctctagagggtggtttagcctagagaggcatttgaaatttgtctgacgataaatagaacttaaaggaattgtcctgagtttgaagcttctgagccttaggaaagacgggtctgagctgttttcaggctgcagtgtactttcagggcctggctgcttgtacaggttccagttcttcttccctagagagtgacctaatgttttatgtccggtatttgggggtagcttattttcctaggtgggagtctgaagatgcaggttttgctcagggactttggaatctaaatgacccagattttgctcaactctagtgctggctattattatgatggtgccgagacatggcagagtgtcctactgatttctgcctgtccgtgggctcctgagcacagagcagacagagcagggggcagcagggtagaacagaaattgcttttcttttaaagctagaaaaaaggagtgggcggaatgggaaatcttgcacagtcctttctcttcctggatgcacatcactcacaagtcgtttcctgaaaatcctaatgcaatccaatggtgagagacggcttcctgccggtctgctgagccagcccctcgtcagggaggagatgagaacaagatgtggtcagagaatggggcagctgggctgggccgggctgctcagtgaccatgtgccctcctctctgtgggacagcagcgtcctttggttctgagagcagcacctggacacatgggcgtatgtggacctagcttgggggagctgcagagttgttcaaacagatggctggccctaaccctagagtttctgtctgattcatgagtctgggtggagcctggcaatttgcatttttaactagtttctagatgatgctgatattgctgcttcagaaagggtgattaggtggaaaatgaaagcggattgttttatgtagattcagaggccagaatgaaggcctgtgggtgccagtgacagaggtgtagtttttaatccggagtaaaacattaaactactgtatgtggtcagaaatggagtgggtagtctcaggagtagcctctccctggaggtgtccagtggtgaatagccatttggcagattcctacacgagataaaaggttcattcattcgtttgcgagtttattcactcattcacagaatgcacatgtactgcctgcttgctaggtgctgggggccggggagaagacttcaaagacacaaggtccctgtttttggggagctcacagtgtaattggggtttgactacatgatttctagggttcctttcagtgctgagggtcagagaggcctgtgatgatggggtaatgtcactgggtgaatgatttctccccccttgctaagtctcagaagaggctgagaatatttttaccaggagtgcattttctgtgggaaaattcacacttccccactggcacctggaatgaactattaaactctgaactcctgaccagctgtacatggcgcagtctgtgaaagcaaacccaggaaatgggctgcaggaatgagcacattgcgttttaccacctctcttaagtgatgtactggagagttcatggctggggaaagttagagagagaaactttctgggttcttctgtcataatccctgttgaaagcaataatgattatcactaacttttacccagctccactttgtgccaggcatggcattaagtctgctacatttattatgttgtttgatcctcatcacagccctatcaaatgagtatatcatcctcttttttgtgtaagaggaaacaaaggttcagagacatacatgtacttgttcacggccgtagaggcagtgaatgtcagagctggaatcaaaacttcagttttccagtctccagaccatgctctaagctgctagtacactgaactactcatccatccattcattcggtaactagttaagtggttttctcattgaacaaatgttaagcactgacataaaccagtgagcaaaactgcttggcctctgccctcatgaggcttacagcttttctccctcaggcaaatgggtgactcctccctcaaatcttggactagttagatgctaaggagaaagagaaaggactgggagacagattctggcaggttagccactgacccaaagtttccatgtgaatgagaatttctcttcacaaagctggggtttgtgctttgctttatttttacattttcctgttgggcttcttttcttcttgtccaaggcgagaagttgaaggccttgacatagtacaggagacaattcttgtggcatttgccttctgaccacacactggggatggagggaaatctgagcgatcccagaacttagagctggaagtgactctagaggaattctagagaccctctgcgatgaccctctcttgctgggaaatgtcacctctttcaaaacctgggttatccctgcagattcctttggctttctgtgctggcctcagcctacattttcttctttttaagagcagttttaaattaaaatttcagttttcaaaacacctctctgacagttaatttaaaagtcaaccaacttcagaaatatgcaacttatattgtaaacatcttctgcaacccctgagataatcaccatcaacaaagggcatttgtttctctctctctttttttttttttttttgagacagagtctcgctcttgtcacctaggctggagtgcaatgacgtgatctcggctcgctgcaacctccaccccccaggttcaagcagttctcctgcctcagcctcccagctaggcacctgctaccacacctggctaatttttgtaattttagtagagatggggtttcaccatgttaaccaggctggtcttgaactcctgacctcaggtgatctgcccacctcagtctcccaaagtgctgggattacaggtgtgagccaccacacctggctgaccttgactttctgtagatcaattctgcctttaatgtggctgaactattaatagttgaaacatccatttgactcttatatttttcttttaatttttagagaaaattctaagaacatttcttgaagttgcctggcctttggtgaggggattcttaacctgtacttcaaggggtctgtggtgagagaaaccaatgtccaagtttagaaaagaaaaaaaggaatttattggaagagtaacatagaattaccaggtctcaggaaatcggaaccactaagtgtccgaaagggcaggcaacggaagcttagggaacccttgtagcaggaacagaagaacagatgcattgcttccatctgttcagacctggcagtatctctccactggcttcgcttgaaatacaggtcaccccttggccagggccaagtaggacaccttgattgacaatctcaccaaaatatgcatcagggaagagttattcccttaaagaaaaattggtctgctgatactaaaaattggtagatccagtgctggaaaaatcaaccacggtacacaacagggttcataggccccgggaaattttgcatgtgtttgcatgtctgttttcccaggacccagacaaatattaagatcattgctttagttctgtcaattccatctagttggagtgatgttcccatagtgatgataaattatatttaatttacattaaatataaaattaataacaaacttatggttttcctttttgttccttagccccttgtggctgcctagtttcttttgtatggagatgcttgggatagtcctgcctggttcagttaaaatcactcgttgttgctaggagggtggagttcatccacttatgatataaatgtctctttttattttttgcaggcaactttttgctccttcctacacagaaacccattatacttcaagtggtaaccctcaaaccaccacacggaaattggaggtgagttcaggtcaacaaatgtctatccagcagctgtcctctcccagccctactcctaggacctcaggagatgcctgatggagttggtctctcctctgaagggagtgtttcccccaagcgaagaccaagggagcaaacgagaagcaaaacatgtatttgatgttcataggtgctcctcctcctttgctgactacaatggctaaagaaacatagactattttagggtaattgcatctaattacaattgatgcaaattactgtgaaatatacatgttctttgctttatgttaattacccacatgttaacaaaagttttagtaaaaggagtgacttactcataatcctgtcgtctcatccaattagatgtttgattagtcctttttaaatggatgtataacatttacagagttgtaatcactgtgcatatacattttgtagtctgctattttaatgtgatttttaagttatgaatattttattttgcttctatattcatattggacattttttccctcaaagttgtttttgagtagggatgtttacgcaatgtcaaagatctttcatttagaaaatggtctttcagatggttacatgtcagtttgctttgccacactccactggtagacatttaaagtagtgaatgatacacatttcatggtggctagctcttcttacagggatgcctattggaatttgtaggctcagaacgttgattctcaaccaggagaaccaatggcgttgccccgaccccgagggacacctggcaatgtttgcaggcaatttttattgccgtgactggcagggaggatctactggcatctacattctataatgcataggacagacccaccactcccccacaacagaattatccagctccaaatatccatagtgcccaagttgagaaaccctggattcgaatgaccattctcaaagtctgggctggtgagatgggggtgaagaagggaagacgcacactggcaggagcagcagtggcctttgcctttggggcaggacataatggactactgaggcacacagactgggagttgtggtgtggagaacagcaggagaggtccctctgcatcaggactccttcagcagcttctcatggaacctgagtgttctaccaggcccattctttaaaatatccctgctggagtgcaagtgtccagcaagataacactggccactatcagtcattaacagctcagattagttcgccagattacccctggatggggaaagggacacaggacaggtaattttgtgtgtgtgtgtgtgtgtgacagagtttcactctgtaacctaggctggagtgcagtggtgcgatcttggctcactgcaacctccgcctcttgggttcaggcaattctcctgtctcagcctccccagtaggtgggattacaggcatgcatcaccacacttggctaatttttgtatttttagtagagacagggtttcaccatgttggccaagctattctcgaactcctgacctcaggtgatctgcccaccttggcctcccaaagtgctgggattataggcatgatccactgcgcccggctaattttgtatttttagtagagatggggtttcaccatgttggccaagctggtctcgaacttctgacctaaggtgatccacccacctcagcctcccaaagcgctgagattacaggccactgtgcccggccacagtttttgatagatccaagagacgtggcgcatagtaactgggtagctcaggggctgtgttttgtggctgaatgtgaagaccagtgctgccttcttaaccaagactttcttggatggggaaggagttggtagtgtggccggtgcctgcagcaaagttggactgtgtcttctcatccccagggaggctgtccagttgtgacttcatattcttcaatgccccttggtcaaaacttttcctctcttcttgagacctctgttctctgcctccaggggcaggggtgggatgggggaacaggcatgcctagaaagctgttagccatgacagcctccttcaaacactctcctctgagtttggatcctgccacttctgtacccacagctcaagaatgggtctcagtccacgaatttgccatgagctcacgcttcctgctatgaaagcccccttggggtggccccatcaggctgagaagctgaggaatgcaatgacttcatgactgatccttgacttgttctttgtgctctctgcttgtgcattaggcagagatgttgtaagggcctttcagaaagagaggattggaaaagaactccccctctcccagaatcccctccttccagaaggtcttgttgactgaagcacatcctagctgaaccttgggatggacaactcattgtttgcttacatcccctgctactagactcttgcaaagctcccacccaggcccatggggttctcagtcagacttcccatttgggagctgagagctcaatgaaaaatgggaatggaataaactactcagctgcccttgacccgaatgttggagactgcactctactaccaaacttggcctggggtagctggagttctgggaaccttatcaagactcatcagtcaggcctttaggcgacagcctgcatctaggtcaggcggttgggggaatgggtctgtgaatgtgttccaacagaaaggatgacagggtttgcaatctgcagccagggttgttatcttggctttaactagttatatgaccttaaacaacccccttgaccacactagtgttgagttttctcatttgcaaattgcatatgctgatatctgactcgcagggctgtggaagggtaagatgaatcactaatttttatgggaattcataagcaactcttccaaccccacattttacagatgaggaaactgagaggagaaggggaaaagtaacttgcccaagttcagttaaccagtaagtggcaaggcttaggctagaacttgtctcctttgttgctagagaaggtggggataaaagagctctgacaagccaagttcctcctttgctactgctgggagaggcagaggatggagcttggggccaggctgctggggttccagtatccactttgctgtgtcaccttgtgaatgacttaaaacctctctttcaatttccccctttaaaacatggcaataataatatctgcctcataagattgtggtcagaatcacaaggaaaaatctgctaagttgttcagcaagcagtaagagctgggtagatgttagctcttttattttagacatagggcctcgctctgtcccccaggctggagtgcagtgacatgatcatagctcactgcagcctcaaactcctagcttcaagtgatcctcttgccttggcctcccaaagcattggtattataggcatgagccgccatgcctggttagatgttagctcttattgttttgtttgtttgtttgtttgttttgagacacagtctcactctgttgcccacactggagtgcagtagcgtaatcttgactcaatgcaacctctgcctcccggattcaagcagttctcatgcctcagccttccgagtatctgggattacaagtgcccgccatcacgcctggctaatttttgtatttttagtagaaatggagtttcaccatgttggctaaggtggtctcaaactcctggcctcaagtgatttgcctgcctcggcctcccaaagtgctggggttacaggtgtgagccaccccacccgacctcttactgttaataatagtaagttgtaggtgtcatcatcacaagagatagtgtatgtgaaagctctgtaaattataaagcatgctacagaagccaggtgctctattttcgagagaactagggctgtgaacactcttagcatccattcaaagataggaagaggtgcagggattcttcacagccatccctgggtttcagttctttcttttttctttttttggagacagagtctcgctcggtcaccaggctggagtgcagtggtgccatctcggctcactgcaacctccgcctcctgggttcaagcaattctcctccctcagtctccgagtagctgggacgacaggagtgcaccaccatgcccagctaattttttgtatatttagtaaagacagggtttcaccgtgttgttggccaggatggtctagatctcttgacctcatgattcgcccaccttgacctcccaaagtgctgggattacgggcatgagccaccgcgcctggcctcagttctttctgttaaccagcgttttgaaactgtagctgatacacgtttctgaactccttgattctctgtcattccaacttctctgagccccatttactccacacaggcccggcccctcttctccccatgagtaatcctgtgctacggggtttgtggctcccctgttgagttctaaggaccaggttcaggacttgagtgcttcatgaggggcctccaaatcccagatcccacgggtaggttgagaagccacatgacaggctggcatttgaaagcagttggaatcctggccaggaggagggttttgcctgccacgccttctttcataatcacagcacactggctttcctttgtgctcctctcaagggtggcatctgacttgtttaaagtccagaagagtttgatgcaaagacaggggttggctctgtccctcctcctgactatgagcttgaatgggcagaggagccacatcgctggccgatggatcatatgcagatgaaagggcacctgtggtctggagaacgaggccgtgttgagtgtcagcttggcctgtatcctttgatctggctgcatggctggctggatatgctggagcattggcacagctagggctttggattcagcctcttggtgggcttccaggcgccttgaggccatattctttgataaaggagaatttcatgattatttggttgccgatgtttatcgcctgccactctcggccaagtactctactagctcctttatgtacgatattctcaccaccactctggggtacagaggctaaagacactgaaggtcagagagagttgtggaactgcgtatgcttggatttaaatatgcctggctatgccaaaatgtttgaatttaattatttgtctatactcaggattagagctgggagggaggtggagccagagaatacagacacacggggtagctgattattgggtcacatccctgtctggtggggacaaagaagcaactgcaagcagcatggtcctagagatgggggaaaagagaaagcttccatgtctgcaactgtgtggtttgcatccatcccttttgagatctttccagaacttggctctaccctgtgggttttatcttctctctgttctgaccagtgcatctctcttgacttatttgggaggaagcctctaggaatgtgtctcttgttgttacccctgattcgttggacaccgtcctgatttcacccccttctgtctggtttagcactttagcatgcccaacagtgcgtatttgcttcctaaattctatggttacctgacttataaaatgctcggccagcacttgaaatggttatttcaagccccttcttttggtttgtaattatatctgtttggatttctcattaatgactgcctctcacaagaccataagccccacgaaggctgaagctgtgactccgtttgctggctatggtgtctccaggggctggcccctggcctggcacagagcggtggtcacagctgtttgtagtgatggagaaattctgacagccatgagacacagtggctggagagcagcagcagacctcacgggcacaggtaccaaatcaagtacaatccagatgtggagggatttgtgtgaaagagcatcttgagctgtggaagagtagggagtgtttgtttcctagggctactgtaacaaagcaccataaacttaaaggtttaaaacagtagaattttactttctcacagtcctggagtctagaagtccaaactcaagatgttgtcggggccatactccctccaagcctctggagagaatccttccaggctcttctagcttctggtggcttctggccatccttggtgttccttggcttgcaacttcatcactccagtctctgcccccatcttcaaatggccttcttctctttctgtgtgtgtgtctgtgtgtccttccctcttgttagaaggacacaaatcattggatttaggaccttctctaattcagcatgacaccatcttttttttttttttccttttccttgagacagaatctcactctgtcgcccaggctggagtgcaatggtgcgatcttggctcaccgcagcctccatctcctggactcaagcaattctcctgcctcggcctcccgagtagctgggattataggtgtgcaccaccacatccggctgatttttgtatttttagtagagacagggtttcaccatgttggccagggcggtctggaactcctgacctcaagtgatccatctgcctcagcctcccaaagtgctgggattacaggtgtgagccaccacgcctggcccagcatgacatcaccttaatttaactacatctgcaagaccctatttccaaataaatcacattctgaggtggacatgaattttagggggattctattcaactcattgcagggggttgcaaagataacattggtggggaggcaagttctttccatggcatgcttttggccacagaaaacactgattcctgaaagagccctgaactaggaaaattctggattttccaatcagcagggagaccttgggcaaatctctttgctcctttgagcctcagcttttcatctgcttcatggagataatgacatcttccctgccccgtctcctaggattattatgggaatcagatgaaatggtggcttggaaagctctttgcaggttgtaaggtgctataaggttgggtaggtatataataagccatgagtcatccatgaccatcctgagatattaacattgccatgcttatcagtgttctttagcctgaccacctcctttctccttgctaggatcactgcttttaccacggcacggtgagggagacagaactgtccagcgtcacgctcagcacttgccgaggaattaggtaagagaccctgaggctgcaggtggcaccgggcactctccccaggaatggaagtttcaagatagacaaggctaaggcaaggaccttgggaaggagtccattgagaatgtgtgcaagccagcccagagaggggctgagcctgggaggatgggcaagggaaagcctaggtaatccagaaatccattgggatttaactttcctgatgaacttgatgttttaaaatataggttttgttattatttaggtatggtaaggccaaaaaatcaggagatgactgccattgaaaagatggtcatactcacagaaaagggaggggcccggctgtgccatggggggcggcacggggaggcactggggttggtcagcgggcagagggagcctggagaaatgtcagcagatgcccttcttgtggtttctgcgggaaggaatgggcgaggcagagaaagcaggtttaggattggctagtttgcatcatttcagcaggctctggggtttatgggctctctgtccttagttgtcctatacctggttctggggtgattagggaagggggatagtggcccagagggtgagagccccataaaataaatggctagggtatggactctggattggttggcttgcatttgaaaggcaaggtagctgggaaattgttgaccatctctaggaattggctaatcctggaaggggcagtccctctatggtcagtaagacccagatgtcaaagaaacagaagataaaaaagaagacacatggttaatatgctcgggatggatgagtttgggcatttggttccacacctcctcagttcttctctgggagatgtacttggaggtggtgaaataggaaatggacggttaatgaacagagagtaggaagtgaaaggaaaggcaaggataattttcaagacagaaaatcaactgaaaagttctgaccagaatgtgcttttgagagtgacccttccttctctgagtgagactacctggctttgagctggtagcagtttaccagctgggtgaccttgggtcccagtggtctcatttgtaaaatgtggataaaaagaatatatgcctgcagttgtgaggattcagcttgtgaatagctatcttacctaggaacttgcagtggcacactgtcagcatgcagtgaactcctaggactttgcttctctaggtgtgttccatggatgggcagcatcaactttacctgggagcttgttcgaaatgcagcatctcaggttccacgcagacctactggattttaatctgcattttaccaagactcccaagtgatttgtgtgcccattacagtctgtacctgagaatgtgtgttccttgagaatatggagtatatctcaaatatctatttctctccaccagcctgccttaatgccttgcttgcagtaggatctacacatgtatgttgacataataagtcttatttatgtagaccactttcaatctccctcctcttttttttttttttgaagaaggatgatgatctaaaaaacctggtatctcattgcatatactaattgcctgggttttgattgtctgtactatgtggtgcctctgtgcagtgatagacagtgagctacagtttcccagaatacacaggctcagtgagagacacttcagcccagtgtaaactggctctatgacaaaaaggaaaaagccctgatttgtagcatctgccaatatgctgacaaagataatcccaccatgatcaatttcaggctaccgatgtgatgttattgaaggcagaattgggaagatatgcctttgattggctctggtgagctgataggaggtggctccattgtgtgttcttcctctcttgactgattgcttcattcattcaatgattgcatttttcattcacaaatagaaattgggtgtcttcctaatgcccataccctacacaggtggagggaaaaccagcactgtaattttggagccctcagtttccttgtcaataaagtgaacatcagtattaagcatggtagagattattgctgtaattatagtacttttaaacataagggtttttcctcctcttacgtcggtgaaaccatgctaagacttatgcaggctcctatacaaatggaaggtttctcacactgcaggtcccaagtgtctgtttataaattgggccatgactttgtttgaatgctgcatggtgagttggctggaggaaatcaggcaggaaatgggctttggatgggaagcaataacagagtggccccaaatcccctctgcttaagtgacctgattgagccaagctaactggcctcgcagtggtatttacaagcccagccaccgccacctgcagtctgcaagtaaacaaagtttgtcccaagaaggaggaaaaagaacatgcaggtgtgacctgcttctgtctgcctcttcctccatcccctcagtctggagcagtgggaacttggcttggcgtcttgtaaatcattccagcagcagtgctgaaagggagggggataccgggtgagctgtccgtgtgtttctgttttgcatgcttccgtctggtgaggtccacctgccttactttcccagccttctcactacacacgccttaagaaaccaaggctgtgggtggactgatttaagagctggagactcatgccagatggttccatttgaaccctggagaaggagcagctgcaacagcagcaacattcaaacccatgtcgtcaaaacactaggcgcctcccaaagctcataaagcactgctgcagtgaaaaatctccatagtgattgttcttctttcctggaaacatgctcccatgattggagaaataggtaggatttctatcaagtgagatcttcaagctgatgataccaagaggaattcagctgagcttctaggtggttgctaggccccctcttctcttcaaagcagttctttaggttactttaattgaagaagtcatgtattatcttagtaaaaataaattcaaaaagtacaaaagagtgtacaatgaaagataacatctctttctcaccccagatttccagattttcccccttcctagagacagccgttgttactagtttcttgtatatccttttaggaatattccttgtgaaaaaagaacgtagatatgtaattgatatggtttggctctgtgtccccacccaaatctgatctcgaattgcaatccccatgttttgagggagggtcctggtgggaggtgattgaatcatgggagcagtctccccatgctgttctggtgatagtgagggagttcttacaagatctgatggtttaaaagtgtcagtttctggccgggtgcggtggcttacgcctgtaatcccagcactttgggaggccgaggcaggcagatcacaagatcaggagatcgagaccatcctggctaacacggtgaaaccccatctctactagaaatacaaaaaattagtcaggcgtggtggtgggcacctgtagtcccagctattcgggaggctgaggcaggagaatggcgtgaacccgggaggcggagcttgcagtgagctgaaatcgcatcactgcactccagcctgggtgacagagtgagagtctgtctcaaaaaacaaacaaacaaaaaaaagtgtcagtttcccttgtgctccctctctcctgccatcttgtgaagaaggtgcttgctttccctttgccatccaccatgactgtaagtttcctgaggcctcccagccatgcagaactgtgagtcaattaaacctctttcctttataaattacccagtctcaagtagttctttatagcagtgtgaaaacggactaatataggaatataatgtctgtaatcttatttgggcccctggaccctttgagaattgattggaagctatgggtacttataaatgacaccaataggccaggcgcggtggctcacgcctgtaattccagcactttgggaggccgaggcaggcagatcacttgaggtcaggagttcgagaccaacctggccgacatggcaaaactccatttccactaaaaatttaaaaattagccatgtgtggtgttgcatgcctgtagtcccagctatttgggaggctgaggcaggagaaccgtttgaacccgggaggcagaggttgcagtgagctgagatcccaccactgcactccagcttgggcgacaaagcaagaccccatctcaaaaaaaaaaaaaatgacaccaataaaaagatgtggcatcccatctcactggggatgtcaagtttcattctcccaagcctgtctcagattaagacattctctaaatatctatactgggttaaggtgtctctgactgagcctgtgtgttctgggaaactctgtgtgtgagtctgtagctcactgtctatcagcaggaagtgtatctggttggtaagttgtttacttttttaaaaatttttttttgttaaaaattatcattatataactatacaggtttagtgttaaatgttcaaatcatgcaggaatgtgtaagctttaaaaagtgaaagttgtttatcttgtcctacccttccaaccaatcccattctccatctgttattactgttggaggtatccttaattactgttggaggtatcctttattgaaatacataattgtgtgtgtgtgtgtgtgtgtgtgtgtgatatatatatatatgtatatatgaacatatttaatccaaatgagatcaccctatgcatacagttttgtattttttttccaacttaagcattatgttttaggtatacatagatctatctcattcttttaatggttgcataatatcgtttgtactaatgtctggcacgtttcattatatagaaagtctttcagaggtatgcaataaatcatccatagtggtctatttgatggatcacccttatattacagcagccctgccttcgaaaacatagggctcactctcactgtaattacaccttaaccgtggtccctggactcagattctgtgagagagggagagagggagaacatgagattgaaaatgaatgcaggagaatgtgtaggaaagtgtgcatgatggcctggaataagctcaaaatgtaaagtcaagggatccacgtttaagatctagctacatacttcctggctgtgtggatctctgtgttttcctctccccattaaattttttccttgtctttgctgtggccaggctggtccctccacaggcccctactctatccaaaaggtggctaagtcctgggagtggggtgggtggtcagtgggggtgaggtcaggggcataccccagagtcatgaacctgaacattaggagagctgggattagccccggctctcacattaactggctaggtgagcttgggcaagttcttttttgggtgggctttcctcttttctgtaaaacaagagtagaccagaccattaaaagcttccttctgtgttggaagtcctgggatgcagagaggttgggcagagtctcagggaggtgggagcctggggcagaaggaggtggctcatatacacacagccagccctggagaagaagtggcaagtcctttccacctttgaattccttgccttccttctgcagaatggatcataaatgctacctccgtgtcaggcattgcacagattaagccctcagaggacagtgttattaagttgtgatgaatttagattctggagccagacacttcctggtttaaaccctgccaagctacttaagttctcaagtctcagttgtctcatccataaaatgggaataacaatattgacatcactggtggatttacaataggtgaggagtgcaaactccttgacagcagggactttgctttgatcatgctatttcccgagctgagaacagttcctgtcacacactgggttctcagtacagatgtgtagaatggctatcgaataaaacactttgcgctttgcttgatgtataatacacaatcaatgaccgttagctgttcttttaaaatgctgctttggttattagtaaatattgcctattcagtccattatcacagcaactctgtgagatgggcagtgttattacatcacttaccacacagctaggagacagcacagccagagtttgaatccaggtgctatatgggggcaccctgtccttgagaaagtacatgacctacaagccttctcttctcttttttgcaggctttggagttccctgtaactccttttggatggatataatttgcagagaaggggagaggaaagaagggtagcagggtagttactttttagggcacctctgggtatagggatgtagaatgtgtcccctttggtttagctctgaatggacaagtccccaggaagcagttgttggcctagttccttgaagaatgcatttggtgaatccttcagttatgcaggggttaggcatgaattgcttggtgcctgcctggcctggcctgcccgggttttcctatacaatttcatttgtatccatctcttaacgatgagcaataggatggagaacagaatggagaatggcatgtgaggctggccacccagcctcctgggccccagctcatgccttctggctgagttctgcctttgccagggctaacattcagcaaattagatcaaccaaggctcctagaaggataaacaactggtggtgcttggaagagggcagctaaaggaattagggttgagggcggggacagcccctggaaccacattctcagacattcccccagcaacaaagctgcagtccactgacagtgctggggcttgtgccagcctctcctccatccccaggccgtctgagaggattgcagtcgtgacatgggcaaataaccaggaacagcagttggaggaagggagggaagtggccacagaatcctattgctggaacgaccttcagggtccttctgagcctctgtttctctcaaattgtaatctgcccactccctgaatcagaattactatgggcctggtgaaaagcaggtgcctgctacagagggtggtctgtaggccaaagttcctgagtgtggctaggcagggaattactcaggcctgcagctctgcgttttttaggttgggccctgtattagtccatttgtgttgctataaaggaatacgtaaggctgggtaatttataaagaaaagaggtttattttggcttacagttctgcgagccatacaagaagcatgacaccagcatctgcttctggtgagggcctcaggctgcttccactcatggcagaaggtgaaggggagcctgtgtgtgcagagatcaagtggtgagagagaaagtgagagagaaagggaggaggtgccaggctctttttaataaccagctcttgaggaaactctcatgggaatttgctgagtaaaaactctctcattaccaccaggatgcaccaagccattcatgagggatccaccccatgaccctaacacctcctaccaggcccacctccaacaatgggaccacattctaccgtgagacttggtggggacaaataaaccatatccacagcagacctggatacctatgttttcaatacactgtagaatattctaatagatatccctgagacctctgctcctagagatctctgacacttaggcttggaactcactgatggaggcagaaagcacagaggctaaggggatggggtccagagtctgtggaccttaaatctttgacttcagattacctagtccccatgcctggagcccacactgcccttaaccatgagagcttgttatttaatgtctctgagccacagtttcttcatctataaagtgggactcatgagggtgcctccttataatgatgatgtgggaatgaaataagaataacatttgtaaacacagtgcctggcatccagttagctcaatcaatggcatctgaaggtgaaaagtaggctgcatacctccttcatcttttctcttaggaaactgaggtgaggccaatcacccctaagaagagagctgctggcaccatcactggagccatctgtagactggtggtatctttctaattcactctacagggtatttttttttcttttggagatggagtcttgctctgtcgcccaggctggagtgcagtggtgcgatctcagctcactgcaacctccgcctcccaggttcaagcaattctcctgcctcagcctcctgagtagctgggattacaggcacccgccagtacgcctggctaatttttgtatttttagtagagacaggattttaccatattgcccaggctggtctccaactcctaagctcaggaaatccacccgccttggcctcccaaagtgctgggattacaggtgtgagccacagcgcccagcctctacaggactatcatgattgaggcagtggaaggtcagggtaaggttgtgggacttggaactagaatgcttccattcaaatcccgactcctttaatacctaggtgataggctgatctgtgcagcaaatcaccatggcacatgtttacctgtgtaacaaacctgcccatcctgcacatgtaccctggaacttaaaataaaagttgatgaaacaaaaacaaaaaacaaatccctactcttactcttactgtttgtgtgactttgggttaattaaccttgctgagcctttgttttcccatttgtacgttggggacaatatttgtaaggatcctaggaaggtggtgggaagaataaaatgctcacttagcacagtgccaagtccatagcaaaggctctataatctgcagccactatgaggattcttatttattgtgcaccacactatggcttggtctctgtcctgtttagctcacaggcttgttcaagtgatgccagatcagttgcgccttgtgaacctccattggaactttccctgattcctctatggaactttccactcactgggtgtaatcttggcaaccacaacctggtgcacacagaaccatcagctggttggtggtcaagccctctgtgttcccaaagtgtgtagccgttaggggaaactgaggtgatgggagaggccttggttggctgagatgaaaagataacttgggaacaggatgcgtgcagcagctctctcctctgccctttcctggctggattagggagtggatgcgacccttgctccttgccacgctcccacccccagatgttcagggagtaccttagatgtccgtcagagggggtgattgggtactgctgcgtcagactgggtgaggcaaccaggaagtcatcaggcttcctggatctggaatgaggtcagccagggatgggatccgggaaaggctgctgcccatcagagcctggcgctgattttccagagagcatcacaggctcttcccaaagggcaaaatctgggcaggaatcccaagtggcggttgtggtggaggtggaagctgagataagctaagagagaggtcctgccaatttacagtggcaaagactgggttggagatgctgtaggttctgagctctctgcatggatgagagcctgcctgaggttttagagcatacaaaatgctgctagagtccatggggcttactcctgggcttcctcctcccactgagccttgattacatacctttacaatcatgtttatctcattgtatcaaggttggcagatatctgctgcctgggccttcactgatcattagcaatagcaattgataataagtcatggtcctctttcttgctgaggctagaaaagccctcagaagccttggtgatgtaacagttgaagcagctgcctccagtccaaggggtgatgaaactttttgctctctctgttatacattagagtgacttattccaatgtttacactcaacgcttcacaagggtaggcacttggtgtgtcttgttcgctattccgtcctcagcaactggcatgatacctggcccgtagcaggagcccagtaaatgtttgtgactgtcttccagaggactgtgagtttctcaaggacaaggattatgtctagattatgtctaggacacatgagtttattctgagttcagtgctagtatctataatcaagggaggaaaaaaagtagtccctcatgcttggtggtggatgtcacttcaccaaataactaccgtgctgacgtggggcaggtgggacaagtaggcgtgtcatcactgatgcatctagctctggtttccaagcacaaagacccttgtctttccacttaatcatccagtagtcttgataagttatcattgccgtgttagggatgaggaaactgacgcttggagagatttaagatgcttgttgaagagcatgtgacaattgaatgttggagctaaatccagaacctcggtcacctcacttgcaggccactgttctttctctggccactgtactgcttttcctgagtctctaaagttttgacccatgatttgtcatatgccatgttttggtttgggaggctttttggaatcctggacctaccatccttcataagttttaagtgtcacaggtacagccttcttagaactttttgagatttcccagtccagagacttttaacctggagtctcacgatgagcttggtggtggtggttgggtggggtgggggttggggtggaggtccaagtgccctgagctcatgcaccactttttatgtataagtgcattcctctagagaggaagtgtgagcttgcatcagagtctcacgaaggggtacatggccccataattaggttaagaaccaatgatcaaaacccactatgtcattttgcatatggagaaactaagacctacacaagggactttttcagaaccataatctttgaccagagattctatttctcctctcaacagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcagggtgagttttgaggctctcagtgcagaaatcaacctggggacaggcttgtcccctctgaggttgcttactttgaatccaggagtatttctaaattgaaggtgatgcctaagaaaaaggaaatagtgtttttcttttattctgtcattgttgagtgtgaaataccctcatcatagaataactgcttttgggggaaaacactactacctttaaaacactcagatgctgacttcagaaagcttaaaaagtgaaaagaaggctgggcgccatggctcatgcctataatcccagcactttgggaggctaaagcaggcagattgcttgaggccaggagtttgagtccagcctgggcaacatggcgaaaccccatctctactaaaagtacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgctttccctattggagtagacactacaccatatgcacacagtcctcatattgattcatactgaaaatggcatggtgtttcgaggtttcgaggttctgtgggaacgtggtggttagcacactccctctcatatgctggcctctgtcctgcctgtgctcatcagctcatctcagtattttctgagaataaaggactgaatccagggtcccagagcagcctccagcaataaccaaatggcagtggaaggtgttatatgagtgacggccaccacagccaagaacatctctagtgccgaatgacaaaatcattacggaggtagctgctgcttatccagcagctctgtttcttagcagttttttaaaaatgaggccaagtccactatttctacagcgctgatctgtttctctttcttagatgaaaagggaagatttaaactccatgaagtatgtggagctttacctcgtggctgattatttagaggtaagggggaggcaatgggtcttgcagaaaaactgctctcttgatagcttccattccaggctccagactgctttggggaaatgttgcccattcatctttctccagttcatctatgattttgaccttaaatctcaccaaaggctgggcgcggcggctcacgcctgtaatcccagcactttgggtgggcaaggcgggtggatcacctgaggtcaggagtttgagaccagcctggccaacatggtgaaaccccatctctactaaaaatacaaaattagctgggcatggtggcacatgcctgtaatcccagctacttgggaggctgtggcagtagcatttcctgaacctgggaggcggaggttgcagtgagctgagatcatgccactgcactccagcctgagcaacaagagcgaaactccgtctcaaagaaaaaaaatctgaccaaaggctcattttgccattttaaacatagttggggggaactcccccaactccccccgccccttcctcccccacctccacacacagctaagcctctcctggcttgttacatcagtcacatagaaaatcaagacagttgtctgattaacatttcttgtactgggtctgaagacctttagattctggtgtttattctgaggaacccggaattgtctatggaaattctaaaacttttttttttgcaaagatgataaatatattcccagtcatccgactgaaaactgtattcttgcccatgtgtgggtccatttttataatcatgttgatgccaaatgatgacctaaagccatggtccccaaaatgtggtccccagagcaccagcatcagcagcacccttgtgtaagatgcaaattctcgggccctgcccccgacctcctgaatcccagactgtcagggtggggtccagaaatccatgttttaacaagacctctgggcgattgggttgcacagtcaagtttgagaaccactgacctaaaggcatagcagttcagcctttaactccatgttcctcaaatcagacaggttctaagaatttgaggaaccctcacctggctcatcatgtatttcatttattcatcagtgatctcttgattttctattatgtgccaagcacctggatatatagatctcaagaagacagaccctccccaggcatcgcagaatttgcagtaacagcacacaaacctgtaggtccaaagtgtgataagcactaagatggaccattaggagggatgaaagtgcagataatgggggattcaacatggttttgggaattagggaaagcttccctgacattgaagcagacacctaaagagtgagtttaggccccagagcccatatttgcctaaattagccagctgttacctccaattctcactttgtttagtgactccatcatataagtactaagtgcatcttctgtgcattggatgtcattatgagctgagcgctcgctgtgttcgagcagggcagacactggccttggtctctcctgaggatagagcccatcacaactccagtctgtctgtatcccatccacatagtttagctaccatcttcccaaagagctcattctaaggcagctgtacctagtcacatttccaaagcatgtgtcctggcagcagggcctggtggtggggagagcactaggctgcaggccagaaggtctttgagtgttagtcactggatgttagcagcagaaggaggtggcccttgaagctgtcttaaaagacaaggaggagttaactgggcagaggagtggaggtgaagggcattccgggccgagggaacattgtgctctgctttgaaaagcgtttagatttattttaactgatgttgatattggtttttccaacagctgtttgtgtgtgtgtgtgtgtgtgtgtgtgttctatgttttctgtttcctctccaaagactagtgtgtctataggatgggggaatagtgtggggagcaaaatccaaagctggtttaaaagccagctgaggctccatagtcgtgggaggagataactgactctggcctgccctgcctgactgcccgtagtgggaggactggtggaagaaaactgagctcctctgactctgggacatttttccacttaagttctgcatctgtgatcatctgatacaatggtcttgagtcatttttttcagctacagaatcctttggttacatggaagttcctgggaaccccagtagttaagcatatagagcccagctgctctgtttaaaggtggggtgtttctcccctttggccttgcattgttctcagaggaatctctgtgcaggctttcaaacccactgggtgtgaatctccagcagctggagaagtgggaagcatggtgggaggcagggattaggcatcttctatctcctgacctccagagtcacagcacacctccagagaaaaagtgtccactcaaggtgcctccaggactctggtgtcagctagagccatctttctcttacaaaggagagtgtctcagcaacagccctgggttcccaacagggctgtgattcatgcagctgtggtggataagggaacgtgctcatttctcagtcctggacacccctccgctgaaggctttgaatgattcatttgagggactggggtgggggtgtgtaacaggccaggctgggttcacaggctcacgaatcatcccctctccacctgtctccatcctctgcagacagaaatatattcttgacaattaattaattaatctgagaggatgggaaggcaggaaaggggagggctgctttaccatgatttataacctgctgcagagacagagccttggggctctgaatgcagagcagaaagtggagacacagatagggagagcaagaccctgctgctgcctagagagagagttgtcagcagtaaaaatgagcaggcagctcctcgctccctgggcctaggtgggagcttctagggtggttctcagtttattcattccccaggtggaacggaatccaggtggggataaagagtaaggtgggctgttgtaggagtagacaggataactgtaaacacaggcctgtaaaggacttccatgatgctggcacagtgcagagtggctgggaaaggatggtgctgcatgtggtactcactgtgtcaccctagaaaatgtaagtttgagacagtcctttctttacatcaggggtctgcaaactataccccatggtcacatccagcctatcctgtgtttttgcaaacaaaattttactggaacacagccaggcccattggtttctgtattatccaggcttctgtattatatatacaggtgtctgtattattctgagccaccactgcacagttgaagagttgtagcagagactatggggccgcaaagcctaatccggcctttgcagaaaagatttgctgactcctgcttcagaatactctggacaacagaattcgctccttaaattatggtggtctcattgggcagttctttgaagagaagattaatatttttttgaaagacaatgaaatctggccctgatgttctaataaatattactaaatgaatggaaatgctgcaacgctgtctgtgccgagagaccaatttagaaacaggaggcctctataatgagaaactcctggattaacaccttggaaaggtctaagttacagtgtcacactgaatctaactctagaaagcagtggtaacagattctcttctggtgagtggcagttttaaggaagcctaagaatgtccacaagctgtggtgaaagggaaatggtggatttcttccctgtatcagggctggtacacacctctggccaaacaaataccccaggttgttttacttggctgttcttgttctttcttgcttagatattctcatgggatggggtggaggaaggacgtgaagattttgaatcaaaataacatgtatagtgggtacctaagataaattagagaggacccagattctgtgtaacaatggcagtgtacaggacatgcccatcatttttaaatgtaatttgcagttgtagcaggttttctctttacactgtgaagctttccttcatcattgcagctcagagagatctatctttttgaggcaggaatggtaaataggaggtattcatactaaaatgtcctctttctggtacccatggcagatatttctaatggaacacagctttctttcctgtgcttggttagaaatgtctgattacggccaggcgcagtggctcacgcctgtaatcccagcactttgggaggccaaggcagatggatcacttgaggtcaggagtttgagacaagcctgaccaacatggtgaaaccccatcattactaaaaatacaaaaattagctggccatggtggcgagcacctgtaatcccagctactcaggaggctgaggcaggagaatcgcttgaacccgggaggcggaggttgtaagccgagatcacgccactgcactccagcctgggcaacaagagcgagactctgtctcaaaaaaaaaaaaaaaagaaagaaatgtgattgaatcgatgcagtctcataattcttctcattcttctcactgtagaaggcactgccagtggatctgagtggtgtgcaagatgaagcctatttgccagtgtcttatggtcctcctcgttggcactcatgtcattcacatgacctcccactgtggttatttctgtgcacgttttcccggcaggttttctcaaccatttcagttctatactccttaagtacagggtctgtcactcagcatctgccacagttatttctggccctctctgttttaattgaagctcctctaggctagaaccaagatctcacacttctttgtgtcctacatagtgctaagcacaatgccttgcccatagcaggcattcagcagcaattcgatgattgttgattgaccacatgtagggaagcctcgtgagatctgtgtaatggtggcttcatgttggggtgatgaccacggtgaggattggatcagtcctcctaagccccagtgggagtttgccagaggccatgtaattcgaaggacaggagaataagatgtgcttcaagggttagaggaaggcaattctactccgtgcataattattgcatgcctactgtgtgtgctgcgctgagctagtagctgtggatatgaagatggatgttgacaggtcctaccctccaaagctcttactgtggtggggaagacaattgcataaaaatgatggctcatagaagacagaagaaaataagagcaaattcaaagacaagtaatggggcgcaggaagcatcctgtgagaggttctgggatctcacatggttctgcttgtcccatttagtttcagaagaatcgacgagaccaggacgccaccaaacacaagctcatagagatcgccaactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacattgtgtatatgaaagaagatatttgttatagtacaaaatgcagaataggtaacctagaatgacagtagcctcttggtaggctagtagtatatagtttttaaaagtagtttttcatgtgtttgggatcaaaagtctctttgagaatctggtaacgtttattgcacaattttagaatactcataacattgatgaagcttaactttgggcctgctagggattcatgaattccaggtctaaagggaaaatcattttttcctaaacactagagaatataggagatcacttaaaatatgttttagggattaataggcaaatgtattagttctgaagtcatcagatggcagtttccatgcccatggtttttttctgccctagatggctctggaaacaaaggtcagtggtcagtgacaggtgaaagtcaaacactggcatttcctggaaggacagactctagggacacagtccagtcctccctctagctcctgactcactcaagaataacatttaaataatcctacaacccaaacatttgacatctgggaaaacaagggaagcttgtttccctggggagaatatgggaggctgactctgctttcccccatgtgacatctattgtttggagacctggcaggttcggacttggctgggtatcccctctgtggggtatgtgatggaaccaagggcgctggtgacaagtgaagggagaagagaggcaccagcaagccccagtccttactgaaagccctaagcctgggtggcccatgcatcctgtgcagccgtcttggctctctcctcgcggctggtgttagtcactcctggcgggtaagggaagccacgcccacttctctggagcttgctgacctagctacttgaactgaactattgttgaactaaaactggaatgaattggactcgtgctgagtcatgaacccaatccaaaatgtttttctgtaactgtgaaaaaaagccaagtttacttccttcaaaagctccctagtaaagcaaattcaaattggaatctgaaccttttattttctgtaacgattgaactggcacaaaacagaaaaatcaaaatttctgttgaaataaactgatatttcactgaatctggagcccatcttgaccagcgtttcttggagcgagtggattatctggatgtgtaggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggtgaaaaatgccagatcataaagattagatgtagctctagcctcgaggaggtcgagtcagatcttgggtatagaatttcaggatctctggtttggacaaaaccctgaagattaccaagaacgtctgtagtctattgcttgcaacctgcttattccatccttgacaaaacctgagactatccagggatggggaagaaaatttgaagagtaagcatatctgtgcacttttatgtcatttatactcatttacttccaaaatgagtgggagacattttataataaaatatccatgtattaatataatttggtatatccatacgaaagaatattattcagcaataaagagaaatcataaacgaatacactctaacacatggatacatctcaaaaacattatggtaagtgagagaagccagacacacaaaaccacatattgtaaaacaaatgtccagaaaaggcagaatagaaacaaagtagatgcacggttgcctgggctgagggtgagaatgggaaatgactatcaatagacatgagggatctcaccgatgtgatgaaaatattctaacactggatgatggcgatggctttattttatttttatttttttttgagacggagtttcgcccgtggcccaggctggagtgcaatggcacaatcttggctcaccgcaacccctgcctcccgggttcaagtgattctcctgcctcagcctcctgagtagctgggattacaggcatgcgccaccacgcccagctaattttgtatttttagtagagatggggtttctccatgttggtcaggctggtctcgaactcccgacctcatgtgatccatccaccttagcctcccagagtgctgggattacaggtgtgagccaccacgcttggctggtgatggctttaaaacttggtaaatttaccaaaaagcattgagctgtacacttaaaatagatgggtattatggtatgcaaattatacctcaatgaagtggctttaaaaaatctatatacaagagaactttttagatacccataagaaagataaggctcacataaggaattgggagaaaaaaattgtaccagacagcctggccaagggcactgattacagaagacagcaaagctcagctctgagctatctcatgaccagctttgtttgaaagccttcttcctattttaaaatgaaatttatgttcctgtctgttttacctattgacctaagccctacttgaacatcatgcagaacaactttttccacatgatagacctattcatatctgaaagcaattttatgtcctatctcagtcatctctaaacaaagtcactgcagttctgccaccagaatgtcctgctctctctcaggatctcattttccctttctaaaaaatgtcagtaacaccagttgcctccttctgttggagccatgggcagaagagaaatctggtatctgtgctctgagttcttaggctaggaaggagctttttttttaaatttatttttattttttagttttagtttttttctttttaatctcaagctccaccagaatgaaaggaaggggcttttaaatcccaggtggtattgacagatactgtggtttttctgtgtcctttcagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgtaaatagcctttttccatatgttgtgttgtccttggctgcaaagcctctgcccacccagcacatgctcagagtttgccccatggcgagtgttggttgtacaaggccattctgactccctggtccagagaatcaggcatttcctaaacatgcgctctgtacccagcataccccagaaaatgtttaaaagcctgagtcacattattcctaagaaatgtttacagtctaatgggaaaattagacttacacatattccattgagcatctgaaataattgtgtatgtatttgggaagggactgactgttggtcaggtcttagactttctaagagactcatctcaatcttcctggcgctttgttctaatacatgagctgatctcccaacacaggcacaggagagcgggctccttgtgttgtccttcacttggttcccaaggggcacaaggctgagtgcttgagagagtccaagtgttagacagtgcaggaactgagggtttggttggagggagacattgaggagggattgtgctagattttcatcagcctgggagagacagtgatgggggtcacatgtgacagtgccccagggtgattatttggtatttattagtgttgacttctgaaggtattttgaggcagttacaacaaaaggcatatagataataaaaccatttgtcttcttttcttttttttttttcttttttgagacagtttccgtctgtcacctaggctggagtgcagtagcgtgatctcggctcactgcaacctctgcctcctgggctcaagcaattctagtgcctcagcctcccaagtagcaggcatgcaccaccatgcccggccaatttttgtatttttaatagagacaggattttgccatgttggccaagctggtcttgaactcctggcctcaagtgatccgcccgcctcggcctcccaaaatgctgggattataggcgtgagccacacatgcctggccttcaaaccatttttcttctgttccctaaatatagctgagttaataatcatttaaactttggcttatccttttaaagaaactgggaaaaataactgtccccaaaacctgggctgtaaatagttactacatttgcctaggaagagtctttggctattagaacttttggcctgaactttggaacatgtagaaaataactagtaggacttcatatcaatttgcatagattttgcatatttctttgcagattgtttctctgaagataagtctgcctgtaattcagcaaacatttattgtatacccactatgtgtgagattctgtgctaggttctacgatcccaaaatagttaagatagtcttgctgtcaaagatatcatggtctagatgagaagacaaacgtggagataagtaccacataatgaatttccatataggttctttaaatacattacatgtttgtggcatgcacagaaacactggtagttttttttttcttctcctctaccctggatgtatataactgaaagagggatgtattcaactggggaaaatgaagcttgctgctggcagattaggatcccattgcaaaacaaaggcagaaacagctcattcttgcatccaactgcactttgtgaggctcctgatggggcacagctgtttccttggcccctgagtatgtgggaatgaagcatcatcggccccacagctgctgccccgatgcccccacccctaccctgtgggactcacaccacagagccaggggtaaggtattggatcccggcagctggtggaagtgggcatgattcacttcagcatcagaatctgtgccacccttccatcaacctctccttctgaccttttcctgtgcagcaggaatgcaatgcagctttgcaaaccctgcccatttccttccaaggaatcagctatgggtatattgtgggagataaacgacctttctctctctctttgtgttcctctggagtcatgagggagtaggtgagaggaagtgagaggtgtggtgagctggaagttgtccagttggcctggttacaagggcctctccccttgggaatgacctgggaaagtcagcgggtccagggaaccccgtgatggccacttactcccaggcacattggaacagccctcttagtctcgtccccggtcaccgtctctccttgcctcctgcaggggcatgtccttccacggcaccaccatcggcctggcccccctcatggccatgtgctctgtgtaccagtctggaggagtcaacatggtgagtctcagcccgtgtgtgtgcgctgcagaaggcgctgagctgcctttcaagaccagaggtcatcttttgaataataagttgatatttattattgtagcagaaaaagctttgacatcaggaagggcaattgtttaaaatgaagtcattaagttctaagagatggaggtactgaagggtgaattttcatttattatagttcattccgtatcttcaagctcaggaaccctgaagagattacatgcatacatcactagatctcatatgttccaaaccaggggctggaaaatagtaagagagtagaggttaaaagtatttttatttcaggtcgtgtgctgttatatatgtcattaagaaacaagaacctgtctcaaagtcatggttaggaaattactgccttcttttgaaattcactctgacttcatgagactatttgttttgactcttcatttctaacctgtgaagtgcatatcaaggaagacttgtcttcatctatttgtctgtccctctatccattctgtatttatcgacaaagtagcataatggccaaaaccacaggctctagggtctgagcctgttgggttcaaagaacagctgtgtgattttgggtgagttaatgagtgttctcagctgtaaaaaacgcatagttttacagttgataatcataggataggaatgggaattaaatgaaataatgcaggaaacacacttccatgtttagtaaatctctttctgctgcttctttcctgctgggtttttttcctcttgatttctttagcttttgcatcatcagacagtacaccaagtgctgtgcctggagtgtatctgtcttgtgtggttttctcaggaaacactaagccaagtacaccctatgtttgaatcaaggtcgtgttttctatgttgatttccttatgtctggagaaatatatatgttcagaagaagaatggggaaaaatcttcctcttttatttattctgaaagcatttattggtctggaagttcatccataggtcagttgtggtctgcaacctttgagaactcaggaaacatggacttttaaacatttgatttcctcctagtgacagcagattcagccttgctgtcagaggcacatatggagagtctgtatgctcagtgacagtggaattggtggagacctgcaagacttggctaaggataaggcagggatggggggcagaggcagatctgtccccttgaccttgacctcaactctgtcttctgagcaggaccactccgagaatgccattggcgtggctgccaccatggcccacgagatgggccacaactttggcatgacccatgattctgcagattgctgctcggccagtgcggctgatggtgggtgcatcatggcagctgccactgggtgagtcaaacagcaagagggaggatggggaggagggcgggcacacctggacagtgtgacccaggggttcctcccagctggccccactgagactcccttaaacttctgatggggccaaaaaatgtagtttttacaacaaagaaattgagagaagaccaaggcaaatgtgcagcaagaacttaactttccagcaggaggtttggtgctggtgtaaccctagatttatttaatttctgttttaaggtgttgagttataaaattggcttggccatatgtgtcttttttatttcatgaattttttatgaggacacattttgatcatagccacagcccttaattcttctatcccaagagagttggatcagtgctgtttcaattccaggcttcactgaaagctccgatgtaacagaacaagttgaagaagagggccatccacacaccccacagtgacttctcagggagtttgcaggccacattacccatgaggaacagggtgaggcagctgcatctccctgtggtcatgaggaaatttttttttttttttttttttgagacagagtcttgctctgtcgcccaggctggagtgcagtggtgtgatctccgctcactgcaagctctgcctcccaggttcacaccattcttctgccttagcctcccgagtagctgggaatacaggcgcctgccaccatgcccggctaattttttgtatttttagtagagacagggtttcaccatgttagccaggatggtctcgatctcctgacctcgtgatccacccgcctcggcctcccaaagtgctgggattacaggtgtgagccaccgcgctggacatgagggatttttaaaaccagagtctctgaagagaattagggagtttcttcaaaggacttgtcttctagcatctgaactcaggcagcacaaagcattgggttcttccaggctctttggaaggcatcacgttgggaccttgtgttccttcaccccacaccattagggcctgtttatgattcttagagaatggtgtttcaatgtctccaagaaacagtgcagctttcttagagctctggtgtcaattttttaaaattatttctcagctgtgacatggaaaggatgatgttggctgggtgcggtggctcacgactgtaattccagcactttgtgaggctgaggtgggcagttcacctgaggtcaggagttcgagaccagcctggccaacatggtgaaaccccgtctctgctaaaaatacaaaaattagctgggcgtggtggtgcacgcctgtggtcccagctactagggaggctgaggcgggaaaatcacttgaactcgagaggcaaaggttgcagtgagccaagattgtgccactgcactccagccttcagcctgggcaacggagcaagactccgtctcaaaaccacaacaacaaaaaaagaatgaggcaggatacagcttcacagtcatgcctggatccctataagctcatggttaagctcacccctttctctctcaatctaaaaagcgtatctgaagacaaatgattgagagttatattgattactactctctttcatttttaaattattcacaaatatggatagtttaacaattattagtaacaaattccttggagcataccttcccactgaaggaaaagctccagtttcttggagggtttaacctttaattggtttagagaattgggagcaggataactctccttttgtagacccagatggctgtactatttgtccttttcaccaatggtgggacccaggaccttccatactcctgtgataaagagcatgcgtttatgagttggctggttgagtttggaatgccctctgcatccttagaacagcaatgagatcactggcccaaaatgaaataaaacttatgatcttggcctttttttggcctggtcctctgtcacaagagaatattcacctgatatcagcttcaggaaaagtttaggttggctggtgttttcttcagtgctaagtctcaggagacctcttgtaacacactcacaaccctttacttatcgcagccccctcatgcaatgggcagaaattgctactcctgattctcaaatgctttctgcatgccgactaagaaaaatagaatgttatggggtggttaatatctcatcactaaggatgaaagaattcttttttttttttttatactttaagttctaggatacatgtgcacaacgtgcaggtttgttacatatgtatacatgtgccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtggagggtacacggcagagcccggtcatttttaacaaatgcatgtggtttctgcagaaagcagaactggattgtttcgtctctattttttgaaggctgaaaatatgtatgtttatacatgcataacaatttggggtagataacaagtaacagtaaattatgggggtgagactgaggttctgtataaatggaaaaaaaaatctgattttatggccttctctctctcactctgttgcccaggctggagtgcagtgacaagatctccactcactgcaacctccacctccagggttcaagcgattctcctgcctcagcctcctgagtagctgggaatacaggtgtgtgccaccacacctggttaatttttttttttttgtacttttagcagagacagagttttgctacattgaccaggctgttctcaaactcctgacctcagatgatccacccacctcggcctcccaaagcactaggattgcaggcgtgagccaccgcaccctgcctgtgacctctgtgatgtgatttttctttttttaatgccagtatgtcactttcagaataaaacaagaactagtcaaggatgccacccccaccaccatgagcccagagagatcaacacagacccatcagaaaggagggagtggtatgaacatggagggccactggggttgaggaatggcctgagagtgggcatggccagttggcttaggttctgagcagttgctcattcaacaggcacactgagtgtgggctactgtgtctggtcctagggttaggatgagtggcaaaaatgacatagttcctgtccttggggagctgatagtctagtgggagaaacacatattgaaataattgcaaaagaatatatgtacagtccatggcaagtgctaggaagacaaatgacacagtgctctgaacatatataatgtgagggggaacctccttgcttgtgtgggaggtgacctggagcccatatctgaaggctgcattaggagttagtgaggcacgcaggagggaaggcacatttcaggtggaaggggagcctgtgccttcgtgggaagaaatatggtacattaggaaggcaggaatacaggtcttcctggagcccaacatggtgggagaataatgggaggaaagtgttctattccttctcttaggggagacaggtggacaggtgtctgtggtcaggggatgggatgtggctctccaatatgctagagccctggacagttaggggtataaggttgataaacatgaggtaggcctcaggcagacctgacttgaattcagcaggtgtgtccctcggccagctactggacttgcctgagccacagcatccctgtctgtggaatggggtcaaggctgcctcataaggctgtggtggagagatctgtggagccccgtacacttttcatcaatggctgatggattggcctgttaatactgtaagagtgtgatgaggacgctcagggtcactggaacgcctcataatcttttaaaaatctcaggctgggggagagcaaggaacccatggagatcttctgttccagaaaggtccaggccaggaagggcttaggaagagaagcagatggagaaaaaaatctaaggaaacagacccaggagttgacataaactgtttggagaggttgttccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctggccaacatgacgaaacccaatcgctattaaaaatacaaaaattagccaggtgtggtggggtgtgcctgtggtctgagttacttcggaggctgaggcgggagaatcgcttgaaaccaggaagcagaggttgcagtgacccgagatattgcatcactgcactccagcctgggtgacagatcgagactccctctcaaaaaaaaaaaaaaaaaaaaagagatagttgctagagagctggggttccaggggtgtgtgggcaagggtggggaaaatgttgggggtggtgaaggccctcccccactcacacccaccccactgcctccccaggaatgtaacaacccctgctgcaatgcctctaattgtaccctgaggccgggggcggagtgtgctcacggctcctgctgccaccagtgtaaggtaagtggcccttttctccacgccttgggccctggcctgacagtgggaccacaggactgctctgctggggtggatggctggggatttgcctccatcctggggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatccagagagagtgggcttgattttattgagctcataaacaataataattatcatcatttgtattgacattaatggacctcttagtagatgccaggcactgtgctgggaattttatgtacgttatctcattctctcctcacaaaaaccccataaaatatatgtgactatccttattttaagatgtggaaactagagcttataggggataagaggtttatctggaatcaggcagtcaggaagggactgaatccagctttccctgactctggtgcccacattcctaatattgatgtgagagataaattgtctgttgctgctagtgttaccgtagaaccacaatctctcttccacaattctgaaattaagggagttctaaaagctgaaaaaaaatgtaaacacatttggtggcaaaacttgacctgaattgacatgagatgaattatagtctttttaaaaaaaaatcactcctaaagtgaatatttatattgcattacagaaatattaatatgtttgatcagaaggtgttatccccagccttgctggggggttatgtaatatacatatgtagttatatatgcggacatatgtaattatccatatccatatatatatatatatatatacatacacacatgtgtaattatatatgtacacacatgtacatatggacctatgtattacaatatctgctttctaaatctgaaaagcctgaaccccatctggccccatcattttaggcaggaactgtgggcctgggcttctgcctagcacttgctgagtgctcgttaggggccagataccattcacatacttagttctaactcacgtttaatcacccattagtgggttattatcctgagttgtgggtgagtgagcacacacaggttacacagcaggtgcccaaggccccgctgccggttaaggagctgggatgtgtgcccaggcaggctggctgtggggcaggtcctctttgcctccacctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagggaggctgtaagactcttcgccctttgccccaggtgtgctgttgatcaacttattgatctgcaaagtgggacaaatagcagtatctatcccatggaagctgtgaggatcccacgagatacgtgtatgtcacacactcagcccagtgcctggccccatagtggggatatattattgctgaggtgctttgtaaactcacagatgttatgtgaatgctagttttgtgtgtgtgtgtgtgtgtgtgtgtgtgtattagtgggcctggctcctctgccacttactatgagtctttggatgcatcgtctaacctctttaagcctacagattttatcatctgcagaagggataattatatcacacaggactgtcatgaaaactaagtgaagtcatatttgtactggacacttaagtgggagctgcataaaagtagctgctattactaaagcatgtaggaaactgtaaattgttgtataggtattatttcttgcctctttcttaagacttctatgaagagaaagtgagttagcatttgtgaaaacagcttgaaattctgtcagtattcacatgagaaggctgaaggtggtttgggctaatgaggtcatgtaaaaagtgctgtgaaatcatggtaatggaaaattctgttctatgagagtgatccttatgagcccttgggcaacagggttgagggtggggaggagattgactgtgttttcctctcattccttggctcagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggctgcagtgagccactccactctaggactccagcccaagcgacagagggatgtaccatctcaaaaaaaaaaaaaaaaaaaaaaaaaaagactgggcacagtggctcacgcctgtaatcccagtactttgggaggccaaggcaggtggatcacctgaggtcaggagttcaagaccagcctggccaacatggtgaaaccctgtaactgctaaaaatacaaaaattagccaggcgtggtggtggacgcctgtaattccagctactcgagaggctaagacaggagaatctcttgaaactgggaggcagaggttgcagtgagctgagattgtgccactgcattccagcctgggtgacagagcaagactctgtctcaaaaaaaataaaaaaagaatatgcttccattctttattagatagattatctctagaagatacacacagaattatacctaggagatacagaaattagagatttaagtatctttagaaaatatactgttaataagtgctattcctccaggatgtagagaagtaggaactggatgactacaagaaaaattttccaagacatacttatatctttaaaatattatgcatgtatgacctattttttaaaatcttgaatcggaacatggcttcttcattagagagcaggcttagcatgcaaccctccccacacacaaatataaatcctcaataaggtaggaagaatttacataaaacaggccaggtgtggtggctcacgcctgtaatcccagcactttgggaggccgaggcggggggatcatgaggtcaggacttcaagaccagcctggccaagatggtgaaaccccatttctacaaaaaaaataaataaataaatacaaaaattagccagtcatggtggtgggtgcttgtcatcccagctactcgggaggctgaggtagagaattgcttgaacccaagaggcggaggatgcaatgagccgtgattgtgccactgtattacagcttgggtgacagagcgagaatccatctgaaagaaaaaaaaaaggatttatataaaacattattctctgagtagatcttgttgagaatatggggatggagtaacctggagggaacaggaagaagaggctgagtattccctcccagaaaatattcttaccttcatgactttaccaaagatacctttgcccttgggggcttctgacagatgagtatactgatagatgttgcttgcccacccaggagcccgacctgcccctgacctctgcttcgagaaggtgaatgtggcaggagacacctttggaaactgtggaaaggacatgaatggtgaacacaggaagtgcaacatgaggtgatgaccaaagggcaggcctcatgaaatgaggatgaacaagcagtttctgctctgtcctcactgttgcccaactcagcagtgtgactggccccagagctgcacctttacgtcaatcagttgaagtcagtcatctattctcggccccctgtttgacaatgcacttttcagctctgaggaagtcagaggagggtgtgggtggcagtgcttcctagaaagctgatcgggcttcctttggggaccatcttacagtagggcagggaatcagcccttttgggtcatttctgccaaattctaatcatgccctaatttgaatagctcctcattcattaattcactcattcattcatttattcatcattcattccaaccaaccatccactcatctgtctacccatccatccatccatccatccatccatctatccatccatctaccacccactcacccactgatccatccatctatccatcctccaccacccactcacccactcatccatccatccatccatccatctgtccgtccatctatccatctactatctattgaagatttactgtctatctactatctattgaagatttaccatgtgcaagatattgtgctgagtgcatggaacttctaattaacaatatagtatgacaatggcaatgtggagagagccatccaacccatcttagtgtgtcagagtggtttcccaaaggaagttatacctacactgagatctggagcagttacctcggtgaacagggtggaaggtggtgctggtgcataggagaataatccaggaagagagatgaatagagaaaaactggtggttgaaagaactgagaacagtttgatacagttaaagtataatgttggggtgcaaaggagaaggtctgctgagaaattagcctggatagtttagcatggaccagatcatgaaaagcctcaaatgcatggctaggggagtttagattttagcttgagagcagtgtgaaaattagactcctatgaggcagactggaggcagggaaatcaatcttctgcagaccaggtaaggggggtggggcagtgtgaattaaggtagatagataataagatagataattaaggagggaagattgatagggtttgaaaatggcttgagcccaggagtgagggagaatggggagttggagatgaccccagatttctagctggaactcctgggtggacagcggtataaggggcaaaaagggaaagattgctcagctcaggtggctattcttggagttaaggacttttcgaggccagttctctggtctagatttgctcagggtcaaggagcctgttctcttcccttggtgtcagtccacatggaatctctcctggtgggttccaaagcacatgactgccctaaacctttgccccaccccacgcaagcctgctgtcttgatcaagaaagactgaagctctctggtgccccagctcttcctctgcctctgattccgcttccttccctctctgtctcttgtgcccagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatgtgagtcccctcccctgctcacctaggagccagctgcagagcagagtgattgagaagtgaggtctgagggaaggatgcctgggctcagatgccacctcgccaacctctgagccttggtggctcccttcatgaagcgtgtatagtgacagcaggcacccaccccagagaactgtcggaaggattaaagaaaatcatcccagtaaagcacttaggtggcctagctagtgccactttcatcctcatcgctaattatcataggaattaaaaatggactaggagttagggaagcctgagcaaaataatagcacagactctatcctccagagtcgattctgataatgaaactatggaaaacatgaagcatttagcatagcacctggcacagagtactgtcaccatcattatttttaaatataatgttaaaattgatacatattaatgacaagtaattaacataatcaacataatagtcctttaatgtgataacacataaataatattgtattgttaaatatgatactttaacaatatatttgtcgttttctccctaatcacaaaagtaatagcagaatttagttggctgttgtcctgtccttagcgttgtgggctgttttccatttttcactttgatagtaacctgaagtgtgctgcctatttgggccctcatactttttttcttttaagatggagtcttgctctgtcacccaggctggaatgcagtggtacaatctcggctcactgcaacctctgtctcccaggctcaagcaattctcctgcctcagcttcccgagtagctgggattacagacacaggccaccaggcccagctaatttttgtatttttcgtagagatggagtttcaccatgttggccaggctggtcttgaactcctgacctctggtgatccgcccacctcagcctcccaaagtgctgggattacaggcgtgagccaccaggccgggccatgggtcctcatatgttccaagtgcaaaatcttgcctcctaactcccaaccagcatccctcccattgcactgatcgttctgttttctctccgtgcagatttgctttgaggggcagtgcaggaacacctccttctttgaaactgaaggctgtgggaagaagtgcaatggccatggggtgcgtgctgggttctggcttctctgtgtcatggggacgtcatgagggcaggccctgtgggtggctgatgctctctggggtgctgatgcctctgccctttctttgctccaggtctgtaacaacaaccagaactgccactgcctgccgggctgggccccgcccttctgcaacacaccgggccacgggggcagtatcgacagtgggcctatgccccctgagagtgagtgccagcctgctggggccactgcccgcttttgtgagaagagcgggcatcaggggcaggtggcatgttgcagagcatccacattgaatcagcttcattgtcctgattttgtagagaggaaatcaggataaagacagaccaagagagaggagcgactgctcatagtgtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtctttttgtttctttgtttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcaggtatgacagggttcaatggaggactcagggtcaatttatgggtcacaaaggtctccataaatggtacttagcaaaagtgttggtgatagtgggtctaattcagggaagacaagtgcaagatacatgctgccctctcccctgctatgactgtgacaggcattactagttgatcttattgtaagtactctactgattctggtcatcactcctgagttcttctcagcagaatatccccaaccaaatcaagttgaaatataaaataaaatctatttgccatcctttgtctagttgatttattccccattttattttatttatttttgagatggagtttcactcttgttgcccaggctggaatgcagtggtgcaatcttggctcactgcagcctccgcctcctgagttcaagcgattctcctgcctcagcgtcctgagtagctggggctacaggtgcatgccaccatacccagctaattttttgtatttttagtagagacggggtttcaccatgttgaccaggctggtctcgaactcttgacctcaggtgatctgcccgctttggcctcccaaaatgctgggattacaagcatgagccaccatgcccagccccctctttgtctttttaaccactgttgctttaaagtttgtttcatctggtataagaatagctactcctgctcgcttttggtgtcccatttgaaaagtgatgtattattttggatatggaagatgtacagtctctgagtcacctattaaataacacttgttctggaggggattttaagtcccaggtctttctggatctatgcctgatggggattggttgatggctcgtgacacccttgtgtctcctcacaggggaagggtcttaaaagggtgaagagaaggtgctgagagagctctgctttgtataaggccaactctgtttccttgagagttctccattggccacacgtttttctacttaggaagatgtggttcgagaagaccaatcccactccctccagagcagacttgggaaagatttagctgcttgctggccgtgcttgggtcaaagggaactcaggcactgtcccctgctgaacatcgtcccctttcttttcctcccccatttcttgtttctagttgtcccttcagggtttctcagaacagcgggactggtcatgccaacccaactttcaagctgcagacgccccagggcaagcgaaaggtaagagctttgcaccactgaactttgctacttttcctttatccctcagggccatgctgtatttttctttttgagatggagtcttgccctgtcgcccaggctggagtacagtggcgccatctcagctcactgcaagctccgcctccagggttcacgccattctcctgcctcagcctcccaattagctgggactacaggtgcccaccaccatgcctggctaatttttgtatttttaatagagacggggtttcaccgtgttagccaggatggtctccatctcctgacctcgtgatccacccgcctcggcctcccaaaatgctgggattacaggcatgagccaccatgcccggccgccatgctgtgtttttctaagagcctctgtgggcccatgggattggtaataaaagcccttttattggctggagagacatgttatttggttctgacatcccctaatgactttaaaggttgcatctgacttctgggatcctcaggggtttaatagattggtgtgtctgttctccctttgggctctggtttatctcaaagagacacacaaggccagccctgagtgatttcttgtctcaggtgttccttgacttgtgcgtacaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctccccttccttttatgtggggcagaggtaggatggaaaaatccatgcagaaagagaggaaagattgacagggagagagaaggaaagaggaaaggaaaaaagcaagagaggggaggagtggagagagagaggtggagagtgtactcgtgtgctgagggtgctatagcagagtactgcacactgggtggcttcaaaacagacacttattttctcacagttctagaggctaagagtccaaggtcaaggtgctggaagggttgatttctgaagcctctctctgtggcttgcaggtggccgccctcttgctgtgttctcacgaggcctttcctatgcacttctgcctccctggtgtctgcctgtccaactctcctcttcttatgaggacaccagattggattaggtggcctcattctatcctaatcacctctttaaagaccttatctctaaatatggtcacattctgaggtactcagggttagggcttcagcatatgattttttttttttaaatgatgagtgcacagttcagtccctaacagagagatgaaagaaagggagaaagcaggcgtgtagagacttggggttacaggagaacaggggtgccagcagagggaggagggagtgggtcgggcgagcagtccactcagactgttgttctgaaaaacccacactagaggcatgttcagagaacacggggccagcctcacccctgtcacccctaggtgctgagccgtaggtcaggaagtgtcagggacagcggggacccagctgtctgttaagtggtggaggctgtgcataccctgcacctgcacccctgggactgctggcaggagtcccgggtgcaggaagctgcccagccagtggcaggcaccccaaaacacagcccccaagcacagcttctcctgggccccgggtcccaggtgggtgtctctctacaagcgaacagtgggaggcagctgctctgagtgggggctgctgtgatgacattgggctgccacctgcctcctcacagccattccaagaagggagttgctgcagccctcatttctcttggaggttgccaggcctcataggattgaagggacttgcccgacattgcacagttgtgagtggaggagctaggacttgaacccaggtctcatccagctgagtgagacagcctcctgccctggggccactcacagtctccagtctgccatcaaagattccccacctcctagctgggggacatggaccccctggagaagtgatagatgaaacctcatcacttcttcagttctgctattctaaaccggcttatgcacctgcactctgggccaggcaatgacgaggaaggcagatggcagctttgcctccaggagctcacattctgctggggcagtgactctgggatatgtgtcactgcaacagtgatatgtgctgtgaaggagaggctcagggtgctcagaagagagtaacgaggatttgacctaatctgggaaatccaggaaggtttccctgaggtggtgacatttgagctgagacatgaaggaggaacaggacttaaccaggctgtgagggcaagtgatgaaggagctttcctggtcccaggacccactagtagggaggctctgtcatgggagagggccctgtggattgaaggaacttaaaggtttgtgtgcttgggtcccaaggagctatgagatgaggctggaaagccaggaggagcccgtctatgcccaggccacatagccttggtcaggactttggtctgtattccataggaagaggacagtggtgacatgatgcaattttctgttgacaaggattgatcactctttgggatatctttaggcaggagagaggtgtagttcctgcaaggggcccatagatgcttctgaagctgttaatctactgtttgacctgcatggggattacttagtgtattcacgttgtgataattcatctagttgtatatttatgatttgttcgcctttttctgtgtgtattatatttgaatttttaaaatagttttaaaaaatgaaagtcactctagaagcaaatgggtgtcctagttagaagatttaaaggttgtcctgaagaaagatggtaaaagcttggagcagggagtaggcagggctgatgaagtgaagctgatgagaaatgtgcagaagagaaaatagataacgagttgaagatccattgcttggcaggggatgacgccccgtgtcaggcttgtgcaatctgattgagtaagatgccatcccttgtggaagggagcatgggccagagtagctgagggactgtttctgctctagaaaaaggaaaacagtgctgggcgagggccctggtagggctgagttggatcatcgcagatgtggcctgtggctggttgccctgggaggcccagtgctgacatgctgatgaggctcctgcccaaactccagcccctcagtggctcatttgcacagctcccttgggagcacagcctttcccagttgcaacctgacatctgcacccagctgtcacctgccccagaaggtctctatcctggcttccagcaaccattgcaacttggcagctattctgagctggggaaggtggtggtgaagggggcgggttgtattgtccttctagatagagctgaagaacatggctttttggccttaagaatttgctttagtttctgattccatgaagcttcttggggaaaatctcggctctttgtgttattcctgccctctctatgtgcttgccttttgtccactttaatacgtggtagtgaccctctcgagaagggaaggaagtcaaggggagcaggcactggaactcccttctatgcagttggcttccccttaaaccccaacagcttgggggcctgcgggtgggacagtcattctttgccccttaaaaaacaatggatcaactaatacgtgttgagcacctactgtatactaggcactgttctggaagccaaagatgtatcagtgaaccaaacagatacggaccccacactgcttccactctagaggggaatggagagacacaaagtaaaaatcaactggataagtaaataaattatatatgttgtaaggcagtaagtgatatgaaaagaaaagaagaggtatattaggataaaaaggtcagggaatgtcagggtgggggctgttgtaattttaaataaggtagtcagggcaaagccttgtggagatggtgagaacatgaaggtaatagtaacacaggaaggacagaatccatgaaatgtgccacacacatggacaaccaacatgaacaaaatatagctgctgctttgtttaaattttgttttaatcttaacaggcaatacacgtacatgctcttgttaaaaaaaaaaaaaaaggaatgttcaagggctgggcgtggtggctcacacgtgtaatcccagcactttgggaggccaaggcaggcagatcacctgaggtcagagttcgagattggcctgaccaacatggcgaaaccccgtctctactaaaaatacaaaaattagctgggcatggtggtgggtgcctgtaatcccaactactcaggaggctgaggcaagagaatcgtttgaactccggaggcagaggttgcagtaagccgagatcatgccattacactccagcctgggggacagagcaagactccatctcaaaaaaaaaaaaaaatggaatgttcacctggaacacacccctccccttttgcaccccatcccagtgtaatctctttggtctgtatccttccttttttctgttacagacatttctattaggcggtgagcgtgctgacttattttatgtcaactatcctctacagcttgtttgttccacctaacaactcttgaacatctccccacgccagcccctatcaacctacttcattctttttaagtgctatatcatctgtcactttataattttagttatttttctgctgatgaaattttgcttatttatagtttctttgctgttacaaacagtgctgcaaggaacaaccttgcagtttcatttttgtgcacgtgtgcaaatagttctctaacataggtcagaagaagtagaattactagatcagagaacagttatttgtaattttttttattatactttaagttctggggtacatgtgcagaatgtgcagatttgttacataggtatacacatgccatggtggtttactgcacccatcaacccgtcatctacattaggcatttctcctaatgctatccctcccctagccccccaccacccaacaggccccagtatgtaatgttcccctccctgtgtccatgtgttctcatttcatgttcatctcccacttatgagtgagaacatgtggtgtttggttttctgttcttgtgttattttgctgagaatgatagtttccagcatcatccatgtccctgcaaaggacatgaactcatccttttttatggctgcatagtattccatggtgtatatgtgccacattttcttgattcagtctatcattgatgggcatttgggttggttccaagtctttgctgttgtgaatagtgccacaataaacatacgtgtacatgtgtctttatagtagaatgatttataatcctttgggtatatatccagtagtgggattgctgggtcaaatggtatttctagttctagatcctccctatttaataatggtgctgggaaaactgtctagccatatgcagaaagctgaaactggatcccttccttacaccttatacaaaaattaactcaagatggattaaagacttaaactaagacctaaaaccataaaaaccctagaagaaaacctaggcaataccattcaggacataggcatgggcaaagacttcatgactaaaacaccaaaagcaatggcaacaaaagccaaaattgacaaatgggatctgattgaactaaagagcttctgcacagcaaaagaaactatcatcagagtgaacaggcaacctacagaatgggagaagatttttgcaatctatccatctgacagagggctaatatccccaatctacaaagaacttaaacagatttacaagaaaaaatcaaacaaccctatcaaaaagtgggtgaaagatatgaacagacacttctcaaaagaagacatttatgcagccaacaaacatatgaaaaaaagatcatcttcactggttatttgtaattttaatagatactgccagcttgctctcctgacttcctcttgagaatataaacacattatacatacagtttctttctaaatgggaccatacagtatataacttttatctatctgattttaacctgtaagatatcagggatattttctttcaaacaggcctctggccttcaagtgaggcttattgctttctctccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaagagggaggggtggctggtcagcttgagataggggcacctaccacaccccttcctgcagggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagccttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttatctggtttggcagctctttattgtgtgtttgttgtaatgtcctactgctcagattagataggattcatgacgtggacttcagaaagagttcccacaaggatggtcagttcagcctataaagccttcatggtggaccctgagccacagcaaagcctatgttttcctatgaccagtagagggggctgtttgtctttacacctggacgcaggctgcttattaaaggcctgaatgatcctgagattcttcgatatgttttttctcatcctacactactgcatatagaagacagctgagagcctctgctcacctcctcatcttattaaggcaagggatcatactttaaagaggggagacacttgccccaggtctcttgggctgggtaggcaggcacagccagggataaggttgggtgtgctttctgattccagaaccctgcgtgatatcacagctcgtattcattagtgcttcccagtccataaaaggatcccacccttattctctcattgatccctacctcaattttgaggttctctcagagagatggaggattaataaccatgatcgaaggtaacagttactcagtacagtcggccccccatatccgtgggtttcaaattcatggattcaaccaacagcaggttgaaatatttgaaaaaaaaaaagtacaaccataaaaagtaatacaatttaaaaatacggtataacaacgatttacacagcatttacattgtattaggtattatagaaatctggagatgatttaaagtatatgggaggatatatgtaggttatatgcaaatactataccattttatataagggacttggccatccttagattttgttatccatgggggtcctggaaccaatcccctgcagataccaaggaacagctgtatttaacatacgtgagccactcactgcatgctgtttacaaataaggattatctcgtttaatcttcacaaaaaccctgagagaggcttcttgctctctgattttacttttttttttttttttttaagacggagtctctctctgtcacccaggctggggtgcagtggtgcaatctcagctcactgcaacctccgcctcccgggctcaagcaattctcatgcctcagcctcctgagtagctgggattacaggtgcccaccaccacgcctaatttttgtatttttagtagagatgacctcaagtgatccattcgcctcagcctcctgaagtgttgggattacaggcgtgagccaccgcacccagcctgattatatttttctaacctctcatggttatgaggttgcctatggaccctaaagacatctaaacacaaatgctttcactactaacatgcctgctcatgaaattgcttcccactcacacatccctacctggttaagaggccactcttcccctgctgtcagccagtctctggggtgatgctcacgtgttggtcactagcataatggagaaagcctggttgggcagaccctggttgaagtcctcactctgcttgctactcaatagataagtgggcctggataagttccagatttctgagtctcttcactatacaaataatatacctgcctcaaaagtgtcgtgatcatcaatgaaattctgtatgtgcaagtccccaacagggcctgtcgcaggctatgtgctgagaaactgctgactacatcagtttacagttgctttgcttaacatgcagagttctattaggatctgccttgcattgagtgctggtccccaggagagtttgggcaaggaaggactgtgatattgttccttcaatcttttctttttcttttattcttttagtgcgtatgatgtgctaggcactgaggataagcagtaaatcaaagccaactctcatgaagcttatatccagatggggaaagagcacagatcacaagaaaataaatgaataaagtagtagcagattatgcacaaggcacagtggctcaggcctaaaatctcagcattttgggaggccaaggtgggaagatcactttaggaaaggagttttgagaccagcctgggtaacatagcaaggcctcatttttaccaaatctgagcctgggagtttgaagctgtagtgagctaggatcacaccactgccctccagcctgggggacagagccagaccctgtctcaaaacacaaaaaaccaaaacagattatgcaactgggggcaaggttagtcttggagagacacattacgcctggtggttaaaccagatatcagctttgctcttcctggctgggtgaccttgggcaattatataaatgggaataaaaacgtatctaacttgaggatttgtgaggagttaaagagaattcacaggaagcacctactatgcctggtgcctggtaagggctcaggtgttaactagggatgagttgtcttcaactgactctatttctgaaactatctttcccactctaccaagggtgttaactaccacagacacggtaggggctttattggcagtcgcattcattcagagattggagactgtccttccagccctagaaaaaccagtttaatcactccatgctcaaggaaggtcaagacacaagtatcaagtaaatataatctgtaatctttattcttgaccctgcagaccacactcttagggccctcagtttactgccattctcaagagccaacttgttgcattgcttttaattacagacagaaatccacattcatcaaaaactggggatttgaggctgaagagtcagggagccagtctgctggtcagccaaaccttggagttccaaggccagcaggaatttacctgggcttggcccacttagggcacaggatataaacacagagtgcaggtagagtcacacaggggaggccctgcaccaacctcggggctgaggatcaagtcttccctctttccagatacaccagcccactaatttccctttctaatggttcttctccaacccccacactcttgtggctagaaaggagatgggaagggaaggaatagtaattatctccctctccagctgctctggttttttgtatgcctctggccaaatgtgaggggaccaaaggtactccccatagcaggtggtgttggaacagtcagggcatgctgcttcccagtgtgggcagctcatcagtggaggaggggactcggtagcaatctggtcaacagctagaatgcaccccatgccaagtctgcacctccagttggccattgagattcacagctgtccaagcctttaaggctgcaacccagaaattacccctgagctcgtttctcctaagttcccagatgagcaccagagtcaacacaaaagttagcccctagtatccagagagcctgggactgccttctgccaaatcccaactttgctcctcatcctcttcccacctccccagatcataggttggttgactccttgaggaatagtaaagtgcgttctgccaaattctagcttggcagccaggccactttgaagcagtgaatttgctgttcttctttcagagtaagacaaaatgcaacactgggtttggccaccagagtttggctgtggctctattattgttttgtttccagttctgcgattactgcctttatgtctcagtgaccgactccttaggatgtaagtagagggggaaggggtgatggtgggatggactgggtggatgccgaggtgctgactgccaggctggagtgctcggggaatgagctggttgaaatttttccctgagacatcaagtggctttcacagtaagaaggtcagctgaggtcttgcttctgcctccaaagaggaagtgacaaaggcaacaggatattttacactggttgtgtccctgtcagctctggatagggaggcatggccaattgctctgtgggcctctgggagccagctctatgtcatccttgggctagaaaacaacaacaacaacaacaacggagattccgtctcaggaggagaattggtgtgaaggaacttccaatgaccaatatcttagagaagtccttggactgtgctacattcagtgggtcagactccatcttcttcccaacggcatagagatggcaccgaaagaatgaatgagaaggaaggtccagggaacctgcaggcactgatgtaaacttgggtatttggtcactgaatctgtttccaggaagttctgccaccattgctatttgggtaaagatttttctcctggaaacagtgatgaggtataaatgaacttctcaagaaaagagagcccattggtaacagttgcactggaaaataaccaggtggttttgaaattgggagggcaggctgtaccatcggactcatcctctcactcacatattccaagcttcaggaatggattataaatactttgggtttctcttctggtgatgaggtgctggcaagttctatattgtccacaaggacgttcttgtcttccagtctaatgacagtgggttccggggcgggagaagggggtgggtttttgtgcatgtggggcaagctggcgcagctgatgtccaggtctttgaaagcatgcagcatgaacacgcccaagatgatggtgacaaagcccgagagggtgcctgcaatgtccacagcagacatgctgtaccactccttgaagaggatgatggacgaggtaacgaccaccgtggtgaagaacacgtagtagatggggaacaccagggaagtgttgaaaatgtccagtgctctgttgaggaagttgacctgagtgctgagggacagtgccaggatgagggacaggatgtaggggagcgggtgccggacaactggcagcccctggaagaagttcttgatggtgatgcccagccccttgacagcagccacagagaaggccccgatcacagagcagatgatgatgtagatgaggatattcctttgcccgtaacgtggggcaatgacaaagatgaggatgaggcatgacaccagcagaagcacagcaaacacgatgaaccctttgggaggagagagagaaggatcacttggctgtggagggtgcaggcaatgtctagggcccagactcatggcagtgggaggtagcattaagatcgtgggctctagagtcagacaaacccgggttccagtcccagcttcatgacttcctaataacttggttaggtttttaaacccccaaaaactcagtttccccatttgtaaaagaggaccaacaataggatcatcctcataaagctgttctgtgggattcagtgagataatgtatataaagcattcataacagtgcctggcacataataaacacttattaatggtacccatacatatcaggccaggaagcctttaagctagccttgctaacaagtaccagcccattaacatttcttctttagcttgccttctcctctaggtggcagcacctgaggtggtcagaacccaatctgaccttttgtggggtagtagggggtgttcaacctccagtattttcctgctcttcaggggcttggagtctacctgtgtctttcatcttggaagccatctccatgatggtagtgaccttctcttcctcaggagcatgtatcaccatcactgtgcttccggccacacagatcacacagcccagcttccccagcaggttcagactctccctcaggaaatatgaggagaggatggcactgcacgtggaaatgggagaaggggattagagcagccatgcctgtcccagagtcccaaagaaaatggggcctgagcaagcactcacagagaacaacagatcagaactcactagtttctcacgtggaaggttttcttccaaaaaaacttacgttaccatgggcaaatcatgtgacctccctaagcctcattgtccccatctgcaaaatggggatgctaataatatccacgggagacattgttctcaggaactaaatgagataatgcacagaaaatgcacagtacagagctggtactgaagaataaacacagctgtcacatatggagggcttagtatgtgctgaacattctgaatgtatcccgcatattaactcatttaatcctcacagcatccctagctgaggccaagagaggttaagcaacttggccagggtcaccaggttctaagaggccaggctggaattctaacccaggcagtctaattccagagtcagggggcttaactgctatgccacattgccactgaaataaaccctcatcaaatgtctgatagttttaaaaacagttcatacgaaatatctgtgcttcccactgcccccagtcctcctgagctggggccaaaaaatgtttgatatagaaactcatttctgggagtgttacaatatttgctggaggaatagaaatgcaggtgaatttcttccattttagagactgaaagtattcccaaacagaagagttggaagaacacttcaaaatgctcttgtctaactgccttcccaatggacacatcctctcttagcactgccaacagatggctctcagctttggcttatagatacctctggtggcagggagcccaccccttcacaagccaaatgaggccattgtaggtttgctctaatcatttaccaaaaatatgccttctggtaatttctattttttgctctatctctgctcctcgggtcattcataacacacctattatttcatttgtataagccagtgtaaacaacctcagtgacaatcacaggtaccatgtcttaggcatttattacctactatgtatggtgctaggaacttcccgtctatcacactagcatctcataactctttgcaaagtgaaatatactatctccagttgataaatgagaagactgaatctcaaagaagttaaaatgacttggcaaggtcaaatgactagcaagtagtggaaccaggaattgagctcgagtcctttctaattataaagctcatgggttttcttctatgcctcgttgaagaggatccttgtgacttccctgagtcttcaatttctgggcaaattatctccagttccttgctgcaccgtggtgacatgatttctattcccctcatatcctcgagccgagccagcagaagcaagagaggaagggaaaaaaaatcacaggcaagcctcgtataatcacgggggcatgcttctgtctcttcatgaaggtggcttagtttagggtaaaaacctattggctatctcaggacattggctatttttagccttaaaaatcctggttcaagttgtcaggagagaggagattgatatctaagctctcttgtctgtcttccgtctttcctctgaaactaccaaaaatattttggccgcaatgtcccattcaagagattattcatgcaggcaggggccacacactggaggattttatggctctcccaacttcccccgggtaggaatttgcaaactaatcagatatgcaattatggtaccacagctacatcagctgtgttaggccagttatacagcatgaatcaggcgagttgtacagcatgagttctatttgttttttgagtgtgtaaatgttgcaaaattttcatcaagatggtaaaacaaatgatgggtactgggtgtggtctgctacaatttaccggcgttccaaggttacgccaacaatcagagtctccttcaaatagggctccaggacccccacagaggagctggctctgtgtttgtagctcagggggactaggggcagtgggaagcacagacatttagtatcaattatttttaaaactatcaaacatttgttgagtgtttacttgagaggcaatgtggcatagcaattaagcccactgactctggaattaagactgcctgggttagaatcctggcctggcctcttagaagctggtaactttggccaagttgcttaacctctgttgggctcagctagggatgctgtgaaaattaaatgagttaatatgcatgatacattcagaatgttcagcacatactaagcccctactatgtgatagctgtggttattgtttggtcccagctctgtactgtgcattttctgtgcattatctcattaaatcctcagaacaatgccccccagtgggtattattggcatccccattttgcagatgggaaaaatgaggcttcgagtgactaagtggcttaaatgacttgcctatggtaacgtgactactaagtggcagagcgaggattagaactcaggcagcgttaatccggagcacatgctcttaacttgtatgctgcatctatcacggcaccaaaatagtgacatgcgccgttcaccctggtgacggtggaagcccttccaactgctttgggcttggcctgcctctctattacccagtcaaggggatgctagggcaagaggcagcaaacattcccagggtctatagctctggacagcacactgcctctttctggaggctgagaccaacccaggtccctgattgccaagtggcagtcgatcccacttggcaattccaggcctcaacaaactgaaaacggaatagaaaaagagagagctagagaggggacaataaccttatgaggacactcagcgctcccagaggcgtgacgactgttgcaggtgcaaatgcgtaggctccaaagttggcaacttctccagcagccactaggaaacgaagggagaaaagaggctagcatggcgcagaagcaccatctccattccagacgaataattccgtgtgcaacaagctggagaatcccagaccagcattccttaaaatcttgatccatacgctctctccctggagagtctgatcgaaggtcagtcccagtctgtccagatcagatccttccactttaaagatggtgaagctaaggccccaagcccaaggtcacgtgacatgcttatggtgtagaagccctcttgttctttaggcctcttggcttctagtctgacaggcacagttaaatttgtctcagggactgccagtattttggactagatttttaatttaaattctaggaagtgttaattatcaaaggaagaaacagttacaattattggttctccaggtaccaattggtccatggaccccacttttcccctcttttccaggggaattttcaacagtctggactaagaggcaggtggttagaaaaatctgacatttctggctgggcgcgttgcctcacacctgtaatcccagcactttgggaggccgaggcaggtgtatcacctgaggtcgggagttcgagaccagcctgaccaacacggagaaaccccgtctctactaaaaatacaaaaaaaaaaaaaaaattagccaggcgtggtggtgcatgcctgtaatcccagctactcgggaggccgaggtaggagaatcacttgaacccgggaagcagaggttgctgtgagctgagattgcaccattgcactccagcctgggcaacaagagtgaaactccgtctcaataaataaattaattaattaattagcaggaaaagaaaaatctgacattcccaaggggcctaagttctttctctctatctgagtttccagtttgtaaactcctgagttaatacacaggataacacttagaaagtttagcagacagtaaaccctcaatatgtgatagctgtgtgtggttatcagaaaagtgtctttttccatctctctgctgatagagaaccacctgggtctcccctttaaaagcagatggtcactgggatagctctggctgagacgaggatcaaaacttgacataggggattatgaatggaaacctggttaattttccacctaaaagagtcagggtttgatagcaggagagggtgggtggaaagtgggggaaatgtgtgagtatgcaaatttgggcaaactttaagtaacggaccagctatgttctaagtgggccaacacattaactgcctgcggactgggggaagttggcctaggagttccagcttctaccatgtagaagtcaagagtccactaccaacaggcagtgatattatcgagctatgtttaaaggcaagttgagaaaatacaccttcatggttgccagctctgtgcaaacctctctggga

SEQ ID NO: 87 - DNA, 3331 bp, Homo sapiens
gccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaa

SEQ ID NO: 88 - protein, 949 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGDLRPPGAGPQQSRPLAAPKVSPREALKVKAGTRGLQGGRCRVEKTKQFMLLVVWTELPEQKPRAKHSCFLVPA

SEQ ID NO: 89 - DNA, 2858 bp, Homo sapiens
tggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagtaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggagatgaggaaactgagaggagaaggggaaaagtaacttgcccaagttcagttaaccagatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagagggtatggaagacttgcaatttgaaaactggggaccagttccaaagtcag

SEQ ID NO: 90 - protein, 712 aa, Homo sapiens
MKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGDLRPPGAGPQQSRPLAAPKRVWKTCNLKTGDQFQSQ

SEQ ID NO: 91 - DNA, 3316 bp, Homo sapiens
tggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagtaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaa

SEQ ID NO: 92 - protein, 880 aa, Homo sapiens
MAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGDLRPPGAGPQQSRPLAAPKVSPREALKVKAGTRGLQGGRCRVEKTKQFMLLVVWTELPEQKPRAKHSCFLVPA

SEQ ID NO: 93 - DNA, 6465 bp, Homo sapiens
gccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagccttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 94 - protein, 912 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGDLRPPGAGPQQSRPLAAPKFPEYRSQRAGGMISSKI

SEQ ID NO: 95 - DNA, 192992 bp, Mus musculus
  misc_feature (1)...(192992): n = A,T,C or G
tctagaggaagcctgtccttaggaaggtgaagtgctctgctgaggatcacaggatgttaatgcaggtgcacaattttgggtctgctgaccacccaaggagttccctgtgagaccccataagccaggtgctcagcctcaggcgtggcagtgacctcctaggctgagcttagtccatcagctgtgtgtagtctctggcatcattctagggctggcatggtggccttgctgatgtcagcttctgtagtgagaggaaggggctccctcctgcccctccaccaatcctagtttcctttgacaccttattatggttgaaatgtccatgtgcttacccaatctgtttggagtcagtgatccgtgtctgttctcctcctgcactgcctgctggagtcaagtctctagattttctccatgtgatgtagaaaccggtaatgcctcattttactgacgtttggggaaagtaaagtggttccatctaattgaattttgtggttaacagaagcttaaacctttaagcgtagaaactttctaatgtcaccatttttcaataaaaggaactaatttccccatcaaaatcatgatttcttcccccctatcctcacccccctcccgacacacacacctaacttagcagtgtggaaggagcaggtgttctctgggtggggttggatgtgtaacccataagccattccatgacttagagtcacctcttgggaatatcagtgttgaagtagtttgctcagtctcctagcctgagtttccttctctgtaatctcggggttgggaggggccactagaagaagcactaaggccggccactgactttacacagtaacacccttgggaattctggcctgcatccccaggttggtctgcaatatattcttctgtgtgctcagtgtatcaacccagcagttactagtcatgaaggaccctcctctgggagttctctgaccccctggaagaatggagggtttctgaccccagattataaacaccttgagtgaggaactctcgaggccgctgttaaccagagttctttctactgccaaagtcaccattcactcacttggggcagggctctgaatcaggaaggatgcatccacctggactctagccaatgggttcacaatacctaactataaagagcaacgcctcagaaactcagaactcagcattgagaggaggttaggaacagcaaggggaggccattgcctatagcaagaggacccaaagaactggaggaatgtgtgaagaccagagtgttaccggttccttttggtttcttgtatttaccacaaaccttgcaatttttttttaattgtggtgggggacacttaagttacattggtctaaatttcaagtggatgggaataggggatggggtgtctcttccaaaggcaattggcaaatgtgagtagtgatgtggcatacatgtgtgcatacgtagaaggagcctactggcatttagaggccaggggccagagacactaaatgttctatagagggcaagaccacaggaaaggattatggcaacaggcacctgggtggactcgactctgttcttaaagaaacagtttgtactgaatcttgaaggaatacctttcccatcttaactattaaccttccattctttttcaaattacttgtgcccagatacacctgtttgtgtcctgtgtccgtcccccacaggatgtttgtcttggcatctgagatggcatcactccagggtcatctctaagccagcaaatctgagccagggcaccttctccttctgctgtaaatgttaatgagtggaatcccagccctgagttcacaggggggtggggtgggggcacaagtttctctaccctggacctatcctttcatttgcaccctttgtttccttcctctgggaggctctcccatccatgacaaagcctcccccactgtgacccagtttctttattctagaaggacttagggtgggatctcgtcaaaagtgtttttgcaaatgaaaataaatgacaactgctgggttctcttatccacatgcattttctctccttcaaagagccctggtagatgaaaggattgggtggatttaggatttgtactgatttctgtgctcaactcaactcaggaatcctcaaccaagaagcctgcacaaggtggggtttgacctagagatgctgacaaaggatccccagtaaaggaagactccctagaacacaggggcatcacacaggcaggcctgtaacttcctctccagaaccctccagggacctgcaagtcccttgagcaggacccatgtagccagactggtgagccagactccagaaagctcaacatgaaaggacaccccccccaattcttccaggctgagtgatctggcaagtagatctgagggttgcaattattaaaaacaagacaggctggggcttgggtgtagcactatcctagcatgtgtgagtccttacattagatccccaacacacacacacacacacacacacaccccaaacagaagcccatcatatatgaaacatcctcacttttcttttttttttttttttttttaaagatttatttattgattattgtaagtacactgtagctgtcttcagacactccagaagagggagtcagatctcattacggatggttgtgagccaccatgtggttgctgggatttgaactctggaccttcggaagagcagtcgggtgctcttacccactgagccatctcgccagcccacatcctcacttttcaaatccctataacaggcctataaaaatcagatgtagttccttccgtttcaaaatgattaaagtgattcccctatgggtagagcaacttgtttaaagtttcaccaaatgcaagttggagaacaggaatcaagtactagcctaaaccaacttttttgcatttttcaaggaaacatcagtttagagaggccagatgcccccacattgcctctggttacaatttctggaccatgttggggtcccagaaatctggtcccccaagtctgtcttctaacctgcagcagagaggtgctcaaattccagtggattcatgccaaagctcacacttccggcagacctcaagttcctctctccttccccaggattgaggcctcaatattgacaacttgtccataggtgctaacagctccacactcgtattaggctctattttttcccctttttgagacagggtttccctatgtagtcctggctgtcctggaactcactctgtagaccaggctggcctcgaactcacaggggttctcctgcctctgcctcccaagtgctgggattaaaggcgtgcaccatcactgtccaactcagaccttttaaaaaattaagatttatttagttaattttgtgtgtatgagggttttgcctgcaagcatgtcagtgtcccatgtgtgtgccttgtgcccatggagatcagaagagggagttagatctcttggagctggggttacagatggctgtgagctaccatgtgggtgctggggattgaacctgggttctctggaagagcaacagttgattttaaccacaacggctctccagcaccaacaaaacgattttagttccaatatctgttcctgtccttacccacggtgggttaattatcgccctgtaaaatagaaataatgaaatcctaactcatatctcatgagaggactgtgtgcccaagaggcacaccatatgcttggtttcaaaagtaaaagccatactgggagtaatggttcatattggtcatcacagtacttggaaggctgaggcaggaggatctcaagttaaaggccagattgggctaaaccaaaccaagtaggatctgtgtgctgggtcggatagctcagtggtaaagtactgacttagcatgtataagatcctgggctctatcccaaacactgaaataaaagctaacataaagtgataaatgcataagacagagctcttgggtatttaggagatggaggccatgccactccttcctctgaggtctgctctgcctccttgctctcttcctcccagaccctaagccttgactctctgtgccccatctcttggctatatcctcctttgaatttccatcctgttcacggaatgtccttccctgtcgtatgctgccacacagcccaccttcgtggggaccccactcctcctgcatccagttttgggtagaggcctcctcagtaacttcccaccatgtttctttgtcttcctgaatcctctccttagctctgtccagaagtctcagagagagcggaatgcaccttagcagcccgaataaagtggaggtaactgagcaaccactttaaatgtcattgatttcaatttctttctttctttttttaaagtatagaatagagtttatttagggcatgcggaggggagttaagagggtagtagaggcagggaaaggcagagaggaggagagagtagataagtggaggtcggccatggccacgtgaagagggggggaagggaaggggagcaagagggcaagatgtaagagagtgtcagagggtaagagcaatgtgaacttcttgatgctgcagttgaaatagctacatatatagttcttggccaaatgatcgtgcagcagagctgtcctttaaggtttacaggggctgcagaggtcctgtgtccatgtgtgcgtcccaggactgtgggggctgttatctactgcctttcttccaaaggctcttcaagctcactgggctctttctttattcttcccagcaagccattgtctttatcttagggaacaaggacataatgcagtctggtgccctcaaacctccggtgtgacggccctgcccccactcccacctgatcctgtcacttcctatttcactgagacctgggaagctttcgggccacctgactgatcacattgccacctctcgggcgggcgggcccctttcaatcacatgcggcatgttccgaatagccttatcttataaacaatgggaagcccaggcctgccatcctcccttatcaccttcctgctagccccccccccactttcctaccgcttgtcaacgcggctttctggaagctgtccacacttgctatctctcctttctcacctcactttcactccacaacctaaggcggactggcttgtgtccacaccactccacagcaatgccctgtcaaggtcaccagtggccttttcccttcagaacttatcttgaccttcaaggcaaggggaggtgatcactgaaccccattcctttacaacactcttgctcatcagttgcttggacacctgagtccccggattcttctgaggccatccccaagtttccacactgctcccttcttcctttcctagcttgtttcatccttgagctttgcaggtagggaaggctgtaagcccgggatggtggctcctccctcctaacgcattccttgccgaaacacctgggaatttgctttctcacccaagagctcctctgttgttttgaactcatttgtaccctggatcccgctgctcagagcccgacatgccttcctggggtgtatttataacccccacttggagaaggaacacttggacatctgttttgttcatttgtctccacaaaaggcagcatgcttcggaaagggacactgacaactgaagagtgtactgggagagactgttgactggtcagaaatccaagttccatgaagtcactgaaagaaagaaagaaagaaagaaagaaagaaagaaagaaagaaagaaagaaagaaagaaagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaagaaagaagttctagtatattccagaagatctagatcccttagattgcagctcgaggactgtcttgcctagcaggaagaactaaagaagatcaagttaggctttaaatgatgataaaagtaaaaagtgctgtctccccatttcttgctgagcccactggtctagcactgcagaaaacccacaagccatggagggtaatttcaaacttgctgtctcacaagatctatcaaaagctctctggagaaacagcaaggctaaaactctgtactcccactttttggctgctccaagatgtaccgagatcagagggagctgagcaccccaatctatcccttttcgacccctcctggagagactgttttcctgacttgttttggtgcgatgccatccgcctatttgcagggccgatcccagcgtctgcccctaggagctctcggctgtgatcattagggggatgtttgctcattacctcacactgtgttccctttatgaggcccccccaggagaaattcctgtctgattttagtaccaagaagagttgtaattctcttgagccatggctctgtttttatctcacggacactgggactagtgtaagggacatggtctccttttcattttggctgcgggaaagcttaggaacaaattggtcgcccacccacaggaggaaaataggccatccccgggtgaattttggcattattcccgcgtctactttgtcttccctttgcctttttctctcttagatttccttcctattgtgttatagaaaattgagaacataacagcaaagataagtcaacatcacgagtcatttccctctcaagacaaacccactactgacactgtcttctaatgaacacacacacacacacatatgacactagattgcccacgtttttccagcttgcttttccaatgtcacaaaactctttccacataattaaatgttcttgaagtaattaaaattttctgtgttgctttagcaatttaatactgataaattcataatgcttctttaccgtatggctggctttctgtatatgtgtctatttattcacacagtattagcagctgaatcaagggccttctgtgtgctaggcaagcactctaccagaaagctacaccccagtcctggttttatgtgtatttacatagacatacatgtagcaggttatttgagttgttatgtaattacactatgtaagcatatgtactataagttgtaatattcctgtgtgtcaactaatttgatgctcatgatcctgtgaggtagagatattggtatccctcttttataggtgagaaagtcaaggctgagaaagatgcaaagacttgcccaggccacacagcagaggcactagttggatgcaggcactctggctccaaactgtgttcttccaagtgccctgtctccttccagcataccactgagatgtcaaagtccaccatggttaaacatttcttgtagtcccttttgcctcatttctgatttatgttattttgccgtgttttaagtacccctgtaactcacctgcagtcctttctaccacaaggcaaggcataaataaacagtacagagtggtaaacgacataaacaggcaaagctaaaacacaaccccagggaccaagggtgagtccagactgtccccgcaatgacatggatttatttccttgggctgtagctggcctgcctccctggaagagctggcttgggtggccagctctcaggaagaccaggaagaagggccttcgtccaaggagaacaagctgggccagcccatccccgaggccctttcttaggttctcagagtctatgaaagtggaaggaacagaatgaggcgggctgaagcaaggaagcccttgggccagaatcaggagtggagtttttctgtctgagtctgttattgaatcacattctaaatgagaaagaaacttaacagtaactagtttcaagctcgcagctggatagattctcacctctgaactctggctgtagctgcaagacagccaaaggttaccattcttgttcacagtccttttgttaaggcaacagagaaccaggccagaggctgggtggcccgaggacaccccaggagactgtaattgcgcgaggttatccattagacaaacgtggtgagagagctcatgtttctttgagatggggtatgttccccatgctggccttgaactcctgggcttaagatagctctcaagccttcggcctccagagtagctgaagtggcaaaagcacaccacccacaggagaacaccactgcctcaggccaggagcccagattactgtatccaaattatatatatatacacacacatacatacacacacacacacacacacacacacacacacacacacacacacacatataagtagccagaaatttgggaaagttatccctagcctctgaagcctccacacccttagttgaagagtagagtcaattggtactatgcaaagctattgtgggaatctccctagggatattaaaaaaaaaaaaggatctaggagctgccaagtcagcttcaggggaccctgggagaactgaactggccccatctctgaagttcaggatagacctgagtaggccactatccaggtgcgtccgagcttcttggcctttagcctcgaatcaccacagcttccaggcctaaaagaaaattggcagtgacaactctgtgaggtttaggcgctgcctcttgttgccccccaccccatcccctagagcctaggggcagaaagttcacatccctttccagttccccttcctcacgcctctggggccgagtgcccataggggcaaggccctgagcgtagtgccaccggggccaccagtctgggttggaggaaggctggacctctgcgaagaaaagaaaacaaacacagatgtgtttggctgggaccgggagggagaaagccgttctcgcccccaccccacccccacagggtgcgcgccggccctgccccctctccggggtttccccgggcgctcctcttgctttctctttgtctctgctgttctttctccggctcccaggttcccacccgctcgctctcgccnnnnnnnnnnnnnnnnnnnnttcccacccgctcgctctcgccctctggtagcatcccgggcccgttggctttaactttcttcttcccggggttaaaactttgctcgtgagcgggcggctgcttgccgacgttactggccggcgccccgcccggcggccccgcctccgcgctcccctccgccccccactcctagcgcgagtggtggcggcggcggcagcggcagcggcagcggcgggcggcggcagagccttcgggggcgtgcgtgcgtgtgtgagtgcgcgccagcgagcgtgagtgtgtgtgtgtgtgtgcgccccgggcgggcagggcagcactcggaccgcggcgggagtcggcggccgcgtcgtcactcgggaggaagaggcggcggcggtggcggccggggccggggctggggcagcggcggccgcgccgggcatggagctggcaagcccgcgttgagacaggacgctcttgctagccgccagcgagaggctctctgcagtccggcgcgcgggctccccggcttgggccaggcaaacttttctttctcttttgccatcacttagaggtaaagtctcctacgcggaatccccagcggggacgcgattggggagggggcatttataaaggaaggaccccaggtggcaagagaaaaggacgctgagcccgtgcgtggttgggggatctggagccctgctgcgcctgaggcttaagggagcaaggagaatgggcatagctgcggatgggcagatgggcgcgggcttgctcttcggttggccgggaggctggggaagccgggaggaaggggcgcgggcggttcaggtttggaagcccctgcgctcggggtcccccggactttgggggagggaagtgggcagtctcggggttggtaccccggggagcggggcacttgcccgccactccaccgagggctgttgggcgcggggcgggctggctgctggctggctgagcgcggctcccctctctccgcaggcgcctggtgcggcgggcgaaccgactccttggcgcggcggggccggggcaagctggccacagcatgatgcgcgctgtgtgggaggcgctggcggcgctggcggcggtggcgtgcctggtgggcgcggtgcgcggcgggcccgggcttagcatgttcgccggccaggcggcgcagcctgatccttgctcggatgagaatggacacccgcgccgctgcatcccggactttgtcaacgcggccttcggcaaggacgtgcgcgtgtccagcacctgcggccggcccccggcgcgctactgcgtggtgagcgagcgtggtgaagagcggctgcgctcctgtcacctctgcaactcttcggatcccaagaaagcgcacccgcccgccttcctcaccgacctcaataacccgcacaacctgacgtgctggcagtccgagaactacctgcagttcccgcacaacgtgacgctcactctgtcgctcggcaagaagtttgaggtgacctatgtgagcctgcaattctgctcgccgcggccagagtccatggccatctacaagtccatggactacgggcgcacgtgggtgcccttccagttctattccacgcagtgccgcaaaatgtacaaccggccgcaccgcgcgcctatcaccaaacagaacgagcaggaggccgtgtgcaccgactcgcacaccgacatgcgcccgctctctggcgggctgatcgctttcagcacgctggacgggcggccctcggcgcacgacttcgacaactcgccggtgctgcaggactgggtcacggccaccgacatccgcgtggctttcagccgcctgcacacgttcggcgacgagaacgaagacgactcggagctggcgcgcgactcctattactatgcagtgtctgacctgcaggttggcggccgctgcaagtgcaacggccacgcggcgcgttgcgtgcgcgaccgagacgacagtctggtgtgtgactgtaggcacaacacggccggccctgaatgcgaccgttgcaagcccttccactacgaccggccctggcagcgcgccacggcccgcgaggccaacgagtgcgtgggtgagtggggcgccgtggcgccgcgggcggtgggtggagacgcggtggggcggggggagctcctggaccttgcagcggcgggttctcccgagcgacggagccaggagtccgagcatcgcgggatagtgggtttcggagaccttacagttgcttcgggacgtgcgttccgagacgtatgggacctgggaggggtgagatcagagccatctgcccgctctgccgacacccggtgttgcatcctttcacccacttcgaaaccaagaggcggctggagaagtggcccgggaggtcagggggtggagggagtggtttggagaaaatttgccgacaggtctttctaatcccagatccaaacggaaacacattcactgccttcctcgcagtttgcttagtgcctggggttcacctccgccccatccccctttcctaaggctgcagctgggcgcgcggttggggaccggggacgttccagagccacaaccaggaatcccttgggagaaggcagagagctccttgcagcttggaaccagttgggtaccaagcaaatgtcactcgtgcaccctccaattctctttttatggtttgattttttttctctcctccccccccccgtttgaacagcgtgttcgtgttatcaagaggagagtgatgtgatttcaattaattactatctacaggttacaaaggagacctcagtgactattttaaactaattcaatcctggaccaaaaaagaagtctaccaggttttttgttcgttcgtttgtttgtttgttttgtttttgttagctccggggtttcgtgaaattgagcagttttgaattaactaaggatccggcgtctcgatttttaatggagtttcaatttctgaaagagaaatctgacaaatccggcattggtgaatacgcctgggtcaaaaaggaggataagaaaggatatgttctacttctgaattgtacaactttgttgatgcagaaactcccaggcatcagtttttcccaagacagagagaaggggggcagggagagagggaaggagagagagagagagagagagagagagagagagagagagagagagcccacgttttcagtattagatgtaaatgtctaaatctgacagtgattgtaatgaaaatcatttagcccataatgtgccatttggtgtgcatcttttgtgaacatacagatttttttccccctcgccctcccaaccccagagagccattgcaagtctcttcaatcacttcaccctcggaggcacattgcagagtttgctggtccccacaaacacacgttttgaagtctggttctgattaattgtgtcatgttgttgtcgaatagtttgtgcctcatgactgtagatgcaggcttttgagcaagcgaatggaaaacatgtcttggagggtcggtgctcagaggcccaggctggagccctggtctgcagacgcctgtgcccctgttgcactgcagggcctcccatttaaaaatgcagtgcgtcccagcctttgcggacctaactgtgcgtcccctagccttcaaggcatggaagaactagctttccagtgagaagagcctttgcagcatctgctaagtggtggcatgcagacttcgtagtggtcttggagaagaaagtgtctttgatctgttcagttccctgagaaatgttagttttccccccatctcttcttctctttgcctttcctcttttcttttcttccttttgtgtggaaaaaccctttattggcacttaaagggattcccagggttttgctatcagttttagtttgtatgtgcatatgaaagatttggtctccagcagggtttaattggacaaacgtgagtggctgtgttggtgtgaatgatctggatcagtgctattgtagtgtcactagtgcgaaggttccctcatccctgctattgatcatccctctctgtcacttagaannnnnnnnnnnnnnnnnnnntctctgtcacttaggatttgaaaacacaacctgttagttgttataatgatggccctggacttgaaataatctctagtttaggattttttgtatttccaccaaagcactaactacacacaaattggattgacccccctccccctttttgtgccaagttgagcaatcaacatattaactaatgtaattagcaagtggtttttgttcaaaaagtttaattaagcctagtaagtacataatctacatgacaaatgatcggctaacgatatttttttccagggttttttactgaagttattttaattcttcgtagttaaagcatctttaaatcttgccaattattcagtcatttcataaaagccaagccgactaaactctgttgaagttatttatagtttcctttttgaatagatgttctgataccttgtagatagaactgggaacatcagattgaagttgccataaagtcttaattgaagttctagtgatttttccatcattctgttagagagaaagccaacaaggacaatttaggagtgatttacagctaaaggtccagctttttatgaaaaggtcctgaagtggagctatggggatgtcttaggatttgacaggtgttctgagatcctgaagggcactgtgcaaggagaagcattaataaatccttcacagagtaactttgtacctccagcaactcagatgcccgccccctccacataagcccattttgtgaatttcacactgttgacacacgaatgaagctgcccagactatttacaattaaggcaaaggattgtaatttttaaattaaaacaaaaatcactcttgatgaaacaaccagcatcgccgtgctgttttgctttttctttaagaagtaatcagatatgatttataataggcctaaattagccttcactccctcctcaaccaagtccctaagaattgagactactgagtgtcttccacagaggcccagcaacttagagattcctaggcagtgtccatgtctcctgtgtttgctcaggccaagcactcatttcagtattgcttcaaggcaagtttctctctgcagggtaaatgcaagctgttgtgaatgcaattttggatttcttctggacagaaagtatttctgaagtagtatgaaagagaagactagtatatatagccttccctcttggacagctctcagcagaataaccatatgttttcttccacccatatgcattagcagcgttcccatgcttttatatgtgtgtacactggctgtgtaaagacacacccatgcatgctgtgtgtgttggtgtacactgaaggaaaaatgcattgacagtttttaaaccacctggatgtctggaccttcctcccccctctccctttctctttcttttggaaaaagagcatctaaagaccatattgtgtttcataagttattgacatcggttttaatcagtgtctccctgatatgcgagctgtgttagtatttagcgcctgatgaagcatgctgtttaatcttcctgtggggatgtcaacgtgagcctctgcttggtttgtgacaggttgagattatgaaaactcgtttttcgactcactctatggctttacattgcctagctgtaaccgaaaacccacacaaaagacgcctttgcaagatgagcaccgtgctggcctggcctcctatggtcatgggtacctgcaacataatgctcataattgtttaaacatggctttgaggaggggtgcagtccaaatggtgcaaggagccctggtgcttggggcacccttagcatttgtcaagcaaggggggttatgttggaggagttgccatgaaacaaatccaatacccgccccccttgctaaagacccttgctatattagaaggccaaaaatatttgctggctcgtccagagcctggcatctcactgtggaagagtatatttttaatactcatagtaattattataattactatcattatgatgattaactcttgagggcttattctttgccaagcactcacattaatttagttatttgatcgttgtgactcggcaaataatgggcactattattgtccttattttagagatggggaaaccatggcctagagacattgcatggtttactcaaagcccggagctggtaggtggcaaagctgggcctcgggccctttgattacacttcattttattgcatgtgctgaactgcatccacacggaatggctgcatggacgactgaaagaatgaataagcgtatgttatgtacacatagaaggaaaggcagaacaacctgttacttcttgctagaactggaggttgtttccttaggtatgttggcttgtaatataccatactgttattgtactatattaatgcatacttaaacataaagttgcaaataacttctcctctgtcataaccagtggggctggtgggagctggaagaagtataattgaagagggttcatgtctatctgtctgtctgtctgtctttacctacttacctatccatccacccatccatccatcgatctacctattggtatttatctgtatgaatcgaacctgcatcttggtgcatgcttggtaagtgcctcgttaccaagctgagcttatgtttatttgtgtgtggaggtcagaggacaacttgctgagttaattctctttgcgccatgttcttcctaagttttttcccctttggtcataaggacgggaggcaggctcctctactctcttagctaccttctggctgacacttttttggtttttattttgttttgttatttatttatttattttttagagacagggtctctgtagttctggctgtcctgaaacttgttatgtaaaccaggctggcctcgaactcagagatccacctgcctctgcctcccaagctctaggaagagcatctgctactatattgaggccaaaatgtatttggttttgtttgtttgtttagacagtgttgataaattgcccaaactgaccttaaacttaaaaaaaaactttttaaaaggtgctatttatttattatgtctatgagcagttttttgttttgttttgtttgcatgcatgtttacagtgctttgggaccatctgggtgctgggaatcaaacccatgcccctctgcaagaacaagtactctgaactactgagctacttagtgccatggccctgaacctttgattccccgccttagcctcctatatatctggaatggtaaaagctgtgcgtcaccaggcccacagataacaagtcttgaactcagcggtaggggggcgttctcaaaggtccaggtgaaacagagctggtagtcccaaatcctctttaaaagaatctcttttctcccaccccagagcttatcgccctaagtatggtgcaaaacaaatgaagggaccaggaagtggctgaaggtgttgctgaaaaaggacgtttgatggagaacgtggtgttctgattgtcagcctgatgccatcagaggacagtctgcagcacaaggctgtcactgtcactgaattctctaggctctaggcagccagagtgaggtctcagctggggtcctcattagcgcctggtgcgtcaggaggctgccccccagctctgtgcagggaaaggaggggggaagtcagggccaaccccctgggggcccgcaggcctgcattttcaggctctgcccagctctccttttagccctgcccagcctcctctctgacctcctcctcctggagaaaaatgagttcctcggaaaagtatttgagactttatgtccagagtaaatattggaaaggcagcgggttgcaatgcagacgttccctggaaggaatccccccctcccccgtttgctgcccacagctggtatcgatatttccttcttgagatgagttgtgcttttcattaagtaaattttttgtcttgggattaaaccaacattgtattcttaatagacttttatgtttacacttcaaacgtccactgggtagttactcgtgttatcttgatggcttctacagtgtctgctatgcacactggctgcaccgaaataaatggctctccggggaactggattataaaacagctttatctgtggatgcacaaggatggatattttgtgagccggttttcttttttttccccctctttctttcagaagcgactaacatgccttgggttttctgtagcatcttttattatggggagacaagaggtcttggggtccttttgaaccgatgaagacttaagccttatacttaagagagtagcatgcagcgtttcgcctgtcttctagaagcctcggaaggccaagtgttggtttgggtggccctggaaccggcagtttagaccgtcattcacaggtggttgtcaggttgagtcctgaaggcagaccacaaacccccaccaagaaccaggcattgtccgaggtactctctgtgtgctttgttcaattaatcagattgccacaaggaacagaagcctttcaaaaacagatgttgctgccaccaaagggcagtttgtatacacagggaccaagtggggactcgtctgcagggcacattggagagagcagggggtatcagaggcatttgtttctgaggctgatcacataaaagccgtgtcctattataaatgactcccggggactgttgcactgaatggagctgggaagaagtgagctgcccaggccagtgtgctagacaggaacagagctgtctgctggcgtgagactggactgctgggtgggaatgaccttactactcccatgttcttaccctgatttcaaaatgtatctttattgtaaactcagaactaggtttcccatttctttgtttacttttggtttttgatacaaggtcaccccagggaacctgggcagcctgaaacttgtctgtaatctatgtgccttctgagtgctgggactgtaaacatgaaccagccacaaatggattagaaatacattttaatttgcttttgttcttttctttctttctttctttctttctttctttctttctttcttttttttttttttttgagctggttggtggtggcacatgtctttaatcccagcacttggaaggcagaggcagtttgaggccagcctgctctacagagggagtttcaggacagccaaggctacacaaagaaactctgtctcaaaaaacaataacaataacaacaacaacaaattttttttgtttaagtgtaagtgtgtgtgtgtgtgtgtgtgtgcgcgcgcgcgtgcgcgcgcgcgcatgcagaggtcagaggcaatgaatctccttggaactggagttacaggtagctgggggctgcttgggagtgtgggtgctgggagtcaaacatgggttctctgcaagagatgtatgtgctcttaaccacagagccatctctacagcccccttaatttacttttaaaaaagcttaaggggctggagaaatgacccagtggttacgagcatttgctggttccccagaggactgcagttccgtttccagcacccacaccaagtagctcacaactgtctgtaactccagcttcagggggtctaatgttcccttccggcctccatggttacccatatacatgtggcatacattcacacagacccccagacacatataccccctctacagacacacacttggaagaagtgttacgttggtaagatgcctgtcatacaaatcgagacctgggctcaaatccccataactcatgcaaaatgctgggaatggggacacttgtattcccaggactgaggaggtggaggcaggaggatccttagagtgcactggccagcctgtctagtagacttggtatgcttcagagatgctgtctatatcacaggtgaaggatcattgagaacgacatccactattccatctctggcttccacatatgtgtgtacatacatataagcatgtatatacgccacaacgtacatatatacagtctgttcaggcttgggtgtaactgagggagactttgattagcatgaacaggtcctgggtttgagtcctagccctgcactaagccaaaagagctttatgtaaactctctcaaaacttgtcctgatatccagagccagagacccattcaatggtgaattctttctttttttttttttttaatttttatttttaactgggaggaagttctggcaaatgctctaccactctataatggtcagattgtagaaatattcgtcctgggctgtgagataatttactgggtaaagcacttggctgacctcaggaatgccaacttgaggtcagatccccagaacccaggcgaagaagatagcagcagaagaacaggcctaatgctgctgcacacccaggaggagacaagagacagggaagcctggcatatacgggggtaaacaaaattgggatcttctgcctcaagcaaactggaaggtgaggcctggtaaggttgccctctgatctccatccatgtgccctaggacatgtgtgcctgcactccacacatgcagcacacacgtcacatacaccacacacacccatacccaccccaccccgacacattctctctatctctttctctcagagaaatatcagtcctttcccatgttcagcttctgggatggtctggctgggcctaggttcaaacctgcacgcgtgacttttgtcagttctgtcttctgattgagagaagggtctatggccatggattgatgagatggagaatgtctcttgttggagcctctctgtctttatatataaactcctaccccaagcatccctcgccccgaggcagctgctggcatgtcatgcataaaaggaaacgccatctgaagggacaggagtactaccaagaagtagaaaagattcctttgctgtggtctgtgtgaactcctccctggcagtccctgggtcatctgcctgtgggattcatgcacttgctaggtagggctgaagcaaattcacatcgaagcacacagaggctggtgatgaagacccaggaggaagaagggtcctaaatggaggagacatctaggtctcacagagggctggctcttcagaggtcacagtagattggttgggtgagaaacttttaaggcaaaacgtgatgcccaatacatcccaacatgggcagaacttgagagtctgggccttggaggatgcagaacccacttctgtgggatctcatttcactgtgtatacggcctcattttagtcgggggtggtggtggtagtgacccatttctgctccctcttggatggatgttgctgaagtttctagatttttttcccccttgaaatattttttttctgctacagataagagagattattagctctcacatttgattttcacgcattcctgaggccccacacttaagttagacaatctgtaggaccacagacatcttgaaaggggctggctttgggtaaataaggaaatgagacagatcttgcaatctctggcagcctgtatgttgtgcagcgttccatattcgaagtcccaaagtgatgaatacttcctgccttttaggcttctggtttcattggctcctgtttggggtggctgtggtgagttcctgtgtctgctcctatgcacagggagtatgtgccaaggcccccattttagatatgtgcggttgtggataacactgacatgtacatacatttttgcctgatacctaccatgcctattataaagtttgatgtatacgttgaagtaggcatgctaagattagcaataatcaaaggtagtatgtgtctttaacaatatgatttaattttaaaaagtgaaaaattaaatatgctctcttaccatcactgtggattttatcgacctcggcatgcaattttgttttccttctatatttgaaaacttttctccttttaagttaaaggaagtgctttctgacatatcaggactgtgagcaccacttctcttgtactttggggccattattaattagagcaagtactcaaacatgcacactgtgacagtagacccggtaactgagatatggtcaagtgatcaactgaggggaaggatatacagcctggttgcagtggataaaggcctggttcacattctcaagagtgtgagatcctaccatagtgcccggctcaaaagtaacgaactgtttattcatttgggattgaaaccccagaaagcaaaaccttgagagatgggagatgactgtatctagtgaatgcatcccccaatcctatctggagcctgggcaggcattgctagttaactgctgcatgctctttctaagtccagaactgatctaacagtagtgaactacatgaggtgaaaaatcacttaccatttttcgctgtagactattttcatgaccttgcccctccccatccactgtgcagacatgtaccatgagttgatgttcaggagcagttactgttgaggtgggtctgttggatctgggcatgacaggaaatagaaaaagatgctcttttcattacggatactgtgtacgtatctgtacacagtagagaagacacttatccatgtgaatgggctccctcagagtctagggcaaaggggaggcactgagtgcacgctgtgttcagatttggcttctctaccagggaaggattgcgtgtatgtccacgtaatgttctcctcctgaatttgttctgatgtagtgtttttggttttgatcaacacaagattttgagaaaccacagtttcttgaaaagtgtggtcttcccagagtgtcagcttgggagttcccaagcaggtgctcgaagctgcagagcatgtttttggacaaaagcttgtccctgcctagcctggggttagatctgggtggttgagcctccctgaaacgggtgagagtagttgttccctctggtcaggaccaacctgtgcgatgttgagggcatggacccttcaatggttacagtctcagctctgcttatgttcaggccggtgcagaaagtgtcgaacaataatagcaccaaacccagcatgaaaaaggaaacacattgtttttgcagatacagtatctggcatcggaagcatggaagcaccttggggctgggcagcctctgggcagggctgttggacacaggacccctgcccacagcctcatggccaacttgttttctcccagaagccagacctcagaggtggacagattgatctcagccagctctttcttcccagacacaacccagtctcacttcgtggctcagtcctggagaaaattcactgtgagaaagagcttggcctctcaaggaaggaaattggatctccttccaagccacagaaatcagcccttcggaaaccacggattcgggcagattggccgtcagggtatccagatatgcaagggaaggaagagcaaggctgagcggtcctctgtgtttcttagcccagtttatttgaccggatccaaggtagggagctgtttctgtttgaaatgaaagatgtctgcctgcaaagcagagcttcattcctcctgatccaaggggcattcttgttttgaaccaaggtcagggcacacagcattccgtttagtaaggtgtgagagcttgggatagatgtggggattttgataagggaggccctttctggcttttggtgcctggatctagatcccaaccagcactaggattagcacttcagcctgcgtcaattgcctattagctcagaggcccagcttaagaccactgcatgctaagcctcgagtggggctctgagcagggctggagaagagggcgttgattgcaggctcggggcagggttgctctgaccttgttctaagcaccttataaataatcacctcagtaagtgctataccaacccaaggaggttggttctgtcattaatgagtaaacttctttgtggccgtgtagcacatgacccctcggtgctcagctccgtgacctgtcaggcagtgttcaccacgcttgcatagccagtgcccctgtcgggaacagagctgcagactgggagctgggctgccatccctgcagggcatcgtgccccttaaagtctgccaagcatggattttgctttttaactctctgcagttaggattgcggtctgggtttgtaagtctgatactgccatcgaggtggctagctgtgtgtggtagtgattcctgagttttatttttgtcctagaattttgtgttaagagtatcatggtatatttctccaatctacatagaacagtgtatatttgttttcctgagtttggtctattggaaaaaagcataactgtgaccacacttatccatacttttataaacgaatttctgctagggatatatgaaaaaaaaagggacttctgggccatagggcatgagtgtcttggtcagcttctgtagacagtggcagtatgtttggtggaaggcaacttacttcttggcatccatatagccatttcccaggtgaagaaactgaggctaggtaacttgtccaaggtcataaagtttgtgagatttagagacctgacctgtggctctggagtcttgctttcccttgttgggcctctggcccctcccctttagtctgtgtccatcctggcgggaggaaatgttcatattgggaagcaagggagactggctggggccttgattccctgactcatgacatccacgattggacggctgagaccctgtttagctctgcatgtgtgatgtgcacagtactctgagccacactgcctccccggggcttgcagcctgacttccttcccccacccccacaagcagcatctctgcattgaaatgtatctcctgtccactctctctggagttccctcagtagacttctgcagccctatttggaagacctccttggccttccctctaagagtttccttccctcagactcaacccacagtgcctcccgtttcttggaggggatgacgtgggctgccttctttccttgccctcccgcgtgttggctaacctgacatctctccagagctgtgtgttcagctggacgagttttcacagagtgggcacacctgagtgtctgtgctgaaatcaggaaatgagatatttccaaaaggcccttcgtttcctcccagccaccgggacccctgtgtaggcagttttgctgctattctgtgttggagggaggacctcactctgtaggtagctcaggctcctctctgtctccagaccctcttgccccagcctctccagtgctgggaagctaggcatgcatcgctgtgccaggctctcgagacccgcctgcttttgaacttcatataaatgaaatcatactgtgtgttctcttcactatcggggccttgtgctcggcattattcctgtgagtgccgtcagcgcgccttctcctatggtcctggttagtttgatggatgatctcaggttcctgggagcacggacggatcctcctcattttctctgctgacctttgctcatggtgaatgatttccttatgtgttttggactttctgactgtgagcttatttttatttcagattttgtggaaatccctctggtctcagttatggaaatgacccaggtttttttttgtttttttttttttcatcgattctgccaaaaactgggctgggaccaaagttttcacttattaattaatcaccacggaaattattatttcaaatggggaagagtatgcgtgcaatctccaaaaccgcccaggcctgatgtctcatttctccctttctgaagggcttggacaacagagactttgagggataaagactttcagtgtcccgtactcagtactcagaatgcattgggaaggtcgggggggnnnnnnnnnnnnnnnnnnnngggttgtcacctggactattgctacagttgcccacccactaccgatacagtctattctcaacagtggccagtggtaaccttgcctgcatgtcagttgcctgcctggtccattccagggagcacctggagctctgacattggctgcagagcctagcctagtcaagccccctgtttctctgccactccattctgttcttttccagccagactctcaatgtgctagataatacactccttacattcctgacactggcacttttgtgtgtgtgtgtgtgtgtgtgtgtgtgtgtgagtgtgtgtgtgtggtgcattaggtgtgcacagatatcatgtcttcagtcaagtatcaccttggtgtcaccatggtaacattcccccatcttgctcgtccatgctgtgtatcaccctccccacctgatatcaccgttatccggctctctttcttcctagaactcttacatcaccttctaaaatacaccacaacttactcagcatgttttgggttttgtttttatttatttcatttacaggaatacactgtagctgtcttcagacacactagaagagggcattggatcccattacagatggttggaagccactgtgtggttgctgggaattgaactcaggacatctggaagagcagccagtcctcttaaccaatcactgagtcatctcaccagccctgctcagcatgtttattgttttcccatccttacatttgctcttttttcctttaaaaaatatatgtatgtatgcatgtatgtgtatatgcatgtgtctgtatgagtgtgcacacatggtatgcaggtgtgtgtacacgccacacagagacagcatgcacacacatgaagccagaagaaggcatcgggtttccttcatcactctgtgcccagttgtttgaggcaggtctgttcctaaatctgggccttacattttcttagctggtttgagggtcagcaagcatagtggtcctaagatgcctggctcattgcataggggctaggatctacgagtcctcatgattgtgcagtaagcacctttagctacagagtcttactgtgaagcccagcatggcgtggatcttgtgtagaccaggctggctttggtctcatagaggatcagcctgctgctgcctctgcccctgcgtgctggggtgaaaggaataggtcctgggaactgaactcagctccccaggaagaacagcgattgctcttcactgccaagcccaatcttctaatctccggatctaccacttgctacattgtaacacttgagcgtacgtttactccagagcagaaacccttggctgtttaatttataaggggcctggcatactgttcaccaggtgatctcagccctagggagggtgaggcaggaggattgctgtaagtcagaggccaacctgggcaacaaagtaagttccaggcaagtctgtactttagagtttcaaacacacacacagtgcagatcctctctcatttgcaaggctgcctctcttggcttgtttgcatgctaaaatccaagccccaaagcattaagacctacttgcagatttgataaccagtccttccccgtgtctctctccttcctcctccccagctactcacccatgcctcatgacctctggggactcagtggttccctggattttcaggccttcagattctctttgcctctgccctctgagcatctccttttattttatcctcacgaggtctgccatgtatcgcatgtatttggaaattacattctgtttagcatttctccatgcttgcagtggtcagggttctgtattacctcagtctacttcgctgccagagcctaagatcatatattttcatctcttctgcatctggagttatttatgacatgcggtgtgaggtaaggacggccattgttttcgtcagatatttagccagctgttccgtgacaaactcttgaaaaacgttctttgtcacagccctgagatgctgcgtttattaaatgccggagtgttgtataaacttggatctgttctctggatcttctactttgtttgacagctctatctattttcctgtcacttcctatctggacaatgcatctcaatgtctggctcgggatttgctcctcctttcctagtcgtcctcattgttattacctaagatgttttgcctttatttatttgcgtgtgtgtgcatgtacacgcatgtgcgtgcatgagcgaatgtctcagcaggtgtgtggaagtcggacaaatttactcagctttccaaatattaattatcttatatattcatcccacaatgaccaaagcctagaaaattgatgttgacattaggatctaatctgcagaccttctttagctcttgggtgacttgtcctttgtgtccttttttttggtccagagtggagcccacccagatccgctgtctcctcagacgtcagccagggtagcttctcagacctgaaaggacttcatatgctttagagaactgcctggacattatttcctagagtgtttctcttttgaggctgattggtgtttcttcatgatcaaattcagataatgtgtcttccagtcaaaatcctatagaagtgacattatacccttgggtctcctttccagtggctgcaggccaccaaaggacagagagttgcttctttctttctaccatgtgggtctctgggatcgaacttgagtcctcaggttcatcagcaagtgcctttacctgaccgagccatcttggattctttattttttgcttgactcctcaaaaaaagttattcccacccacccccacgaagaaaaaaaaaagctaggcagagtggtgcatacctttaatctcagtgcttgggaggcagagacaaatggatctcaatgaggttgaggctagtctggtcttcatagctccagcactgtcaggtctacatagtctcaaacaaacaaacaaacaaacaaacaaacaaacaaacaacgaactgagtgttttgctacatgtatttgcaccatgtgcttgcattgcccaaggagacctaaagaaggtactgggaccctgagaattggagcaagttgccatgtgggtcctgggaaccgagcaggcctctgcaagagtagtaagtattctcagaggctgcagcgtctttccagcctctggcttggcttctgtccttttgttcattgacctcagatgagtttgccattgattattttttcagctattgttctgccttggctgtgtttgctgactggatgagttgctcaagtttcatttcaagagcccttgataatttggtgaaggtgttgttaaggtggactcagttatagtcgataattttaagttgtcactgcatcaacacaattctgtataataacaactcaatcatttaaatatctccattggggttgttagagtttctgctccttgtgtgtctccctctttttttttttttattccagatggacttttaaaacagacttattgagatataaatcacacagactttgagagtgtgatttgataggtttggcctgtgtgtgtcataccaccagcataattaagacaaaggaatcagcccaaaacagtccccgtgctccttggccctcctcctccttctttctcctgtgctttctgtggtattagtgttcctcttcttaacaactaaaggatgtattaattatgtttgtgtgcatatgtgtgtggcagaggcgcccttaggctgtggcatgtgggcagagtccaggcttataggagttggctttctccctccacggttctgtgggttctatggatttaatcagatccccacttttgatggcgagtcccttagcccagttcaccttttcttacctttttacataaatggaaacatacactttgtagttgtgtgtgtgtgtgtgttcacctgtgcaggcatgtgtggaggccagaagttgacgtcactgagaagtcctcctctattactcaatgcctcttggctccctctccccactctgagtcctgtctctttgactcgctatctctgtgacaactctccttccttcctcccttcctccctcacctgcaccctagggttacaggtgtgttctgcagtacctggctttgaggtgggtgtcagccacacaaactcaggtcttcaaactcaggtcttcactctcgtgcttgggctatttccagctctactttgcattcttccttcttctgccctgtgtggttatttggtttttgttgttgttgttgttgttgttgttgttgttgttgttggtttttttgagacagggtttctctatattgccctggctgttctggaactcactctgtagaccaggctgaccttgaactcaggaattcgcctgccttttcctcccaagtgctgggattcaaggcgtgcaccaccacatccagtgttatttgggtttcttatgtatcactgatgtgtgtgcattgataatacagaacatggctatactacacagtctgcctgctgatctcccaataggaattcaagtcgtttgcactttggggctatttgtacagatacagcagctgcgaacatttctgtgtaaactgttctgtgaatgtatgctttcatctctttgggataaatgcctaagaatgggactgtaagctgatgcaatagatgcacgttcaactttctaaaaaagcatttatgttttatatatgtgtatatatatatacatatatatatacatatatatgtgtatatatatatacacatatgtgctcagatcacatgtatgcctgtatgccaaaagatggcatcagaatatattacagatggtcgtgagacaccatgtggttgctgggaattgaactcaggacctctggaatagcagccagtgcttttaactgctgagccatctctccagcctcaaatagccaactttaaaaagagaaattgcaaactattttctggatgctaaactagcagtctgtgagagttctagtttatttgctcctattttctaatggcttttgaaatgaccagtcctattaattgagtcattcctatagttatacagtagatggctttacaattttgtctaaaaacagaagcatagaacaaagacatttatttatgttttttatatacctctcaggagagttgatggatttttttttataattgaatcatacactttaaaaaatgtttgttcctggttggacctggtggcacatgcctttaatcctagcactcggaggcagaggagggtgggtatctatgaattcaaagagtctggtccacataatgagttctaggcgaaacagggctacacagtctggtcctgtctcaaaaacaagaacaaaacaaaacaaaatccaaaaccttactcctacctagtaataaatttgcttttgattttgaaagataattttctatcgcattcaactcaacaattaatgttgcaattaggtacagcaggctgttggtttctttttttcagtgctggggattgaagcccatcagggtgtgctgatgctggtaagagctgtgttgctaccttgacagtgcctttgtgatttgtgtattagtatgctgcaacctgcagctgtgctaaattcatttaaaattagtttctatagggtctcggttgacttctcctgaacttttcaccacataatccaaaagctctgtagcccttctcccccccccccccccccaatacttgggcctttagtttaccttttctttcttactgcattggctacaactacaagccaatgacatgtaataatgttgcgagtgtgcctcgctttgatcctgagcgtctcaggacctacatcatggaatatgttgtctgatgaaaccttgaggtagatatcctgttcctggtctactgggaggtttggtttttttttttttttaattcaagtatatatagggtattcctatctctccattttgttttgtttagtttttgagacaggcttcatgcagccaggtaaccttaagttcgctacgtacttgaggcaggcctcttgcctcagccttcaaagtgctgagattctagacttgtgccatgatacctaggtagaatattagtcatttaaagatcaaccaaaattaatcagttttctgctttgactgttcgttaacccaattgactgcattgattaacttctgagatgcaattcatactccatttgtaggttgatggatgactccttacagtgagcatgttttcatggctcacctgtgttttagcacatgtgtgtttccttgattttcatggctgagtaacgtacagaattttatttattcatttttgtgttgtgtttctcatttgagctatactgagtagtgctgttgtctgctgtgaatgctgacgtgagatttcctgtggatctgcgttacggtggtttggaagagtaaaatcagtcccctgtgggctcctggattggatcacttgttccccacttggtgacacttttggaggacattattgaacctgtaggaggtggaactgtgatggaggaagtttgaggttttataacctggtcctactcccttttcccttcccccctctctgcttcctgtgtgtagatgaaatgtggtcaccctggacaccaggctgacctcgcactcctgcttccatggtctcactgccacagtggactgtgtgccctgagactgtgagcccagataaaccctttctctccaaagttgcttttgtcaggatattctgtcacaacaacagcaagataactaatacatgtgtatttaattcttcagtatgtacccaagaatggaatttctgggtcataaaaaaaaaacaacatagctttttggagatcagccaaaccgatttctccccagctgcactgttccacacccccacaggcttcatagtggatgctggtccattgatactcagcatgtgccttttcataggcattctggtgttgtgaagtggcatctcactgtggttttgtgattacccgagtttgaattagtcactgcaaattgtatgattctttgctaatatttaattttggatatttaggtctatgtttgaaagtgagagatgtctgagctttcttttggttagcctttgtatcaaggctgtccttacattagcaaacaatgcaggaagtttccactctaatggcatggaagcagctggacctgatagttttgatagaaagagcccatctgggcccgtccagttttggaagtagttattcgataaccatttcaatttattccatacttcaatgttggttcaggaattttcaactgctcttttagtcaaatctggccatttattttccaagaaaataatccttacccagattttcatttttaagcatagttatatatagtgatcacaaaaatatattaaaaatttccatatgtggctctgacatgtatgcaatgtcaaatagtaacatttactctcgttctttgcctgggttcgtttgcttttttgacatttgtgtgagtgatgatggtggtgtcaggtcatgcttgctgtttgtttctgtgtgctagaccccagggcttaactaagtacattcaataactcttaacaactctgggaatcggcagtgcttctccgtgttgggtagtgaagacattggacttgtctgaagccacacagctacaacgtgtagacctggaattccagtaggacctgtctgttctcagagctagtgttcttacctgccttctatcccaggctgctacttttcctatttttttcaaatcttactatggttggtgattgagtgattgtgtttgtgcttatgagtgtgcacacatgcatgccccagtgtgcttgtggaggtcagaggatagcatgggagtcctggttttgtcctttgaccgtgtagatcttggggatcagaacttgtgtcgtcagcttggcagcaagtgcctttccacgtgcatcttgccagccttactgcttgcttttgaacatagttcgttttctaagttttcacttttttatctttgctaatttattacttaggctatttgtggtcctcctaatttttgtttaactctcagctcaattattttctttgtgtatatcaataaaccatttaaagcaagaacttttcttctctactatggctttgaccacttttgaccactttccatgtatacattttggtctatgaagtagttcttattgacactgttttctacaaggatgaggttattgtagtgtgtgtgtgtgtgtgtgtgtgtgtgtgtgtgtgtatgtttgatttaatcaatcatactgtgattgtatatatatatatatgtgtgtgtgtgtgtatatatgtatgtatataggtatgagtgtgtgtgtgtatatatatgtacatatacacatatgcatatatgtatatacacatatgcatatatgtatatatatatgcatatatgtatatatgttcctagagtcatttataaataaataatgttcttttattttccttttctagatagggcctcaaaatgtatttcagtttaaccttgaactcacaatcctcctgcttctatgggaattataggtatgtctcatcacacctggttccagtttgttttattgaagctggtagagagatttcatcttttttttgaggaactgaggtttggacacagggcctaacacacgccagacaagcattaaatgctgagctgtatatcctaggcccccttttccttttattcagacagggtctcaccaagttgcccaggcttgccttgaaattgtcatctcaacctgcatctgccaccaggtctggagacttgaaaaatatatatttctcttagatttgtttatttttgtttatgtgtatgggtatttggccaatctgtgtgtatgtatatcgcatgtgtgctggtgcccaccaaagttagaagagtcatcagatcctcgagactggagttacaggcagttttaagccatcaaggaactaaacctgggtcatctgcaagagcagcgagtgctcttaaccactgagccacctcttctgcctgctgaaaggcttcattggttttgttttgttttgtttttcagaataatctcataagtctatacgatcattttgtcagtgccagtgggaaccaaagaagtggatttgttgtagcagttcagtgcgttgatataatcaaccacagtgcgatcatattcttcacatactctattgtaacttttcttgtcgtggcccagggccaaaacacttgtagtggaacactccaacatatactaagtctgcatgcttaacagattagttgacagaatcccttgacctttagaaaattcagaactgtgcaaaagcatccaccacaaagtcaaggcatagagtagtactaggagagagaattcaaagcacagcctcatgtacaaatctagtgctggtgctggggatcgaaccggggccctaagactcacctgtgctcttccatgagcttcaccccagtcccaaagctgcttatttcctactgacaccacagcggtggactgtgtccctgcttctgggtagcctgactgacggcaggactactccctggcgcagtggagttgggcagccccgctttagctcctgcattctcccgtgatggttgtcagattcactattccatgcttccagggctgcagtgaactgggagtgagggttggaagcagaagaagcagaggagggagacgatcacacgagtgaagctggagccttctgaactgacagctggctgagttcattgctttggctcgttcctgactcttcacaagcatctgccccgttgtcttttggcctggcaaatagaattcatcctgtaaagaacaagatggcgaagcccctaggactcaccattgtgggacgccacctcggagtgaaataggaccccaaatggcttggtttgaccgtggaagtgcttagttcctgtggctctatggaagagcagttccacggtcagcttcctgcagaacgagcagattccatgcctgcctctgtttcccctcatcctcctgctaaggagtgattaattcatggaaggaaagatgggatgctaaagagaggagtgggcttcactcagcaccacaaaaacagacaaggaaagggatggaaattaatgagctaagtatcttaatttaagaaattaggggggaaatgaacagaataaggcagaaaaggagtcggggagggaaaaggaagagataaaaataagagcagaagccaatgaactagaaaacaaatattcaacagagaagacccaccaaagccaagagagggtggtttggaaagagtaatacaaataaacaaatatctgcagagagtagtctaagaggggaaaaaaatgaagaaaaaaataccattgggaatgaaaaggagccctaagcacagagctggcccagagttgtcttgttttgttgtattttttaaaaaggttaagttggttttagaatgcttgcctagggtacccatagcataggttcaagtcccaggccatctttgaaggtgagatgaacatatttggatgacaaggttgctctctgtagccccggctgtcctggaacttgcttgtagaccaagctgtccttgagctcagcgacctgccgttgcctctgggttgccgggattaaagatggtgtcaccacaccagtgccaccatgcctggcagtgctaacaggtttggaaagcatagcttctgtgcttattaaatccttggaacattttccatccatcaggctgttgagcatctgaataaaacgttgtgtgtggaaacaaagcagaaagagcttaagttggatgtcattgaaattccaaatgtgtgttttaaaggacagtaccaagagcatgcaaggcggcctgcagaggaggagaaaggagttgcagctctcataaaggcgatatcaataaaacttggaaatgtccttaaaaagacaatggaattcatacctagggcaaaaacccccgatctagttctccaaagaagatatacaagtggcaaataagcctgtgaaaaggtgtccaacatcctagtctgccagggaaatacaaagaagaaacgcccaaaccaaaatcaaaaggatgcttaaggggctgaagagatggctcagtggttgagagctctcgctgctcctctagagtactggggtttggttcctagcacccctaccaggagagacacgtgccagctatagtgccatctacaaaggcagctcaggagagctggtgaggcgttctggattccatgtgactcgtacacctgccacacagtatacttgtgtgtgtgtacaccccgcacacaccaagaacacatagataaaaaataaatcatcttttaaaaagggacagataataagtgatgagctgtttcagttcctttctcatcactgtggcaaggtctttgacaaaagccacttaaggaagaaggcttattttagcttgtatttaataaggcatggtgataggtacaggagagggctgctcatacctgcctgtgctgttaggaagcagaaaatgggcacaggctagaaaaacctcagggacttggggatcttctgaagggcccaggttcaattcccagcacctacatggcagcccataaccactgtgtgtaacacgttctaggggatttgacatccttttctgctctctgtgtgcaccaggtatgcattgtggtacatagacatatatataggcaaacacccttgaatatgaaaataaaattcaaaacaaaacaacaacaaaaaaccctcaaggcccaaccccaatacctacttcctccagtgaggctcacctcctcaaggttccgtagccttactatggaaccataaccaactggggagggaccctgggttcaaatacatgagcctgtctttcaatccatagcacaagtagtgtgaagatgtggagaaagagatccttacacacggatgggaatttaaaatcgtggagccattttggaaaataattcctcagaaggaattaaatatgctgttatatgactcaactattccaaaagccccattagaaacaaagtgcatacctcagcctatttacaaatgttcatgacagtaacagccacaaaactcatatagttagtccaaatatctatccggatgcccatgaatggataaaacgaacatgataggtgtataatatctatatgatgaaaacttacttagccctaaagaggaaaggacttatatatggcaaaacaaggacagcctttgcagacataattgtaactgaaagaaactggtcacaattgtacatcagcatgctatacagtcacttataaagtggccagactagagaaaacccacaaaaggtagaaaacagattactagtaggcagagactgagggagtaagggagtgatggctaatgggtatggctttcccttttaggtgataaaatgttctagaattagataatggtaacatatagccttgacaatatagtgtggaattgtgcaccttaagtgactatgttttacatgaattgcaacttcattttatttatttatttatttatttatttatttatttatttatttatttggtttttcgagacaggatttctctgtatagtcctggctgtcctggaactcactctgtagactaggctggcctcgaactcagaaatctgcctgcctctgcctcccaagtgctgggattaaaggcgtgcgccaccacgcccagtcccattttatttttaaaaagctggagaatgggaaattctgattaaaatgtgtatttctgagcccttgcctagattcctgaagtcaaatgtttggacatgggctaatgacctgctttgatgggtgctttagatggaatgaacccacacggaggtgtaggggccagtgtctactgacagtgaaattctcgataggaagttaggacaagatgatgaccacagaagtttgtcaggaacttcctagcaatggtggttgtgagcaagactcatgagttcccctgatatcagagggtcaggaatgagcaggaacatctgcatggcagcagctagagcatctctccgtagctaagaacaggaaaaaatactgtacatgctaccctgacccagcagtctgcatcaacatggctggtgatggggtcatgtgacccagaagtctgcattaacatggttggtgatggggtcatgtgacagcagtctgcatcaacatggctagtgatgggtcacatggactccatgacatgcagactcccaggtaggagagtcgaggacacctcacttctgtgagatttggaccaaaaccactgaattttaatttgacaatgatcagacaattcccaacaagaaatattttagaaaataactgggcacactctttaggagtatgaaggctaggactggagggataactcagccatgaagagctctttctgcatctgtaacttcagttcccggggatctgctgccctcttctgagttcttcagatactgcatgcacacactgcacatacatacacacaggcaacacacacacacacacacacacacacacacacacacacagaaatatatttaagaagatggtatttgagaaactgagcaaagcaatagcagctgaaccattttgcaatttttttttcaaatcttacattacttcagattgttatttttggaagtgactgtccttgagtgtcttgaggcccactttgaagggtgtcgtgtgcaaagcctgggtttggagtcttgtaggccttatttcctcttctgtgaactgagggtcatcaggtctgtgtcagagcatcgctggagtggacaaaggtgagagcatgaggttcgaagctcagaacctgtggtacagttgcttggtaagtaagtcccagcatttcccagccatccaggaactcagagagattgtcagcctcagttcccactcccgagagagagagagagagagagagagagagagagagagagagagagagagagagagagatagaatatgaatatgaatcctctcttcggtgctggttcagcctagcaaggagccctcccgacatcctagcctagcatctaagaaaagatgtattctgggagaggtgggatttgcctgggttgatggtgcagatgccctggcaagggcagagaacactgtgggggcctcgggaaagtggcctgggctcgaggctttttcacaggctgggcttggcaggctgcttaactctgcactagctttcaaacaaaaagagtttttagacacaaaggaaggctcaacctggtcactgccaggcctggcttggcatttgagtccagaaattcaacttgtcggagctcacagctagcccaggccgtcctgatagctgtcctgcccccactcgggattgccagaaacctgtgttggagctgcagcccactcctttgctgacctgggttcctttcatcagaggtagattggagccagcgcctggggcgtggatttgctgaccacagagcctgggctgcaggcccgggtggtggtccttgcacctgtccttagatacagcctctctttgctttgcagaatggggcgtttgtgctggagtggttttcttagcagattacccttcccctagctttactgacgtgtattaattacatatatttaccatatacaatagggaattttgaaaaacacacacattttgttctctgtgtctgggggtgactgaatccaagcaccaaccagctgaagacagaaaatgttgaagagtgtagtgagcatgcagagatgtcttttcttgtcattgtcccctaaacagtacagtataccaaatgtttatgctcagcacttatattgtattaggtctgtgtactctagttgtgatctaaagtaatgggcactgtgtgtagtttctacacaagcacttcactgttctgcacgaggtgtgtgctcatctgaggggcacccaaggggatcacagagccccagggatgctgaggagaaccactacataagctcccaagcctcaccgagatataattgacaaacagaaattgtatatatttaagatatacaaaatgttattttgataggtaaatgtagtgtgattaattaacatatctgttacataattatttccatatgtggcaagaacatttaaggtctgctctcatggtgttctctttttgtttgtttgtctttgttttgttttgttttgttttctgacaaggtctcactatgtagccctggctatgctggaattcactatgtagaccaggctggcctcgaactcagagtgctgggattaaaggtgtacaccaccatgcctggtctcatagcagtcttcaggtattttaaatattatcattactatttctgcaaagtcaggtctcacactagctaagtactctaccagtctgatacatctctatgtagccccctatatattatcaagcattttcaaataaggcaaaatagatagttaatttttttcagcttttgaacatggatttttctggctcttttcttaagcccttctcccagaccagatgcgcactcagtacatatacatcaggtaatacatcacggaaaagcccctgggcagcctagagaacactcaccagaaaagagggaaaagccattaaccagtgaaatagccaggtgtctgaagagccaacgactgggcagcctcatgttaacttggcggagatcccaatgggtgcctggcacgtgctggttcaggctgtatgcaacatgttaggttgccgtgaaaaggagggcaccacagaacgttaggaatgaagggtagacagtcaactgaattgccttgcccagaaaaagaactcagcaaccgtgtttgcatttccagagaggggtttctgtctggctgtgggctgatggaggagatgattggtagagccgtagcacttgtagcactcgcagagtggattcctgatgagctgagatgttattatctttcagggtagtcacttagacttctctgagcgcgaaggctcatgctgtgactagcaccccacgtagccttgcacaacctgtttcattggggtcatgccttcggatggcttccgagatgaagagggggaaggggaagagatgtgagggaagaattaatttctctgccttgtcgaggggtgggagcctttctttggaatgaaagcatcttcaaatagagaataggtaactattttcagcttttgaacataggttttctggctttttttttttttaaagagtttgcagcacttatcaacaggtgtctatcggaggtagtggtggggtttacaagagaaagaggtctaagtatctgcagtgagcgggcactttgagtttggccagagaggagggccaccatgccaagtggctggggcatggaggggatgggggtccagctcctgtgtctctgcagagccaggctgtccatcagggacacaagcttccagcagggctgcacagccagggctttgggatgctaatggatctttagggaagctaaagggagccgtttctatcaccacaaaggggagaaatgaaggagagaaaggaattctggttctgaagtttccttaggggaaggccagacaaaggtggttcaaatggacagtgtaaagttttatctgtcgtgacaaaggggaactgggcagacatgttgccttccttggcagcttcctggaggggttaaatagctaccagggtggatcagtaaacaggggttcagtaaactcggtggctaagggcagccagttgatttgaggatccctgctggtgcccatgtaataggctccctttgttgcattcattcattcattcattcattcattcatgcatgcatccatccagtcagtcgctggcccatccatccatccatccatccatccatccatccatccatccatccatctactgactcattcattcacccactcaacttttagtaactgttctggagtgttccagaagatacaaacacaacagtggataaggagggtctctactctcatggagtctgtgttccatgtgaacaggtgtgaaggaaggatgaagagaaggaaggagggaaggaggggagggagaagggagctcatgttagtgatcagaggacaccttagatgaggtggagatggccttgcccagcaagccatctctgcagaaattggagacaagtgcaggagtctggaggtagaaaggtgcttgccttcattgagaaatagtagtatgggaagagagaaaaaagatagggagacaagagggttgacatcctgtgggcactagcaagagctaagattgcttctgagggctgcagggacttgttggggttttcaggtcagatgatctggctggaagataataggaaccaaggaaaagcagggcccctgggctggttggttgatctgagctcccgccctgcagatctggtccagtgccagtggctctacctggaggctggtgtctaagccaaaatacaactctcacctcaaagaggataagaggtcatttattctagagccaaatatgagtggccacagccttgaaacacagattcaggtttcaccaaattccatgttacaacactctagtagttttgccaagttttatattcttgtaacagagataaactaaaacacttcaaatacactggtgggatcatcagagcgggatatagagaagcagagaaatctgctgtagtcctctgatgctgtctgatgccactcttagcctgatggttggtagaagctagtggttagataagttaataaactccaaaaggtttcacctaaagttagatcaggcacagatgtgggcaaggaatggcaaataaagggctaaagagagatcaagataagttataatcaggctcctgacctgtagcatttgaactctctgcacccattgcaattctgacccgctaatcagccttccctgaactttcgtctttgtgtgatcctgaggacggctaagagcaggttgaggcagtggtgtgggccactgtccgtgatgaacatggccattcattcagctcattgggaacatgtttgtagccctggggtgtgatccatgagcattggcccagcttgcccatgttctgccctgtgagacatattgaggacagagtgctcagagcccatagggaagacttggcattgatgaaggggagcctttggctaaaattgacaggaagggtattattcacaccctggcagctggctgtagctccgaacctttactttcctctaggtgtgttcataccccagttgatttttttttctttttttttttaaagtcaatccctctaccctacaggacgcctcgtatgtgtcccagttttgtgacttgagcacattatcttgggtttaagcagatacagcagggaaccaagagaagcaaaacagtggtatcactgaggtggggagcacctcacctctttggaagcccagaaggttggctatgacgtgggtatagtttgaatgtgttgcccgcccaatgatttatgggttggacgcttcttccctgtgtggcaatactggaaggtgatatctttaaggacctatgggaggtccttagtccttaggtctttggagatatatatatatctccaaagatgatagatatatgttcttagaagggattggcttctctttggtgttctgttttgagaactgatgctatcctcatgaggcctttccagaagccaaaaccacggggccaactgcatttgtttggacatttaacttccagaactgtgatctaaacaaacctctttcctttataaaatatctaggctcaactatctcattagagtggtatgaactggactcatatagagctgctaatgagtgtgagtcttgtcagagtgccccaagataattctctgacgccaatgagaatgctttcaggtgggggggggtgcggatggggggtgttgtctgcgcacaggctgacagcaggaagccaattggaagataagtgtagttcagtagagggaggctctggccagaactggcagaagaggactgtgttgtctcttgaaggggagagggagaggcttggggactggttcaacgtaaggtcaaagagacctggagacaagaaagaatagagtgtttaatggtccagctgagagcgccacattcccatcagagaggcagagacccccctccccccatggtagtgtgtgggctgcctcacttggccttccagagccgcctatctgcaggattgttatattattatatgtacagattcatatagaaacacagttggcaagccgagtaaaggttgaatgagctgctacagcagaaggtgatgctgaagggggcagggcctgtagtgtgtcagctttttgccttctgtgagactctaccatcaacttcttccccttaccccacttctaaaagggccaaatgaccccaaggctccccgagagggcttacacaacctagtttttgacatcattgaatacaccacatcagcagtatgtaaagggagcatgacaccagagtccgtttgctagtgatcccaggtgcttgctggcttctcctggtgacctgctctccaggggcagtggtgtgactctcggcccccctcctggctctcaggtcagcatgcccacacccctgtttgcattgcgtgctcaggtattttgcattctaccgtaccttggctgtgtttttttttcttccttgttttcatggtgcctctgtgtattcctgttcatcaaacacatccattaaacttccagtgggaaggccgacttgttgacccacattgaagcctcatgattggatttgggagcccgtgtaaggaaataacattttccaggacattctgcctgacccctggaagggtagccgttttatttggtagttgtgctgaaggtggatgttcatgcatgttggtcatgttcctaccactgagccacactgccagccccataagtacagcatttatttcatctcaatcattttgaataatggtttattttttactgaaaactgcactttttaaccaacctgtcttttaatacagagttcctgagacaaattcggtttttttctcagtgactcatggccatatgtaaatattaaccattgaggcagaagctcactacatagccctggctactatggaacttgctatacagatcagactggcctctaactcacagtgatctccctgcctctgcctcttgagtgctagattagaggcatttactatcatgcttgtcctgtccactgtattatattgaatgtggtattacatggaagggtgcagaaccctatgttctgtccctaaattgccccgggtagctgagctgtaagggtgagcactgccttactcttctcatctataagaaggaatagtcatatctgctttgcagggttttttataagcatctgggcctttggttcatggaaaggattttttttttaagctcccgaaaggtacccttaaggaaaaactcagaaataatgacagcaggttgaagtaggctgggcattttccatcctgaattcttcatctgggactgaccgttttcatttgggaacaggcacaggtattagtaagctttgcgccctgcattaatctttgaggtgtgagggaaacttaagagattcatggtacagccttggaaagagcccacatcttggaaccagattgctcaagttcaagcacgcacaatgctgggtttgttaagaagctgtctgaggtgcagttctgcccacaaggaaccctgggaagagcagaacaggtatcagttgagcttcgatctgtcctcaaaaagacaatatagctgaggttcgtcaggtggatgtattaaagggccataataaaacctcattgtatgcaatataggtgctaaagaaaagccagatcagggctgtggatgtagctcagttgatagagtgcaaagctctgagttatctcaggattcaaagaggtagaggcaggagggtcagaacttaaaggctagcctgagctacaagagactgtgcttcaaacaacagcagcaacaaaacccacaaatgaagcatagaattgtagtatgatccagcaattccacttctagatttatacccccaaagaactgaaaaatgatatgcaaaacaagtaactttccctagagtgatcatagtgtcacactcaaagcggaaaagactcaggtgactaccaatgattgggggaaacaaaaagaaagaaacaaaaggtaatatattcaccagcaaaataacgtccagctacagcatggatgaacaacaagaacattatgccaaatgatgaaaccaacacaaaaggtcacatacatgagtatgtttgtgggaagagtccagaatacgcaaggataagtggttgctaggaattggaggaagaggaaaatgggtacaagttattctttggaagagattaaaccgttttggacaggagtggtaggtagttgtgggatatcgtgaatgtcctaaatgccactgtgtctcaaatggtaatctttatgttagacaaaattttacattggcttagaaggaactgatgtagaagagaagatctaagagggtgtctcaggtttctattgctctgacaaaacacgatgaccaaaagcaacaagaagaggaaagagtttattttatcttacaattcccaggtctcgctccatcactgtgggaggtcagggcaggaactcaaggcaggaacctggaggcaggaactgagacagaggcaccactaaacagtgctgtttactggcttgtttatccccaagatctcattttttattagtgtagattatttgagggttaaagaatataacagaagaaaaccagtgatctgggggtgaccatgttaactgcctcatgactcttcaagccatgagcttcaggacatgggcggaagacagctcaggaagttgtgacacttgcaacagaatgccagtttctctatccatgttgtaagcagccatcggagtttaagaaggataacgaggaatatccaacaaaggtttagagggaaatgtaatttaggaaggataaaatcgaggaaaataaccccaccacaatagtctcaggggaatgttactttctttgttctgctgtgttctcctggactgataaaacactctcacagctcctctgtggaactggtggaagaggtatgagaggggttattccaaagaccatttttcaaagtagaggactaagtggcaggagaaagatggtgtgaagaagcagcctgattctcggcatgtgcacgggatgaggatgctgaccacctagagggacggacgaggctggactttctagggaacattcatcccggagacagttgggctagaagtcgggtatggggtccggggaatggagcgggagtgttacgacagatggcaggcaggtggggcatgtccactgtgtctgggggagtggttaacccattttggcgtcaccagaggcacagattgctgagcccttctctgggatagtctggagctccagttccctggtggcccatgagtgtctgcaccctgttggctttagccgggatccagaatcagcttttggtataggaaagaggtggcacacagtggccatggcataggtctgtgagagcgatgagtctgttcgttctgatccttaatcagtctttgtatctcagttgagtcctaggccccgagactgacagctaccaaagaatctttaaagttgtctttgtgttgtgataaccccagacttttcttggaatgaagttgtcccaactctaaatgagaggtcatggcccaacagaaagacttttatccttcttcctggccggggcaacaaactagaagaatgttgtttctgtatcaaacccaacaaatagggtctttcagatgccacgaaagagttcacggactctggacaaaatgtttgaacttaggcccttcctgaaaattttaagctgagtgattgttaagccaaattgtctctcaggattttgaggggcacattgtttgagaccctcgtccaatattctgctgacgagctatggcttccccaggtgtgcacttaacacttgcttctttgcagcctggggaaccttcaaccaagggaatgagcccccctaccctcatttgaaaaggttttgaaatgctaattctcagccttgaagtattctgacagccgggaaaggtattcagggcaatcaggcaccttgatgattacccggtgtgaaaggtaaattgctgctacccaagaagtcacctgcttttcaagagaaagctctggaaaatagctcagaaaattgcaccgcaggattactgcatttcatgtaccatgagatggggccatctgacactccggtgtatctgtgggtgtgacagtgtcagcttgtagtagagatttaacagcgctcaccagcttgtccttgtgtttaaaaaagaagaagaaaggaaaagaaagagcaggattgtagtgaaggtttccaggttctgttataagcctatttaaaatctgaaagcgcatcttggctacttactttccactgagaaagcccgacccagggaagaaactgtcagtcctagggcttcccccacctctatctatcctctgtgctgagggtggaaccagcccttggacgtgctaggcaaacactctgtgactcaacttcacccttactaagcctctcattcatcggtttataagtatcagaaagctttgtaattttgccacaatcagcacaaagtggcatttctttttggcccaaagtgaaggcaggatttagtccccgttccaaaagtccacactcagttataagaggctagttcaacaacaaaagcagactggtgcatatcccgtggaaagagccattgacaagacagatgagtacaggaatgaattttcatacggggctttgcctatttgtttgcctatttgtcctatttgtttcttcagtcattaaataagaatacagaacaccctggtcaccaaggccctggctccctcattagttgcttgcctgctcaaggtcagtcctacctgttaacccacctgtccatccatccatccatccatccatccatccatccatccatccatttctccatctattcatccactctctcatccatccatctgtccactcatccatctatctggcctggtcctcctctatctgacccacacctgtttggtgaatctccttaggattctcttgactctgactctatagccgtgccatccactcttaactttacatgaagccatgtggggcgggctcacagttttacttctggtgctagcctgtcatctgggccagatcccaccagtctcacctcatcttgagtgtccttctagtgggcatctcaggctgcccagaccagtgctgggagagccagtgtgaccccactctcacctcccgtcagctcattcctgagtctggttagcattctcatactcagtctgtttcatgtctcttgaaatgccaccatcactgtccacctggaccactgtgggcccctccctgggctcctgtgtccacaagcaccctggtttggtccatttcctgaagactctgatacactgtataaaaagaaaaacagcatctgtaccttcccctgctcccatcatgccataaagcagccataccacctccccaaggccgttcctcccattctcctcactccctgagctttctgcctgtgactctcctctctttctgtggatgactctttcttgttccttaggttttgattccaatgcctcacttagacaggcctctcctgaccctgcacctgccatgttcatagcctttcagtatatgtacaagacgtgttcatgtatgtgcatgtgtgttcaggtgcatacatactatgcttgaggggccatgggtttacagtgggtggctccctctctgcatttgtttgtttattgatggggtctctcctggctggcttggaacgtgatataaactaggctgactgacctcaaacttgaagagagcctgggattaaaggtgtgcactatcatgcccagccttcccctttgtttttttgagacaggatctctccctgaccctggagcttaactgattctcagaaagataagctagacagagggcttccgggaccctcctgcttctgatgcttgcacgcgcatgcgtgtacatgtaagagtggtggaagactggggtgccagtattttatcttacattgtcagttcaaagaaaagcaggaaagctttatttatttactagagacaggacttcaaactggcttggcactcatggcaattctcctgcttcggtttcctgagtgctgggaatacagagtgagtgcctctaatggctaggaaaacttaatttatacagattattatagttatcagaactgattataaatgtataaactctttattcacccttttgctaaccctagagtctctgctagaatgcaccttcagccctgatcccattcaagtggctacagtaaggtttaaactcagcaacaatgtcacttggaaaagaatgcagaattgtggacactctactatgggttagtaatgcatgaaaacagatacaatgtaacacacataaaacaggaatctctacaacaaatgtacagaagggaagaattgaacccaccggtggcagaggtgctgctgtaatgtcgtggacagtgggatgtactcaggatgactgttactgtgtaggactgagtgtgagcgaataatgcatattgagttttagagagacgtagaaggatgctgaatatttgaattgaggctcttgctaccaaagggtatcaattttcattgtgttaaaagtatttgccagtgataatgtacattttctttaaatacattctagatgcatccatttgtacacccatcgtgaatatatgtcgtcaccatctttgtgattctttctggtatattttcaagcccaagtcctttggcatggaagataagatctcgatttctctccagccaaccattttcctatccatatcagcccccccccccatcccactttaagtttgttctgccttggcaagggcttgggtctagaattcttcaaggtatttctgtctgtctgtccctcactggtgagataggggttgagattcctgacttgatgccaagagccaaaccatcatttactgttcaggtactaaagccacccaaccactcctgccccccagagcttggggctgtgtcacaatgcctcagtgcctcccaggacttccagcccactggggatacttcgtaagtgtttattaactgtgtgagtaaacagacaagttgaaaagggtttgtactcctttggcgtgaatagaggtcaagttatgttctgcttttttgttttttgggtttttttttttgctttttgtttttttttgggggggggggttataggctgtgtttcatttgagacctttgggagggaactactaatgccttcaactctggctaggccttagactctggacatctttccagccctctaagtttacatgaatgaacccacctgtgcttaaagtcagaagctgaattttcctctccgtgcacatagtttctggcttcctggcggcttcctccagcctgtgtggacactctgtccctgggggatgtgtggatgggcttcacaatcccgtgggacgggggctgccgaagcacttcactcagctattgagttggaacctcttaggcaatgagatctcacttcccctcctagggattttcctattaaagtactggaaaaggtctcttctactagtttatagtttgggaaattaaaaaaaaaagtgaatggaaattaagttttaaggacatttctttttggtcttctgtaatgatcagtttaattcccactttattgactttttgttattctaaaggagaaggagaaggaacacttttttcccttccgatttcgtaattaggaaacctccacagcctctgcgcacaagctattttggtgacctggattaatcactttcactgtgttataaacagaacagtggagccagcgaggtcatttccttttccaggcgtttggattctgagcatcctcctcccttccacttcccagattcctcagcttgggggcctgtccccgtcttcggctcacagatccgatgcctcttgttcccaactgtgatctgaggacagagtcgagccacaaagcaagagtgacttgaactaaaagcagtgaacctggagagatagcttaggtgttcaaagcactggctgctcttgtagtggacaggggtctggttcccagcatccacactggacagtttacattgcctataattccaggtccagaggttctgacaccctcttctggccttcttggacaccttcatgtaggtaatgaacacacaaatgcatgcacagacagacagacagacagacagacacacacacacatacaccaaaagaatatgaaaaccaggagaagacttgctaggattcccagttggaccaaagaaggtctggcaaaatgggtctccatttagctaagtacttgaacttagtcccaagtactaagtcctccttatagcctactatgtcctacctttgcctctctgggtgatcatttgttaaaacccagtgtcatgctgtagaccaaaggaaacacccgtaagtcagataaaaccatctcccaggaagtttgaggggtgagtcaggggcattaagcgcccttcctctttggaggctctagagtctgatggggtcaaaagttgcccctgaaccccagtctggcttgaaggcctaatactccttcaccttaatttaactctgtgactctggacaagcgtctcagccactctgtgacttagtttctctgagctattaggaacatttttgtacaatgattctgtagagttaagctgccaccaatttagagttcagtttaatattatttatttatttgtgtgtgtgtgtgtgtgtgtgtgcatgcgttttgctggagatagaatccagggccttgaagtctgtaaggccagtactccactccttagttacatccccagcccctgaatctcacctttaaagcaggatgtacctcaagctgcaaaactatcacctgattgagtctggcgtctgctctctaatctaaacctatctagaagcttggaggagctactttgccttactctgcccctaaccactgtaccctcctgccatgttgcttctcaccaggcctttttttatatccctgactctctctcacttatctctccttcatgagaaatttctagattgagagaatagccatagaaggctatagtatgacgagcccagctccccctcacctccctcagttatttgagggagcctgcttgagatctctggggacacatccattttggatgtaccatggtggagtgagcaccggtcagggtgaatttctttagaatttctcaggcagtccctgtaaccaccatgctaagcccctgacacggtccaaggctcgctctaagcctgttttgatcactttcctaatctaatgatatttcttcacattcttggtaattaaactctgtaatcccttcattcggcactgtttgacctttatcctaaattaaatttttaaaaatatgactttaaaggaatcccacaagacgtgtttgcagagagaaaaaaaaaccagtgtattaaaaggaattacagtttctaagtctcagactgactcatgccagccttgggtcagttgtatagcttcaggtggctactgtgcccacctgcctgcccagagcggtgcagaaactacccataagcttttctgctgaagccttgaatggagcctgggagtaagagggaaataataccacacacttgccaatgccacgtggtgtttccctgcgctttagaaatggattgaagtcacgttcagggcccaatctctccgggatgcctgagacactcctctaagtcccacgtgaagtggatgctgagtgggcactggggtttgaccaaaggaagagggcacgagaagtggccttctgtagcaccacagtacccacatgttctagatccctgcaggggcaggagaagctgcaagacttgaggaagtctaaggaaacaggcaggcctgagagcgtggggaggagtctgggctagcaaagggctttgaccttcttgtagcccagggctgacaagatgcatctgaggccaggacttcatggggagcactttcccctggaagccatcattttcttggggtccccacatggtccctcaccccagctttctagcttcatgccagcacccgccctggtggccgtggggcctgggttatttgctgttttttcaagtgtacaccacacccttgaactgtctgccaaggaggcgcattgttcgtgagaattcctcccaggctccagctaacccttagatgcactattctgggcttagggtcctgaattacttgtctttctttctttccccttttcctttcttccttttaaagtcttcccaaacacccccctcccgtattcttgccttcgcctaacctagtcttcttaccaagtttcatcttattgtctaaaaagcttggagagatgggcggggctgcaggaactgagctataatcaaagaggccccttgacctggtctgcacagccactcttactcctggccctggagaggaggcacggagacccctgagctatgaggaaggagtatgggcaggtcccctggtggctgtgtgtatatatgcgcagctgatgggaggtgactggggggcgcaatggtgtggaagagggcatagaacgtaggctgaagaatgaaaaccagtatttccctcagaacagagcagattaacctgtagaatagaagtcttgccaaacccaacttccttgttcccagaaaccttggcacaggggcccccctctctggcagaggcccatcctcatcagaggaaccagcaaggcagctgctgtgagtttctttcgcctgtcttttctggcaaccccaaatgcttacttttttccttcccttttccttccccaccctcctgtagcagggagttggttctggttaatgttgaagatcataacatgattaccctaaagtctcatgaaattaaatcacttttcttcaaagagaaagggcttggggaggggactggctggctggtaggccagtgaggggcgagcggatattgaaagcaggctggcagctgcctggagctctgcttagcggaggccaacagaaccagggcagccacacatgggggccgtgtttgccagcagtggctctgaggccttgggttgcccacctgtgccctaggcacctgtctcctgagtgcagggtcttggggggtgggaggtgagaagcagagttggaagtgacagcgggaaggaaaagactcagggagatgaacctgaaggatgagtcacgggggtgtgtgtggaggggagtgggggggggggaaggaaagcaactctaaataaataccctagagagttctttatcagcagctgccctgggaattcatagggccacagaatgtatctaaggacagctctcctaccagaaaagcctgcgattgaaccttagcccttataggcaaagcactgcttgcagaggtaggctggggcaggcatgttccctttatcatcagatgtcctggatttatgatatgttacaggttaagagaaccctgtaggtcatccaacatcagatgtctcacaaagtatattagtctcctgtgtacttagcccctcaaagaatacccagcttccattccatgccttctgggtatgagttctctcaaagtccttctgactgtccttcttggagagactctgggacttatacccattaatccaggttttacctcttggagacaggaaacagtggcctggcttgggcaatgactggtttggaaagcgctggctgtgggtgtggctttgtctttgacatgtgggcatcctgtggaggttctcacaatgagtacactgggtctgacatctctttgagtctttcccgccccctttctgggctagtatttcaaagggaacataaagagtgatttcaaaacaagaccaaaaagatattttattctattactgttgacccgcagcaccctgagctcttgtggggctagtgcgcatctcaggaggctcggactggatggatctgtgagtcaagatgaagtagcaagtaaaaattgctgctagcacaagccagtgctcccactagcacaagccagtgctcccgacacaggcagtggggtgaaggtccacccgagaaagctgtggggttggtcacttgagttagaaagctagtggtcactgcaaggagacttgacatcggcggggtggcttgctatgaaaagttcagcgagtgcatatttctgagggtttagggatgggatgtggccagctccggttggagctcagcgccgtgactcattctcaccaagggtcaccgagcatctttctgcgcttggccttgggctgaactcctcacctggccagccttctcgaaactgtgtgtcattctttgcgaaggcagagccttggagcctgtgagtgagtgtgcgcatcagtggaaactcaaacaactcccaagttcctgtagttgttgccttcagaggtgtgactgtgaagggatggagcccacttcgttgtttttcacaaaacagacccggaaggataggtccaaatgaacatacgtgagtagccaccttgggagccgaaacacttcttccactggcctggagagctgttttatcagctccctggggaaagctggtcttgttactttatagccacagttcatttttatccaaaaacaacaatcacccaagcccgatcctgaagtctgctcaccagatttgacacccaagggttgaagctggatgttagagtcctgttcaggtccagggcccaagagcaaccaccatctggaacattcagaagttcctgaggccagctcccaaacacaagtctcagaagggcttttggcagcagtgatgctgttggcatccgtgagcagtccttattctgccttcccaacaaggcagagatctttcctgtagaattgtctaggtgtggatagtgacgattgggcttggtagtgagttagccccacctcgctgacgtcgggcctagttgcccgtgtacccaccccatgcatctgcagaaccacacattgccctgtggttttattggcgatgatctgactttggcagtcgcctcctgtgtaactgacctgccaccatcctgggtagggtgtccctgagaacccaagtggcctgggtctgggttccatgctgttggaggtgcactcttgctttgtgtctcttcccttgcacttcatcttgctgaagatagccagtgtagaccgtccttaccttcctgaacttggatgtctgtctggaatgtcttggctcccagtttagagtcactaccattatatcacccacaccacggagcaggccgaggtgcattctttgttcattgctcttgtctgtggaaggcatgggtggacagttgggtgggtgtggacctggctgggctttccagttctttcctatgtgagacttcttggaattaacaaagaagagaagaggaaagaattgacaacagctagagatgcaggttctccgaagtgcagacagccagcccctcatctccagctggaaatggaaagattcaacagacagaaaagagatggaagtaacgatgtagattttggccagaaagagggaccaggttggggctgcgtggtttttgaggagccagcccagaagaacaggagttcagataaatgagaggtgagcaagagggctgccaggagcaacagcacagcggaggtggggcagcgggcggacggtcagaaggcttggtttccattcataccataccatcagctcatgttggcacttggagcaaatcctgtcaactgtgggagcctcctgtccttgcctggggaatgcagataatctcccctagctcacagattcacaagatggttgtgaaacaagataggactcaactcattggctaatgtctaccctggccattgtgctacactgccttttagggaaatcctctggagcacacaactaggcctgtccacagtcagcatggacaagtgacttttttttttttaaaaacaagccagaacatcccatagccatacattgtttctttgatttttttttccttcttcttagtcatttttttttaaaagacagaatcccacgtgtaaccttgattgtcttggaactcatgattctcctgccttaggctccatgctgggctaagcatccctccctacctccagcgccccattaaagacccttgtcttcctctagtaccttctcactcatatagcttctaaaaggaacagtcccctgggcagccatgttttctggctccaacccacccatcttcagtctccccacagttgactactgaaactaatgtttatctgagatttctaatgatctccagggctaatctaacgacctgccacctctctctccttcctctctgaacttccgtcccctggggctttaggagcatggcctttctccgtctccgctgaggcctcagccatctccctccttgatgcatccacctgttcatactcctggaatgggcgtggtttgaagtgggctatgccattcaccagctcctctgtttggtctctgttgtggtagtggtgccagtccttcctcatgttctagcctttcttggaacattaaaattattatcttggggtgggggaacatttgtgatgtaaataaataaaatagttaaaaaacaaacacaaattgttatagttaacttagaactcttgaaattacatctcgttaaccaaaatatactttatttgaagtctgctctccttttcccagtgaaggtaaccaaggagtccccttcttggtctgatttgacccctcggcccactggctagcattattgactactctcttgtgacatctcatttgcaccttcccatttaaattgccaacacctgagcactgttcagttatcctctatactggtcaatctatacctctcctcccagacccacctgccctacagatccatacttggtaacagtataacatgtttccttttctgtgaagaaaatgcccatggctgggtagtctataaagaacggccacttcctctacttgctagtcaagtatgctaccactctactgaattcccagccccacggtaggcacttcttcagctcatgcttaggagtgtgggaagtttaggagcatggcatggcggctgcacctgctgtggtgtctggtgaggctgcgggtgtctgtgttttataacacagtggagagcagcccccaatgggaagaaccagcaagaagcatttgaacctcttctaaagcaactcatgcctccactctcataacctcatataatcttaatcacctgcaaagctccccctcacgtaccattagcatatgaatttggggattaaatttctaatgtaagaaaaggggcacattttaaatcagggcaggaaacaagcctgctagtgcacagctctggtggtcaggcctgcctctgtcaacataaacatatttacttgttttttgggtggggaccattgatggcagatggtagacttatgagtgacaggaagcgtcagtgctagctgcctagagggaaacggagcctctgtcatgtcccgtccccttcccgcaaccccccaccagctgaaagcaatagctggttagataattgaataggtcaggtgaatatttgaatattcagattttggttgtttttttttttttgttttttgttttcaagacagggtttctctgtgtagccctggctgtcctggaactcactctgtagaccagtctggccttgaactcagaaatccatctgcctttgcttcccaagtgctgggattaaaggtgtgcaacaccatcttggcctttggagagttacaatgatttgtgtaatccagtcaagatgggtcacgttccctgggacacaactgatcaacacaggcctttcttgcctgcagaaactgatgcacgaatgagtggggcccagtttggtatgatgaagcatgaggggacattggctgcaggctttcataaaataactcttctaggcttgggaggattctggaagccatttctccagcctcttcttttatggaagccatttctccagcctcttcttttatggaagccatttctccatctttttttgtttgtttgtttggttggttttggtttttcgagacagggttcctctgtttagccctggctgtcctggaactcactctgtagaccaggctggcctcagactcagaaatccacctgcctctgcctcctgagtgctgggattaaaggtgcgccatcacgcccagccagttttccatcttttatgggtctagagtctgaaactgggaccttcttttgtgcatgagggacacccaccctgatgacactcggagtgcaaagacttagagaggaagatgaggggaaactaaggtggagctgcctgcgatgatctcgtgtgtttcaggaccctgccctttaagaagcccatggagccaccgctgggttgctcccaaagacaacagcggtgtctttgtgtgggaggacatggaagccagggtcaggagtactgaggattggggtggttctctttttttgttcttgttttgtttgtttgtttgttttttcaagacagggtttctctgtgtagccctggctgccccgaaactcactctgtagaccaggttggccttgaactcaaaaaatccgcctgcctctgcctcccaagtgctgggattaaaggtgtgcgccaccactgcccggctccggggtgactctcttaagacaatactttaaacaccaagggcactggacgtgcttccaaaaggttaatgtagcaatgaagaattgttgactttcaggaacaggtgtattgtatgagcaaaacacaaatacagcccgctctacagacatattgggacagggagagaatgtttccgcaaaggcacgggaggatttgaaaggaaacagtaacagcaataaaataaacaaaaaccaaaacagacttaaacaacaacaataacaacaacaacaaattcaatacagctgttctgtctagtcactctgtgggagggacactcaatccccgaactgtcaccattccactttagaaacaagaccctgtctagggctggtcttggagggtgcgggaatctgccacggaagatttccatctggggaacagtattccaagagcagtggcttctttgctctgccacaccctagggagacctctgatagtgcgagacttgcctttggggctctctagcttcaggtcagttctggtgctcatggggatgagatgcagcagtctgctctccaaccttgaccagaagactacaaatgcaagcactgagcacagtgggcctcagtgagctgcggattagttcctgtgacctagtgcccccagaagacactggctcaagcggaggatgtgtctctcacttaatggcagggaggtaggaggtaactgggtcacaggcagctgtgttccatgatgttatcctcccaaaagcagccatccttttttcccctattgtctacccatcctctggggtgtgatcctcttcttctggtcaaggctcattcaccatcggccagcctttactcctgcctgccaggacagacaagagagagggacagagtgctgtttccttggagggagtgatacggcagtggtgtgtgcatcacttcggcttagttcccagtacctcaaacttcaggacatggctgaagttagctgtagagtgccctacctgcatggcctctctgtcatgaagccttagttcctgtctctacagaacaaggtcctccagtcctaacagttctcagccacaccctgcccccactaaacctcagggctttcatccacatagtggaggaagttaaaatgcctatcacagtgacacaagggcaggcgagagctctccctgcatggttcctggaagagagaggcactcaagtggtagctgtcagtcagccagtgaacaaagagactttgagggcttacctgggagctctgttctaatggggatgcaggggtacactgatcctccccatctaacctctctttccaggttgtctctcctgcagcacacaggtgtcaagccaggtctctttgtaagaagcaagggctcttgcagacagttgtagaatgaaagtaaggtcccctccttccccgcatggtaatttatgaaggtcactgagtaaattcattactcatcaaagaaaatcacttgttgtctttgttctttttgtgaagtccgtccccccccctaatagcagcaggtgaaagtaggtaaaggcagacaagctgccatgccataaataaaaaccaataaaccaacctggagagacggctcagtggttatagcgcttgttgctcttgcagaagacctgggcttgattcccagcccccaagaggaggctcacagtcatttgtgactccagtttcagaggcacacacagagaacacatccaggcacaggcaggcaaagcacacacatgagattaaataaatataaaaaataaaagctaacgaacaaacgttgaaatcacttagctagtcaatgtgttggtcagggatggaccatgtgtgtcatgatgatctcaggaagtcctatcctccaatgaggatgcaaacatcttagtgtgcccaggtcccccgtgatgtttgtacagtgatgaaattgcctaatgaagtagttttccaaatgcatcctctgtggttgagcaatatgtgactaaccccttaagcacctgtctgctatattatggaaatatagtagaaagcaccacagtcctcagaggaacccagtacagaggggagcacgtgccagaggttacagtgtagggagacaggtgacccaggagggactcaaacaggtgctgtggcgctggagaaatagaaaacagagccagttgtgaaatcaagaaaggcttcctagaggaaggagcattattatcatcaacatagggacactgttaaacatggtcattatcacgtacaccactgccatcaccatccacggtattgtcattgatgacagttgtcgttatcactatccatcaataccaccaatataatcttcactctggtcactgagcactttctaaatgctgggcattgtcttctttaatccttaccctgacctcaggggagcaagtagaagtgagaacgaggctcacaaatgttaggcaattggcgcaaagtcctacagtgatcatctcagtgcggctgaagcaagaggtaagagctgaggctgggcggtgggggagggctgtcctgggagaggtctctgcagtggaagtgagggtgggatggagccaggttagcctctggatccatcttgatgacaacagagagaagctactgagggttttcagggggaggggccaggactgttgaaggatcaccctggttgctcagtgaccagtggagctgaggacagggaaacttaaacaggagacagtaagtcgttgtagcatttgggacagtggctctgaagtacccattgcctcctttgcattgggagttctgagtggggctgagagaggagaaagcgccttacctgctaggtggaaccatccttaaagctctctccatgtgttcattttcacaaacacccagaggatgagcagatctacccaggtcatagatcaagactggtatagttgagtgttcttagcctgtagccaccaaacccaggcttgtggtccaggggtagcacagtttatctgagcatgcctctaaaggctgagtctacccgactgtgtcagggtggcagagaagactccttgtgaatcctgcctccagggatctcacatgctacttgtaacacaaagtcctaggtctaccagtagactaaccgaagccattttgccccaggctttctgctgttgtctgcctccacaggattcaaccgggctttcctggagggcaaagcttccatgtccagtgataagggacacacacaatagtattcagtgagtaggccaaaatcacagctcctccagactggtagctgggaacagaccactctgtagggaaaggcaggagtgcggagaaataagaaatagttcaggagggcctgtgggtgcctgagtggggcatgtggcattagtcagcctccagggtcttctggccacttctgtgacttagtgtcatactcttgacaattttgagggcttcctaatgaattgggacacaggattctgggccctgggcctggcaggggtcccagctcacctggcagccctgggccagtcttctgtctctgggccccagtctcctctcagtgatcagtatcccccaggcacctagcaccccagtgacatgcgctgcttaggggcgggcctcgggcagatgagtgggtgacctcggcaccactcctgggaaggtcgtacatttgaggactgagaccttggggcagacccggaacctggaacaagttcagatgtcacagatgggggatttttctgcatcaattatcttctttgcgggttgtgggttttcagacagggctggcagcttggcccgagccacagtaaccatttctgagctggctggggacacagagtggaggacctcggggtggagaaatctgtcctctcccttctagtatcaggagtttaaacggttccaggcacagagaaacaggcgttcccccgagttccttatggcgaggcaccatgaaacccttgcacctgttcaccctgtgaaacatgatgtctggaccacttaagtggctgcctttactgattaatttctcagcaccatgctggaccattagtgtggtggtgacagtctttgtggtggggagccgagagaccaggctgaggaacccacctttattattaaggtagcagcatgcactttggctactttgcagttcccacctctttatacctttatattagagccatgtcccaaatggccaatttcttgttaatgagacacagcatgttttaccagaagatgctcccagacgcccccctcccttttcttaacccctaatgagtttctcactgctggacagacacatttcggtcacccctttgaagaactactctgtgcatccacttagtgttcttgccttctctagaaccttctgctgcactccagcttgacccctgcagtattggagacaggccacctggtcccggctgtagtcatgtgccttccatcatccgtgtccaagcaaaggtctcatctccctgcccctgccccactcttcctacagtttacaaggagtctcggctgagcatagagtagaatttttcagaggcaccgtaagctgtgaagccacagcagtggaatgaccaacccaaatgagtcccttctgcgctttgaagcatcctctccttgtggacatttgaggacaaggcaggatgctgaggccccgggggcaggtctggctgtgttggcagagatgctgtcaatgctggactcctcccaccgatcagcacttatcacctttctgtaggaactgggccaccaaacctaattcgccttacttggcaaagtaggttaggactgactgagtgaggagagtcacttagtgcctctggtaatttgtaagtgaaagggtgggaacatcccccctttcttcgtgcccaaagcagcttctggggaccttggtgtgactggcttcctgtggcctgcctttgctggccctctctctgcctgggtacagaaaccaggccaagtgcctggggaacatttctctttctgtttcgaggaggggagaattagaaagtcaaattctgctctcatccaggagccaagagaagggagcaaggagcaagggacctgagtaggctcagctgtactttggggtcttgcccaatccgagactgctgggaaccaggaaagggggtggctgggagttaggcagcctctcggccccttcctgcttctcctgaaggacgggaccctctgtccccatctgtcatgagcctggggtatgtaaagttgaccagagggagatgggctgaaaaagagccagcctgagaaaggcttgggatgccaggttgagactgctgtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagcgtaggtcatgtctcactttctacagtagggcgtcaccagagaatgagttgcctcttgcaactttctgtccccggacctgcaaagcagggagggctactcctgtcagagctttcccgttatgtacgctgctgtgtgtatgtgtgtgtgtgtgtgtctgtgcacgagcacgcatgtgcgcacacgcgtgtgtgcgtccctgcagaaattaggaaagggtattagatttgctggaatcacaagtggttgtgagctgctggaagtgggtgctggggaccaaactctggtcctgtctgagccatttctccagcctgttatggtttttgtttagttttggttttgaaccaagatcttactgtgtagttctggctggcctgaaactcactatgtagagcaggctggcctcaaactcatagagatctgcctgcctctgcctcctgggtgctaggattaaagatgcgtgccagtacgcccagcttgtattctttttaactgcggtaaagctgagcgcacacacacatgattttgcttctctattcttggatgcatggctcagcagtgttagtgctttgacatcgctatacaaccatcaccaccacccaccccagaggcttttattgtcacagagtagggagagccctgtccccaacagacactcactcctcagcgtccaggccctaaccaccattctgctctccccatctgagtcagactatctggttacctccttaaatgagtggacagcatttatcctttggaaaatggcttacttcactgagcacagtttcttcttggctcatctgggtacacatggtatgtgtcagaattcccttcttaaagccaaataatctgcgattgtacggataacccatattttgtttattcattcatctgtggacactgactgctgtaagcgatgcagcagtgaatatagatggacccagagtttcttttaaaaataacttttaagaaatgttttcttgtttcagaagtgcattcatttgaaaacatttagaaatgtgggcaagttaaaagaaaaaaaatcacaccttagttcattccttggagacacataatatatattctgttgacattttggtaaacagattgaacattccaaaaatctgaaatctgacatgctccccagtctgcagatgtttgaatgctggcatgcgcatgctaccacaagtggaaaattccacacctgactttactctacaggtcgaagtccgaatgcaggtgtgcgggcatggtggtggcctgtttccatcatttcagcactttgagaggcaggaggatcaggagttcaagatcggcctcagctacttaatgaactggaaaccagcctgggctatgtgagaccctacctggaaaaaaacctcaaaccaaggagctggggagctggatctacagtcaagagagcttgctcttcttgcataggatccgagttccgttcccagcatgcactttcgggtggctcacaaccttcctctggcctcatatgtatataagtaaaaacaagtctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttagtacatacatatgtatgtgtatatatatatttgatttttctagaacagggtttctctgtgtagccctggctgtcctgaactccctctgtagaccaggctggccttgaattcagaaatctgcctgcctctgcctcccgagtgctgggattaaaggcgtgcaccaccacgtccagccaagttttttcttttaaacctctgtctttggtgtcatccttcccatactttacagttatgttatagacatgtgcctaccttttcatttgctctagacactgtacttcatttttcatacttatatcttgaatcctaaaatgacctaaaacctattatgggctggaagtccaacctgttctttctttatctgctcttccttgtgctgaatgcttgggtctgtttctggagtccttcctgtctaatgatagaaacctttgttctttcaccagtaccacactgttttaatattttaattagttatgaataatcatggcatgaatcccatgattacagaattacttggcttggtctcttgcattttgtttccaaatgaagtttaaaatgatctggttaacttaaaaaaaacaaaaaacaaaaaacaaaaaaactcctccacgattctctttgaaattgcattgtgtacctaagactattgaaggatttggaatatttatgattttcaattttctctggagagtcaatgtccacatggttttctgaggctggtttctgtatgctttgatacactctcatttgaagaatggtcgtttccagatgtcaacctagggaagaagcaattgttacagtttttatttagtaactggcctgcttgctgcacttaggggcggtcttgggtttcatagtcagcaatgacaatcctatctcttcctttccagcatttctgtcacacattatcttttcttgtcttattgcattggctacatcagctagaacaatttccagtactgggatgataccatgcctccttgtcttaattttgatttttaactgtaatatttccagtgcttctgtttttttctttggccttacattgatttttcagaggcattattaatacatcatctaatactgccttacagtcctgtggccaggaatcaatggattttccacatgtatttgatttgtgggggcccccaacctctctctccctttcatcctctctactttcatttgcatcgttgactgacacatcctcgtgtctctcctctcacccccaagctgtctgttatcaattacttctacttccaagagttatccttccccccttttttctttttttctaaactattgtgttaattgaagccataattcacagacgtggaaaacatttcaaacaccacagaagtgaaaacgcaggcacccagactccaaacactgtacagcgttctccctcctgtgctgtgtactttcggcctgagaaagtcaacctctggccttctttgcgctgcgttccgtgcacacagaaggaatgggtttcgcaactccagacactgcaggtctggagatgaggttggtaccactgtctggcctgcatgcattgcaattactactgtcctcggtcagtctcatcagcattcggtgcagatttatagaaccgcgggacccttggtgatgctgtcccaggcgccctgggatatacctgtacaggtaggaaagtgttcctctcagagtgaactgaagcagctgagaagagacaggtgcatggactaagtaagcatcggagggtaggtaggagcagactcgctgcagtgtgtgctgcacagtgcggaagctggcaacagaagtggctagagccgcaggaacaggcaagagcttcagggagcagctgtgtccacaggatatgggctacagctagggaactttgtgagaggaggctgagccgtctcagacacccctgcacgaggagaaaaccatcacccttagttagtgactaggatatggaggagagaccgtagtgagctgctgctaaagactaccattgagattgacggttcatagacacttcatttctctctctttcccctcaggcagtatttgcttttcacctttgatgctcatttctttccagctctaagaacaatgtgttaattggggaaatttaagaaaatacagaaagagaaaatcaatctgaaatcttccctcccagggaagatatcgataacattccagcatacgttattcctggtattttttcctactttttgtacatgagttcttaaatggaattacatacattattgtgtgtatctcctcagtagcctaggaaaaaattctgaattcaaaatgcaaaatgtgtctcattttctgttcaacacaaagctgaaaaatacatattccattcattgtaagttggggattgtatgtgaattttttaacctgtgtggtatttgcctttttatttgtatttgtggattttggtgttttgggttttgtttatttgtttggaggcaggatctcatgtaacccgggttggccgctaactaattaaacttcttcccaggggctgggattacggcatgcgcttgtcacacctggcttctcactttttaaggcagagtctcatgtagctcaggtgtcttagttactgttcagttggtgtgatgaaaccccatggccaaagcaacttataaaagaaagcatttaattgggggcttgcttacagacccatgatggtggggagcatggctgcaggcaggcaggcaggcaggcaggcaggcaggcactgaacaagtagctagcggtcacatctgtcttgcctacaaacagagagagaaaagagggagccagtctggcacagacttctgaaacctcaaaacctacctcctagggacacgccttctctaacaaggccacacccaatccaacaaggccacacccctcaacaaggccacaccccctcaacaaggccacaccccctcagcaaggccacacctcccaatcattcccttacagttcctgtaacagggagccaagctttcaaacttatgagcctacagggtctatccttactcaaaccctactccaagcctgcctcaaaaatctctttctaattgagggtgacctgcagctcccaaagccttctgttttacttccagagtgctgggatcacaagcatatcacaccatacctcgtagtgttgttttgctttgttttaatctgaagagcgttgttgtttttaaattcagaggtggatttttttccccgtcattctatgaattagttagtgtctgtgatggtttgagagtggcactattaggaggtgtggccttgttggaggaagtatgccactgtgggggtggcctttgagatccttctcctacctgcttggaagacagttttctcctgtttgcctttggaacaagatgtggaatccccagctccttctccagtaccatggcggcctggatgataatggactgaacctctgcacccataagccagccccaattaaatgtgcggcttataagagttgccttggtcatggtgtctctttacagcaatggaaaccctaagacagcatctttctccataggcttttcctttgtcattctattgcgaggctgcaacttttccagacagttcttttcagtgtgtttgctctttgtggagacctccctgccagctgttgcttggagccctctcatcatctatgaagcttcccagatcatctattaatgtcaacatttgctctccatgtgctgtggactgcctgcatttgtgtttagggtttattgaaagtgtttgtagcattcgcactgtgttcatagactatataagctgcctgaggtctagagctgacttacgactatgattatttatcgcaatgcttagtgcatagtaggacctcagtaggtagtgctggatggagtccgattgagtttgagtggactgaaggattgaggagcctcagaacaagccgggacatggctgtctgttcttcactgacggcagaattctctgaattgtttgtggtgtgtcctgaggaggaacttgttctaaagaattacacatttgtgtttatggcattgttggctttttacatcagtcattgccagcccagtgacatctgacactcttggcaaaaggcttggtccctgggacactgttataagcacgcatggtgagtgaagagcagaccagctgtgtctgatccgttccagggaccctggcggcaacctggccaggtgggtagagaatgagcctccactatcttacgtaacaactcggtcttgattccatcagggctccagctgggcttcagaaggagttgacacccctgctctttgtcatcttgttgggattttttcaacctgtgcctaaatcataggagggagtatcaaacctgaccaggtgcttagtcaggctctttagtcatctggcaaactcaaataaaagatacaaggcactgcagagtaccccagacggagtgaatacttctgatggagaatatgaagtgcgggtgaaatgcacttcaggccaggccagtttgggaaaacagcttggtactgtctactaatgaccccactcctagatgtgtgtctgtcaggaatgtcaatatacgaacgccttccagagacatgtactgcagtgtttgagacaatactatgcgtgacactatgtacaaatgtcctttaacaactcagcaggaaattaagtggttgcatatcatatagcattgttatacagaatgagcaagtgtataattcataaggacacacgatgcttggttaatgtagccagacagggactgtgtgtttccactatatgaagtgtggagacaggcagagctcgtgtatgttggaggaggcaggaattcggttactcgggttgaatggtggatggtggtagaggctcatctccgcctcatacctgtagacgagtgctgtatctctgagctctacctctctgtcagtccagggctctggttcttatccggatgataattcctatggatgggttccatctgtgaaaagtccctgaggggtatcctttatgggtcattttctgacaaattgtaaatgttaataaaaagttgaaaggtggaggctgcggagatggctcattggttaagagcaaacactgactctgcagaggaccggaggtcagttccttatatcctcatcagacagctccaaggcatctggtaccccattgtggcttccatggacgtctgctctgtcttcctccctcttcccctcttttctctctttccttcccttctctctctctttctctgtctgtttctgtctctctctcacatacacttgccctcccctagtcaaaaccctgtgtgtgtgtgtgtgtgtatccttattcccagagcatcctattcatgataccagaggcagaagcaatccctgtgtccatagacagtgaatggataatcaaagtctgttaccaatccatagtgtgtgtaagactctagaaggaaggagactctgacacatgctccggtaggaatgagccacaaggcattctgctaagtgaaaggagctggtcacaagagaagagcagtctggtgagtccactttcatgaggtctttcaaagacagaaagtagacatcttaggtcagtgggactgctggtggagtggggaaatggggagttagtgtgtcacgggacagggttttatttgcaggaagacaaaagttctgtgcatggatgcaggtgactgtaccaatgtgtcaatataggtgatgccacagaactggacacatagaaatgcttaagatggtaaatggtccggtttttttgtttgttttttgttttgttttttaattgctttgtttttcaagacacggtttctctgtgtagccctggctatccaagaactcactctgtagacaaacaaggccggcctactcacagaggtctgcatgtctttaccttcctagtgctaggattaaaggtgtgcaccaccaccacctggcaagtgttcttgtatatacttgaccataataagatatccatgatcacaaaggataatgtgctcaggagtcgaagataggacaacccagaacaagagaggctccaatagcaggtgctactgaggagcccgggacagaagctctcaaaatgagggagccggtaatggcctgggaagaaaccattcagccagacctgctaggccagtgggctggcatgcggaacctgatgcttccgtgccatacagaatgagtgtgtaacccatactgactttggagttgaaggagcccggcctttctggctagctagctgcttaaccccaggacattcagctctgcctgtgctctgacctcaggcagtactcccgccagctgctggagctggagaggtggcttggccaggggaagggcaggacttcccccctgggctttgtcttgctccgtgagaggctgggaccacagccctgagctggcagccagggcttgctgcccgctggacattgcagagtcgaattcctgtatactgagggcattcttgtgtcaggtttctagtggagagggtgagggtgactttgagggcagaaacttgacttgctggggtcaaccagagaccatattagaaggaaagctgatggcttattctctggtcatcagggactaagctgcccttagtgcccgacctttagagagagcctaaaaaacagcattgcacctggatccaagcttctagggccagccatcgggtcaaccctggccactctggctgtcctgtcctaggaagtctggcttccttcctcactacactggccatccactgcttgttcctttaggcagccaagtgcctctgtgtgcccattctctctcgctctccccacacctcctctctctccagggtctcatgcaacccgagtggaattcagactggctatgcatctgaagatgaccttgaacttctgacctttctgcctccatctcccgagtgctgggtttgcaggtgtgtgccatcacacttatgtatgtggtgctggtgactgaacccatggctttgtgcacgctatgcaaatacttggcctactgaactagattcccagtccctattccctgccacgctcccccacccctcctccaccccaaggcatttggagctgatgtctgtgaatgacggccctggaaacttaagaactcaggaaaaaaacagtttccagatagatgtcagaagaggcatgaatccagatgattctgttagacacctattgaggtgtgggagttcttcagtgtttgtgacactatgcctggtttctgtggggatgaagagacatgggctgatgaagccatgctgagacatggctttgctcaaaaaagaacttggtttctggggcaactgctctcttccaccatactctttcttgcattatctctctgtgctgttggtagagaatgaccactgtctctaggatgggagccttgtcctccaacttgaaagatagaaaggagacagcccaaagatggagatgggggtgaatgagaggaaggaataggcatgggagtcaaatgtcctgttttgatcaaagcagtctcttccaggggggattaaggtaccaaacagatcatttccatccaaagtggtcgactggaccaactagggctgcatcacctggaactggctgacagggtggattcttgggtccagccaacctgtgtcagagtctgcatcttaacaggatcctctattgatttctgtgtgcactgacgttggaggaggcctgagtgggctgcacttcctggtccagagccagcaagtgacttctctgtggtcatgtagatggttcattgaacagacagaactcagcacactgtctcaactggcctacagatttatgcctgggtgaatttttgtttgtagtttgtgtctttggggaatgtcctagggttttgattgctgagataaagcaacatgaggatgaaagggtttatttcatctgataccttatagtccctcatcccagaaagtcagggcaggcactcaagcaaggcaggaacctggaggcaagagctggcacaggggctgcaaacgatgctgcttactggtttgttccccatggtttgttcagcatgatttcttaccgcacccaagaccaccaatgcaggggtgtcaccactcattgtgagctgggccctcccacattaatcatcaataaggaaatggcctgtagacttgcctacaggccagacctatggaaggactttctcaagatgccctcttccaggatgactctcatttgtgccaactgacaaacatgctaacaagcgaaggacatttttatagaaagatggcggaactatgaagtaacactgcctccgagctggcacgctgaatggagtagcacgctaagtggagtagcctaaggcaatgcttctcagccttcttaatgctgccacccttgaatacagatcctcatgctgtggtgacctccaaccataaagttacttcattgctacttcataggtaattttgcttctgtcatgaatcataatgtaaatatttgatatgcaggatatctgatacatgttccctgtaaaaggttgttcaacacccaaagcgggtcaagacctacagttcaggaatggctgacctgaagctctgggtttgtttttttaccatagagcatggtacctctcacttctaaacaatgggttgttctgttgtcaccttctcattgctgccccttgagggagatcatatcccatgacactcatgtcatctcattcttacttccatacgctggtcctttaaagccaaggaaatggagacccagaaagaaaagtgctggccttttaccaaaagaaagaaaggatgccatttgagagcatggtcacaggatgctagcctctcacatatttgtgcttaaggatgctgggtaaaattatatataatttgcatttgtgacactccagattctatgactctggggcagaagttatcttttaagtgccaaatttgtctagctattattaccacataccaaagcatttcaagacattttataacacaaacactagaatctgcgtccatttaagcttccatatgcattttaattgtattttaattaaagactgaagtagaagttctttgtgtctcagccagcgagtgaaaagaattttagctgcgtagatagaatatgatgtttgctgttttcaaaatacatgtgggtgctcactccccggttaggaccgagaacaagcagagaacagatgctacatataaacttggagcttcaggtagagccccagagctttcagcctagaacggggcagagatgtccaggatgcagctgacttctgtgatggtcttcataggtggaggtcgtttggtgattgttttattatacttttatcctagggtggaaagagggcggcaaactccagttcatgagcaaaatcaagcaggtcacctgatttttgttaatggtattttactgaaacacagccacactggattctcactactatgctgtgttgagacattgtaacaaaacttgtacgtgtacaatgctaaacatatttatccagtccttttggagaaaagcctttgacaaactggcttaatgtctctttggatagtgctccctaatttttttttacatgatgtaaatggttggaactcattaattcactggtacactcacttactgaagatggcttcatcattgtggcagggaaccttagctcagaagctgtggactcgtgaaaaaaatgtaagggaagattgtggacttggtaaaaacctccgaggaactaatacaggttgtgaaggtcttgggtgcaaataacaggatctgctaattcaaggtgaaaaggctgtgcttaagagtttagatagttcagagaattacttgaaagactgaagcagagatactaggctgagctttcagaaacattcccaattactacagaacaggccaccaagtatttgcagagccaggaggttataggcaatggggccatggtcacagctccaggaccctggctcctagtacatcacccttcctatcaaacagtaactcgcactttggctctctccccattgagccaccatcaaaactgaattagaatctaaagcacatagaacctagctgcaagggagtcagggaaagatttttccatcttctaactcatgggtgtgttaatcaaagcccacagctgcttcctaggttgttttgtctcgaaagatagatttaaaatgttcaacttatctattttacattaatttgggggggtacttaaaatattgtgttgtaaacataatcaatgagcttgatcaaaatgcccaaggaagtaatggtatggaagacactcccagacttgtctttaagatctgtccatcatgtctcaaagtcacaaagttacctcctctgggaagccttctcaaggtggaataggtgtttatctgtagtctgcatcctcagaatgggttgtactatgcctttcatttggtcatgcctcacattccatgtctttgtgcatctgtactctacgaggttgtctgtcttattgtttgttgttgttgtagttctttgtatatgctgttttaaaatccttttaaatgtgatgctggcatcttctcccagtctgtcttggtcctttccttgtagttattcaccttctttgacatattctttgcttcaggtgaatgcatagggaggcaaattaatgctccgcatctggaacagcccaattcagacccttaggtctgtgcttagtgaaacccatgtttttgcatgggaagagcagacttccctcttctttctaaacccaggtgggtttgctttcttgggctatgacaacaaattgccacaaactgggtggctttaaaaaatgacaacagtccagtctctcacagttcaggaggtttgaggtgagaacttaacacgttaggctccaagggagactctttggtcccagctgctagctacatccgtttaatggcaggtcaccagggcctctgcttcctgctctgaatatcatgccgcccctgttcatctatgccattggctatcagtttaatgtccatatgaaatctaagattatattcagtcaaaagtcacaggtatatctgtaagattgttgtttttgaagatattccataaagtttacaggaactggatgttagttcatgcacctacttttgagagagaagggacatattcttacatgaaacacagcaagtctcaggtgcagccaaactaaaagcctggcagatgtattgggggatgagctgtagatgaagcaaaatgaatcttggaaagggcaatatattctgaagtgcaggtccccagagatgagaggttgtacttgttggacattgcaagttttcacgtatttctttctttcttttttttaatcaagcctgcatattgagcagtaactaaaggcaattgtctccttatggccaccaacctgtcgcctgttgtggagctgtgcttgtggttgtcccttcgagaaggtcacctcagtgggatggaggactggttactggtgggcaagtaggtcagtttgtaaggcccgcagaaatccgcagaacagagggcaggggagaaagaaggccattgaccttcaccatctgtgagcaccacattggcacattcatctacttgctaaaatttattatgtagccccctcccaaataaatctgccctctcatgcttatttaccacaacttgtgccaagaggtgaaagatttgagtcatggcgtgttcacgtccccaggcaaggtcaaccgaggagatgctcttgtctccagctcgtacagtaaacaagtttgagctctcagactgtaaacaagaggccacttcacagtctcttcgctgctgtgttttcacattttgctgcctttttccccttggtggttttgttgttttagatggcactcgagcacagcgcgctgacatgctgtctggtgtgctgaagtggtgtgccttgcagacaaaaacgtaggtgttagatccactttgttttagacatagcttacagtgctaagggccgtgaatccagtgcttaggaatcagctatgtgtatcaagcaggcgccttttaacacaagctcagtggacaagactctgtatcaatcagtctgcaagaatgttgcaaccagaggctcacaggaacttaacccggtgtttcccttaggagcaatgggtgggtattctgtaactcggtgttcacaggatctttatggactgtcactacagcaaataatgagagccagctgtatcttaaagaacccacttctgaaagtgattatagagcgggattggggagaaatgtcctgagattggcagcctcacgttgcatgaagaaactttgtgcaattgaagcaaaggttgctctgtagaggcccaagaccaaaggcagccaggcaagagagaggtaaagacgggcaagaatagaacagatttgagatggtaaaaacccagtcaaaccctgtagagcacacagcaagaggcagatagatcttcagggatattaggctgggcaattccataacctactgcttgcctggtatgcacaagatcttgtgttccatccccagtaacataaaaataataataaaaaaaagactcttcactgaggcatggtttatataatagcaaaagtgtccaacaatggggatgtagttaagtcgactctaatgtagccataaaatgaaatatgtgtgattcagctattcagatgttgtgaattatttcttgacttaaaaggagtaagacaggaaaggcgggatttaaaatagtgtttttttatttcttataaagatgcatgtgtatttatttagaagagatctgtgtgactctactaaggcatttacagatggagtgaaagtcactttaagggccaggggtgtggctcactgagggagtgcttgcttagcatgtctgaggccctgggttcaaaccataacatgagtatatacagtgggctctctacggtggctcaggaggtaaagaaagccttaccactaagcctgacaacctgcgcttgatccccaccatccacatgatggaagtagagaactgactcccacaaattgttctctaacctgtgcattatggcatgtgcacagtgatacacaccagataaacacaattttaaaaacacagacacatattttgtatagtacctggtgttttaagtaaaaataaataaataaataaataaataaataagagacaaatgatgattccctggggcccttcctcctcccagttctctcataattactggcctcatctgtcttgtagttttagaaattaaatcatggtgcctacctaaaggacatctgaaggcagactttgcattttctagaacttgtcaccttaagaagtgtgtgggaaatgctccctgtatttttcttgggtagatgaactgtgagtgtggaaccctataagagccctatatgctctacagttgggccccaacttaacatccagctgccaagcttgaggtacccgaaggtagaggaaagagccactacccattcataacgccattcaaaaagcagcttgaaggctattcacaaagtcctgtgagtctgaggtgggctgattggaaacggagctcatctagatgtgttctctaagcctcctaatgcatggagcacgcccctagggctctcagggtaggcaggcatcacagtgacccaactgttttctgtctcagagcttgtctggagagtctgctgccctgtccacatgtccagtcccaggagccggacagatcccagcaaaggagaagtataggatcggtgtgtggatgctggcaccctcatgtgccttgctggtgctaattcgaaagccagcttcagatgtgcttctgtggcctaaggaggaaaacagcaaacaggcaggagctgagctcagtgccctgactcattcttccacgtggggctggtgacacaaagctctgacatttcctgtggccacagcccccagaaacaactagcaggccctggctgaggtctgtctgccctgcagggagcttactgctcttgtcctgcctcagtgtactctgggagcctgcaaggttatcagagcccagtacatacatcttccaagcttgggggtgggagtggggtggggtggggggaggactgcgtgggaccctttcttggcgaacagtgggagatttttcctctcataaacaaaacaaacatgagccggaggggtggtggccccaggggcaggctgggtggccctttccttcaacctctgcatttgtttctccatggggcagattgtggaagcctctgagaggttggaaagcctcccgagagccttcttagtcgtcattgcatttggttaactgagcatatcacctcttgttgttggccagggctctgttaccgtggatgagacagcaagttgtttaaacccatatccaggaggcaggtgcctctgcagaacacccaagggggcaggcactcctcctcggtaggcaggtggggtagaaggaacagagcccttactaccatgaggagtggagtcgtggccctcaccctgccagccaggcttctggggcctttcctagctgttgataaactgttgagatagctgtgatggtgagggactcctccctagcgcccaccccctcccgtcccagtcttttctcatcttggtgattgccccctgtctcgtttacaaagcttttccaagcttgctggagagcactgggctgccagtgcatgcctcagctaggaaaccagcgaaggctctcatccatcacgtgctcattaccactctggaaggcctcaggaggtcagcttccactggcctctcagcgctgtctgcattgtgctgttgggggcctgactgccctttcccagagatgactgtagctcctcttcagaaaatatgctgggaaaggtattctaaaggcagccaagaagtagaaggcagtagaagtagatcttgctattcaggtacatggatcagagttaaatattttaaggaatagtacatcctatttctctgatatggatgtcttgtctgctgtcagggagggtctgtggggacattgctatgaaagtgtgcactgtgaccctctgtggctggggggctgggtggaagaagccctgcagagtgaaggagtgcttttaggacctcccggatcagacatgatgttataggaaaatatgctttggctgaggaaatagagagaaagccgaggggacagagcaggaggctgaggacataaagcagattgtcatcaggggatgagctaagatgctggcggggggggtccagggaagatgatggaggatggtctgtatccaagaggatggccaagtgatggagcattggggtgttggtggtggggtggctaaggatactgtgagcctcaaaagcacaaaggccatcattcaggcactaacccactggcctctggcctcgcctttggctaagtgaattgtttcctggaggccccagccatgaggggctgtgtccccacggtgtctactcaaagttcacagtagggaagagggagctgtcttatctgtgtccccttggtagggggggggggctgaggtctgcccctttgtgtgtgttgcatggtagaagccaagagggaccatagcctgtgtctatgggcagggagtccatagaccatagggccacactaccaggccactacaggtatgtatgtgacttggaccagttattgaggtcctctgtgcctcagtttccttacctataaaaggggagagagttacaagttgtgtgctatataactaactgtgcaaagtaggcagttcaatggtgtttcatatattcagagttatgcaaccaatttccatcatccacaaacaagcctcgtatgtattaacagttattctccatctcccctgccctgtctcagctcctggcaaccattatctacttctgtctttgtggattatggaatgtcatactaatgtgatcctctgtgactagtggtttttaacatcatgttttcaaggtttgtccacatttaacatgcaagcacattattcattttcatggcagagtaatattccactgtagggatataccacatttcatttttatccatttatcagtcgtggaacacttgggttgtttgtgttgggggatttgatgaatgaggctgctctgaacatttatactcatgcctccgtgtggacacatgtttccagttttcctggggattcatccaggaatcacttggtatttatttaaccttatgaggatctgccagactgctttcttaagtggcttgactgctttatattcctactggtaatgcaggaggactccagtttctccacacccttagcagccccgtggctggttattttcctcgttccattctgcaaggtatgaaggggcttcagtgccactctgatgtgtttccccattggccaaggagactaaactatggctatatgacttcctcctccctctgctccctctgcatcttcctgtcttccctcctccttgttctccaataatggttgttacatgtatatgtatacatatatattcctacctgtaacctgatataatatatctgcataatatcacttctttattttcagcactgggcatttggcattgagagactatccccccacccccatcagcactccttaattgcctgtagttctttttctcaaagccttgagaacccctcctccccatccacctcagcatgtctattggtgccacccttttccaggttttatttaagcagccatgttatggagacctcatggctgtagcctctgacatttctaggaggtacactctcacagcgcacactgttccttgggctcctacagtctttgtgtcccctcttctgcaccaatccccgaaccttaggtgagggagtcacgttgtgagtgtatggattgggactgggctccacactctgcctttgagcagttatggtattctgtaatggtgtccacctgttgcagggttaaaccctttgtctaatgtttggtgactatttgggtggcttccttggagaaatgtctctacagagccttgcccatttccagatgtccaggtaggtcttagaagtaccggaaagcagagctcacacatgatattcggcaagtggtgcttagactcctgggattggcaggctggcctttcctttctgagtgaggtgtatgggtggtcaaacatggcaaggagcatggtgatggctcgcatttcccttagctctcttcaattagtcccatttggggagaggatggatcacttgccatcctacccaaggctgactcccatctgatccttttgagtacatttctaaatgccaggagtggagcgtgcctgcagtgcacacctgctgagggcaggcgagggccacttcagtgccactcagagtagccaggtatagattagtgacaagacagctgaggagtacagggtgaggctgtttctctgctgtgttggcactatagagtactcttgccaaacctagacagtgtaggtcaacaccatacagttaagagacggcaaataccaggtattgggctgcttcctgtgcaacacagcacagtacttacggtgaactgctttttaataactagaagtagttaaccttaaaatcgtgacaaaggggtggtcaactagctccacatacaggtacctgtcacatatgccattaactgccactattatattaggcactagagtgtgtgctctgctttgtacactggggtggaatatgttcattgactccagtgtcctcatacacagggtctgtcaccatatctatatgtgtcacagtgctgactgacacattattttgcatacagactggatttgggtctggttatccggcatgcactcccaagaggcgactccagagagtgttggttgatgcaatcatttcttggggacattgagaccccccaagttctgcccagcaggattctcccagcaccacccgcatggtgtcacagtgatgtcgttggccctttgtcacttcatgttctttggtaccagctgcttgggctgggctggtctgggcatgagctttctttcccatttgcctttttataaccaagccagatcccttgatgtttccaaaggtggctgtggtctttggtgacgaaagccctaggtccagcttgacccttaggttttacgtgagcctgctgtctctccatccctcctctaattctggggaaaactatcagggatttaaagggtttgggaggcgcttcttcctgataacgtggttacagaaaaagaagaaagcatatggcccagtgactgtgtcagtggagagccggatgtgagttcgaatccccaccagggtggacctggttacagaataaagctgttcccacagcccaatgccaatggcaccctccccatggctacattctccaatttcctcctcctggacagttctttccctcgtccattgcactgaagtcactgaagtgctagtgcctgccgttctgatggttttccccctttcagaaaccttgccaccccacaccctctcctcacaagcgggggaagttcatgtttccctcatccaaacgtctggcaactgtgtctcatctgagttttgatttcctcccccatctttactgcgactccaggcgtgcttcctttgtgatttccctcacccggccctgtgctcattctctctctggggcctccctgcagctcttcccatacctgggttattattattctggctctgtgataatgtgtgcactctcacgcactcggctgaggcccctctgcctccctccatcctttctgtgcctgtaagccatctagccaccccccccatcccaccccatcccataggaatgtggtcagcagaatggtccagctggctggctggtcagccacaccaaggccccagctcagggctggcagctgtggccatcaactcatttttccctggcagtggcaactccctgggtgctagggggcagctgccctttcacccagcagccccgggcatcctttcttctctaggagatctcacatctactccctcagatcaatcctcctatgacttctttgcagatagctcactgctacagtcacttcccttgacacactccagtttgtcagtgtccctctgcatgtgaaagggctggaatataatcccgttggtgtcagggggacattatccttctctgtgtgcatgagttttgaggtatagggaatgtattttagaatctttctttccttccttccttccttccttccttccatccatccatctctctgccatccttttgaaatagatctcatagtgtcaatgttagtggacttgaacttactctttatcctaaaatgatgtttaacttttgatcgccccgcctccaccttccctgtgctgggattaggagtgtacaccaccaaactttcaaggctttatgcacactagccttgcacacagacactctgagctgaactacatcactggcccctgaattgctgttttaaagcagtttaaagcactaccctcaaacccggaagttctgaatagtttggctccaagactagcttggactagaattttagggttgggacagtggctattatttctcagtgacactctcaagcagacaaagggggtatgggaaagtttgatctggggagattgcatctgggggagctttagattctgagatgagagtcggtgatagtctaaaattgagctttcgtttgtgatcaaactgtgacattgtatctctttgttgcaaaggcaaagctattctgggtagaagcaagggggtaaataaagactagaacatccagtaggcttgaccctgttaacatccctggccagtctactgcaggaatgaccagtctctgagaaacactcagtggtttgatcctgttaacatccctcgcccctctacagagggaatgaccagtctctgcacttccagcctgtgcaggcccacagatctgtacttagcacatgcacgctgggtttcatcttgctgaactatctgctctgcagattgctgagactgtatagcgttttgttttgagaaagtattcttgtactagttaactggttagatttggagtggaatgtatttgcaggtcaccttcccctccccacccccaactacaggctttgctgtgtctttgcgttattctcagagttcccctagagtaaagccccagattggaattggggcggggggaggcaaaataccaattaaaattttttttgcatgagtgtttatctgcatgcatgtatatgtactctgtgtgcgctcggtaacctcttagattagaagagggtgtcagatcccctggaactggcgttagggatggtgggagccatcatatgggtgttggaaattgagccctggtcctctggaagaacagctagtgctcttaactggggagtcacccttccagcctgccttgtctatgcatttattctgtgactggtatcattctttatagttattcccaaaatgaagatgatataagcaattacttgcatgctcttccagtaaatttgtgcagtttttttttattattattacatcccaatacatgtaaacactaaaatgtggaggtgattctgtttattctcacgagttacacagttgcctcatctctacttttataaattctgttgtctttctctccaattgtttcatttgggacttagtatttgatacagtatctctctctctctctctctctctctctctctctctgtgtgtgtgtgtgtgtgtgtgtgtgtgtgtgtgtgtgtgtgtgtgtgtgtaggggagtggtctcaccgtgaatccctggctggcctggaactctgaagatcaggctggccttgaacttagagatccacctacctctgcctctggaatgctgggactataggtgtacactatgacgtgggcctcaggatacattttaggattttggagctgggtgtggtgactcctacctgtgatcctagtacgtgggaagcagaaacaggtgagtttgagatgagactgaactacatagcaagattctgtttcaaaagacctaagtaggcatctagcttggtgtgagagtttttccctggaatgttcaaggccctaggttccattgcagccttgaggggattgggggagggtgtggggaagctttctgaatagcacaccgtcagcagagaggcaaaggattgtcccccctgtcaggttaaaccttggagaaacatttggggtccatggcctgctcggtgggagccagtctgtcagcttcagagctgttttacagcaggctcagcacagtgacttcatctttgcatggaagaacactcaggtctacttggctgcctgtgacatattccccgacctcaagctttgtgaagtacatgtcctccaggaaagtcctggtctgtggcagctatgtcccttggttccagacccaacctccttctcatccatttttctgaaaagaagcaaaacaaaacaaacgagtggctcagctcggccagctgcctgcctctcctcctggctgctttcctttcttcactaggttttccaggccccggtcctcagctcttccaccgtgagtcgaggcctgcaaggtggaagctcttcagaccgggtcaccctttcttcagtgcatccctgggctgttgccatagcagtgggatggatagacatgtcttgcttgggccccccttcttcctccagcttctctctggattccacttcctgccctctgagtgagcatgtgggtgggaaaccggctgggtggtctgcccagatttccaagagattggtggccacaccttgtacactgcctaatatgggcccaggccaggctcagaccacactcagctgtgctttcttttccaatgatgctgacgacgaggatgatggtgacgaggatggaggatgagcagttcccatcgtgaccagacagcagccggaagatgagctagaaatcctacacgggcctcctcccatgactgagtgccaacctacttcctgccctaaaagacagatgtgtgtgtgtgtgtgtgtgtgtgtgtggtactcttttagtcctgttggccatgggagtagagtcaaatggctaaatggctgagcttctataccccaagacttgactcctggctttgaacattgcctatatccctactaggctatgtgaacaaatgactgagctttttctatgccttgtttcctcttaaatggggataatacttaataggttcagtataaggagtgaataaatgattttgtaattacatgtgtgcactttgcagtgcctcgcacacactgtgttcacagttactattgctgtgtttgtcatgtgcgtatatagcttaagttggccttgaatatgcaatcctctagccttagcctcctaagtcctagaattacaggtgttccccactgtgccacctaactttttttttaagatggcttctcaagtgacccaggttggccttgaacttgctatatacgaaggatgaccttgaagttatttttgagcttcctgcctctacctactgtttgcagagattactgacacgaatcatcacacccggttttatgcagtgctggggatcaaacccagagtgttgagtatgctagtcaagtactctgccagctgagctatctcgtcttccagccctcaactccctgcctcttcttttgtttgttttggttttgttgtttacagacaggctctcaatatatagcccagcttcagctcctcatcctcctaccttagcctccaggatggtgagataacaggtgtttaccaccgtgcctggctaatgtgtatgtgtctactttcttcttgtggcataccagaaggccatgggagactttttatctgttttgtgttcaacttcgcacagccttcctcagaatggagctctggtgtgccttttacattctctttcagacactcccacgttgtcagatctaacctacacacgagtctttaagtgaaggtggtaggtccattttataggtaagagaacatgaagctgtgggctcctagggtacctggcagcattgtgtagctgacatgtgacagggtcagaaactaaccccttctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgaagagagccatttcaaagaggacagtgtagcattccacaaaccaaagagggtccatggcgtgggtgacacagagctagttcactgacattgcatttgtaaggcaaatgaaaagacaggcttggggtatagaaaggcctttgcccagggaagaggcttaaatattccaggtgggtctccccagacccccacccgtgggtgtacatgtgcacatgcgcaggcatgtgtgagtgcataccgtgttggtgctctgggccagccctttctgctctggctcactgtggctgggagctgctaaggatcgtccctggagacagggggcttgttgtagctctgacggctgctagagctgggcaaagggattggtgtggaaccacaagctggagactcagcaggcatgggtcttgggagaaactgtgatggggtgggagtggagatgggactccaggctgactaggccattgggatctaagaggagatattttgaaggagagactcatgagcttcttttcatctctgaggaggaatgcgtgccagtctacctgtgtcccatgtcctttctggaggagatcctatagatggagagagaggcctgggggaggtaggatctgctcaatgagcaggagctggaccaggcaaagtgagggaaagttagggtgtctgttgaattgtggggtgatattattggggctgtgttttagtaagatcaccctagttgctttgtgggaggctagagaatggccagagagtgataggaggctctagggagagatggctgaggcttgggtggacagtggtgaccactgggcacattgagtgtgggaggagctgtcgccaggccttgatgagtagcttgtgagaagaaaaggaagagagctgtgacacgtgagtcccaaatatgtcaaatattggtatggatctggagtttgctgtcactatcaaatgtggagcgtgagggctattttgtcccctcctagtggcactagggaacatggtgtaggttacagaggtagataatggaccaagctcagtggctggggtccctggaagccctcaattttcctagatatccttgatcttgggaacccttgaaggcatgaggggcagaagaggccaagatcaggtatctcagatttcctgcaacctgctttgggatctggagagacatctgaaaagatgtgggccaatttctggtgacctaattaacgagcggacatgagtagcttgggtgagtgacttctagtgtccaggaggagagttcaggttcagccaagggcatccctaatgcaaaacctctgctggttctatggctcatcagggaagtctggagatgtgggaagtgagagagaggctgctagggcagggtggtgggtcgtgacagtggtgcttctgtcatatatccttgggcctaggagccagctgacatgatgtaaggcatgatgtctctaagctggcggctatctttagcctgtggagttcttgttgtctagggcaacaagagtgcccccatcacctgccacatcccctccttgtttcaagctactatttttgctgactgtggtggtttgaatatgcttggcccagggagtggcactatttggaggtgtggccttgttggagtcgatatgaccttgttggaggaagtgtgtcactgtgggtgtgggctttaagaccctcaatcctagctgcctggaagccagtcttctcctagcggccttcagaacaagaggtagaaccctcagctcctccagcccatttctgccttgatgctgccatgctcccaccttgatgacaatggactgaacctctgaacctataagccagcctcaataataaatgttgtcctatataatatagagttgccttggtcatggtgtctgtacacagcagtgaaactctagctaagacagtgactttctccattagaacctaaggcaccgagatgttttctgttgattcaaattgtgagaggaggaaatctgcattcttgctatgcctcgtctcttagtgtccaccaggaaaaccttagtcattttgtggggccttatagaggattctctcccagcccagttcacagggccatctggctggagttcacttaacccaattacagggtgacaaaagtcagaattgcttaggagcttcagggattaatgggacagaataggagcaagttaggcaaaaagcccattgactgttcattcatcacagtgctgtgagatggaagaaagcgggtcaaagaatgaatcaaagagctcgcagcaacactgccagtgtgtaaccctggctaaagcattcccctctctgcttgcaagataaggggtgctgtgtgattccccaagtccctccctgccatagcactcccagttgtgcggctggtaaaaaaatgcgggacagaaatgagcgagctcatttcattgttgcagatttagacctgggaatgggaaaagcaccaagccagtgtgggtgggcttactacaggactttgggggtcaccgtgcgggggatcacaatttgtaagaccccattatggctatccaggggttcagtacttaaaaggctctgttctggcaactggccaggtagctcaagcttcatgaaatctccagagagccaggtccacgtggctgagcagcctgaggtgaagatcctgagctggatatggaggaggatgctgcagaggttctcaggactgacttcgagcctgagtaccctggcttgttcattggctagcttgcctctctttggaaggaacgtctgttcaatctaagggatacactgcattccattctgtcttaagggtctattgggacctaggctgattacattgtgtgcatctcagcatggatgacatgtcgaaaatctgtatctagtgaaggcgttggaaagctgtgacctcacagggtgagctacggtgtctagacctcctctacttgccacctgcatagatactggagctggaagagggtgtcgtgtgtaggcaggcacctggagtgttggtacttatgttccctgagaagttatttcttggtgcttgaaaatcattgagagcttgttcaaatacctggggcaataatctggtgactcctgggttagtggtgaccagctgccttcctaggcaatctaagagatacactgcattccattctcttttaagggtctattggaaccttggctgattacatatgtcaagagaaaaaaaaaatagatgaaatcaagcccctcctcccaaagtacatcatatccagtgtctttgatcccaaatctctgtttgacactgttaccaatgcttctatctgctaagggtagcctgtggtcttgggttctcagcaacccgtgctctgggctcctcttctctttgttcaccagccatgcacttttgggagcattgtgcatttctacctccagacttctactcttattggtccaatggccaagaatgcctttgccattgacctcttggaaagcactagtcacccctcacctgctttgagccatttctctcaacgcactgaatgtgtgaccctcaagcccagtctgacccctttttgagaaagagttaagtacagctggctttcccagaacccataatataacacagactggcttggaattcccagttgtcctgcctcagcctccaaagtgttgacattgcagatatgtgcagtcaaacccttccctggtgtattttaaatacttttggttaagagttctggctagccgggcagtggtggctcatgcctttaatcccagtgcttgggaggcagaggcaggcagatttatgagtttgaggccagcctggtctacagagtgagttccaggacagccagggctacacagagaaaccctgtctcgaagccccccccccccccaaaaaaaaaagagttctggctaaatctgggtcactagaaatgaggtctcaccaacccatcatcattgttgactatacaatcatgggtccccaagtgctgtgccaacttcttccaaacctaggacaactgtttaatctcctcttcccacccaagacatacatgtccagcagaacagtcagctgctgtggacgggctgtatgtagttcattgcctgaaccagttaagtactcaaggaagcctctagaaaggcaactccacatctctcctgtcacaccttctgtggaggtcatttggttgttctctcactgttcctgctgagtcagatcaggcacttgtctgaaggtttatcctgcagggttctgggcagccatcagagccacctctccttgctccttaggtgacttcagtctaggcctcgggttttctgagtggttaagagagcttcctgctcttccagaggatctgagctcagctctcggcacccacgtcaggtgactcacaacatcctgcctgtagttccatttccagggcatcagatgcccttgtctgacctctgtaagtgcttagatggtcactcttagacacacatacaacacaaaaataaagataagccttaaaaaaaatagaggttgaaaagtcataccaaacattgaaactgtctctctctgaactggtttgagccctccccttattcaagggctccctagtaacattgctcagccccagggtgaatggcttctcactagtctgtcctcagtgctcactgggtgctcaccccccctcccttcccttcccttcccttcccttcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccccctccccttctcacctctccccttccccttctcacctctccccttccccttctcacctctccgcttctcacccctcccccttcccctccctctccctctccctctcatagaacacacacaaccagatttgctcatgtttcctcccctgtcctacctctcctttcctcactatgagtccaacaaatgttctggtctgcatgaactctgtgtgtgtgtgtctgtgtgtgtctgtgtgcctgtgtgtgtctgtgtatgtgtctctgtgtgtatgtgtgtatgtatgtgtgtgtgtatctctgtttctctctctctgtgtatgcatgtctatgtgtctgtatgtgtgtgtctccatgtgtgtttctgtctgtctgtgtgtgtctctatgtgtttctttctgtgtatcagtatgtgtgtgtctctgtgtgtgtttctgtctgtctctctctgtatgtgtgtttgtgtgtatctgtgtgtctgtgtgtgtgtgtgtatgtttctctcactctcccccccttctctgtttctctctctctgtgtgtgtgtgtgtgtgtgtttctgtgtgtgtgtgtgtgtgtgtctattctagctagtgactttaagctgtctttgaatgattgctcaacttgaacatcccttcaggctggtgtctggggtggtttggatcactgctcagcatttcattcctttccccaaattgcttgttattttatttgcataaattttagtggtaagatactgcccgggggcctaggaagctcaaatagacctcttaatggggcaaccgagaccagtggtggggatgtagtctcgcccctgcacacgcgtctataattttcttagactgtcctctaccagagcagtgacaactgtgagctctgggggagacaagaatgtcctacttccaggggacaagcacagggctccacagctgcaccccagacactgcctctccctgacctcagcctgtccccctctctctgcaccttgtcaccaagggcctcatgtggtcagaagacagaggccagatggacccttgctcccacctgggttctggcatctcctgctgtcaatcaatctctctgcacctcctcattgggcaagggtctggtgcaccatcaggtcatgtgtaggtagttgctggggtagaataggggtgggataggttgagctgccagagactagaggacataagatgaggcggctgaatggggacaggctgaatggggacaggatgggggacaggctgtcagagcttaagtgtgggctctacaagagggactcaagacttgtgggctgaggatagagatctgtagaggatcacgaaggctgctcttgatcccttctctagaactgagctttgcacgaggcatgctctccaggatgctatgagcagacatattctgggctccaatctccccttgggtggtatgcaagtagttcaaatattcccattttttgacatgggaatggcagaggaggctgggaaagctgagctgggatacgtctatgggtaccacgggaaaagaacttggccaaacagagcggagggttgtagtattcaaattaaacattttttaggctgtatcctaatgcatcctgactttatttgtccatctgtccacccactcacatacctcattcatccttcccttccagccatctaagacccatctaaccatccatccatccatccatccagaatggatttactggattccaacattttgtggcaatataccagtaagagctgctggtgagttggcagcagaaatgggattcaagagagactacgggaaagcaacaggtgaacaggacttagtgatggagcagataattgggctggggtttagagaatgggcaggaggtgacttccaaatttctagttcaaatgtgtggggagatgaaagacagtggtggaagacccccagatttgggagggaatgtcaaaactttgatcttggtctgtggagagttggaagtgccttggagtgacttaagatatggagaaggcattggataagcatgccagaagctcagaggtatttggaccggatatataaagatgggagtcatcacgcctcaaaaagctaataactgagttaggtgagattaccaaggcagatagtgcagcgagaggggaggaggctccatctctcctggaagcagtttagcatcagctacaggatggagcaggttaagcccgaaaggacgtcagcaccatgaggatgagaaggctggagcgctattaggaaaattaaaggaagagagtaaggtcatccctgggtatctgagggacctattccaacactcctgtgctaacagaaccctccaagtccattaaatcaaatggcaccgtttttgcaagtaactgcacatcctcctgtgtggtttacctcatccccagatgactcgtaacacctaatacagctatatgaacacttctctgtgtatgctcagtacaggaatactgtttttcttcttcaacaatttcagtctgatgaggctgttgctatattggaatgcagagaaccaaacgctgagctgactgcgtcactgaagagatgagcaaccactgtctaaacagccagtggtctagtcagagatacaggtatcctgagcatgggagcacggaagcacggaaggtgcactgttgtggattagggtaaatcagtagacactgagctgatcagtggaaggagatgtcctggagggaagagaacagtctgagcatctagataggatagagttgagaccaaggggaagaagttggtctaaggtacagctgacgaactggctgtaagtaaggagaagaaggaaggtgctagccttaatcggtgtaaccttggggccgaccagccacttatgaggacttctttttatcctgaaaacaaaaatggaggccacagattccctggagaggcttgacaggaagagaaaattgacatttctccaggacagaccctttcgttcattcaagtctcactgtgtacctactgagttctaggctgtgttccagatcccaggtagacgtcagtgaggtatggaggaacggtaagaaaacccctggagcttcgtgctaggtcaggaagtagagtgaatgagtctatatgtgaagtgtagttggccttttatgatcaggggctctgcatacatcaatgaaaccaactgcagatcgaaaacagttttgaagaaaattgcaggctgggggacgtatgtaggtgagcagtagagcctgcccttagcatgagcaaagttcgggggttaagtccccaccttcaagccaacaacagcaacaacagctagatatgtacctgtgggcagaacatagtggcacatatctttcaaactgacagtgggactttgtgatttcaaggctggtctggtctacacagtgagtttctggctagatagagctacatatacagtgaaatcctgtcttaaaaaaaaaaaaaaaaacaaaaacccaaaaacattccatctgtagtgaacaggcacagagagttttcttttcatggtttccccagacaataggatatagcaggtgatgtgaagctgtgtgttaattctgtgacaatcctatgcactcttaagagactttgactcgaacatccgcagattttgttgactccagagtcttggcacgaatccccctagatacagagggacgactgctcatgctaaacagcagtgaccaataatgtggttataatgtaaagcatgacgatgtgtgcatggctaggttacacacaagcacactgttttgcatgctttggaggaagagtgccagcagtgacttagaggactggggtggtgggctcagggttttaagctagcaggttggggcaggactccaaggaagggaaaactgcattaagacttaaggtgtaaagagagtaaagggaggctgactgtggaaacaggtcacagactgatatgtctggtcatcttcctgggccaggcttggtgcaggactggcaaggcatgtggcagctaagagaggaggtcacggagaatcattcgcactcaaggcccggggctgccacttctttcctaaagtaggcatgattcaggatggcagcaaggcgtggagtggagagagagtatgggtacagccgagaggctgggaggagctgtcggactatagctcatgaagacatttctctcggaatctgttttcttctactggaggttgagggcaccattatcctccctggggactctgtcagccccaccgctcagacaccagtcctttcgtgttcgggcagcagagaacactgagatgcgtgttggtggcatgtccctgtctggtacctgacactaccatgttcctttccatccttgatttacctgctctgtcttcctttttgctgttaagtcttggctctcccttctcgaaaggcattagattctgtgtaaatgacgagcagctagcagggaaaatcttcttttgcatgcttggagagatggcccatcctgagtgatgctctcgtgtactttgggaaaggtggcagtgacacacccttaaacctaggggtatgggtttaaccacgtcaggccagtacaaggaccatcataccttcaaccaggaactccttggagacaagctggtctcaactgaggattcagagatgtcgaggctcccctgtgacctgtttgtgatctccccgtgatgcggtgtcctgagcagactgccatttgcttttctccatcctcctgtgatggactctagtccgtggatcacctctatgcccggcgtctctggcatctgtggtagagatgctggggatgcctggaacaagtcttgtcagtcatgttcatagtaatgtcagccactgttggcaggtgggtctcatcactaccctcattcctagataaggaagctaatggatgagagcttaacagacagccaagttcaagtgtcttgccctagcctgtgacagataggatctgaacctgcacgtctggccccagactcaccctcttccttacctcgttaggacaaagctgaggctaaggacctctgttcatctgataaaggggactataattagtcttcttttctggtccagcaaggaggaccaggcagctcaggtgactggcccagagcacaggtgggaagtgaggaaggctcagagggccgagctttcgttgcacctgccgcccagcctcactggcatttgctagcgagccacatgaacacacagcagtgatctagcccatactctaagcccagtgaatctgcttcgcagcttgtttgcatttgtggagttaatttgctttccagacagaaccacagaccagtgtcccaacctcctcaagagtgcccctcccttaagggtcctaatgtttgccccatggctcccagtatgcagctgctggccaagggagggtcagagtgagaagcagccaggctgctcagggccaggggccagcgatgaggccagcgctgcctccccctgaggccggcctgctcctagcctggtgctggcgcatgaaatccgaactctggagggaaatttactgcacaataaaggaagaatggcccactttggggacaattaaaaccacattactgtggaattatagaggacgccgggggaattagccacatgcaaagcagccaggagtgccaaagccaagaaatgtgggcgatcacacagggctcccctcccccagacttgtacaagggacctgtctggttttcaaaccctgggaaaacatttacaaagactaccaccaaaagatagtatgaagataaccttgcctggcctagcatgtagccccagtacttctattccggttagagaaccaaccaggtcactgggttgagtctaatggggacaactctactttgccatttgaccacagggtcttggaggtggtgtgggtggcttccagtcccattaccactatgagccaaatgagctgctggggtctccacatctttagttgtaagatagggacaaaaagaccttccccacctgattctgtgggcatgttcaatggataaggtatacaaaatcaggtcccagaatctccatctttttaagatttgtggcttcctttaatagaatgacagtctagttgggttgtcatatgcttgagttcgatacttgaagagtcaaccaatctcagatccaaaatacatgaaaagcatttggatctgaattttaaaaatgcacttttttttttcttcctagcatttccttaactgtccagtgtgatcacaatacctgttgtaacaggtattggaatcaatcaggggatgattggaggtatatagaaggacgggtggatactaggtgaatactgtgtcatttcacataatggacatgagaatccttggatttcagtatccatggggttcaggttgtcttgcaatctattccctatggacatcaagggatgttgcctaaagcaatcagccaaggaatttgataccctctgtttcttgacacgggctccccttttttgaaagggtctgtccccttaggggtccttgcctagactctaggatggtatattatccttaaatctaggggagatgttcagggcacttagcaagtaacacttcacagtgccaaccatgactagagatactttgactgtgggcaatcctgttacctttgaaagccccaaaggtggctgcatttatttgtttgtcggttgtatgtgtgtgccaggacacatgtgtggagggcagagggcaacttgcaggaacagggtctcttccttgtaagttccagggatcaaacccaggttaactgacagcaagtgctttatctgctgagccctaactcagctgcctctaatgctctgtagctgcagtgcatccgtaagccaatgcggtacagagataccattgtactccaggggaagagttacagcttccatgggctgtgtactgccatagtgagacccttccagaagggctatcagggtccattttctacagatgaagtccccatttgcttgcatgttctgtctctttctcacatgcatgtttactgtaaggaaccagcgtcctttccagatttgactccctgtcctaactcctgagcaggaatattcatggggctagacctagttgtaaaccagtaacagccactcagccccaaggtgtctgtttaaaggttccctgagtcagaaggtttttacctcctctccagaatacacctcctggatcttgtccctctaacttgaatttctctaggaatgcttaggtcactcacttccaggggggagacccattccagctcccttggtcagctggaatttgctgtcccctgtcattccatctatgtggcggatcacccactttctcttccaggacatgacttttaattaaaatctttaattacaatcccataagctctttactgatctctaaataaattttacctactgatttgattaaaataaccagatccagaactggggctcagagtttgatgagttccattacaaagcgtcccctgatgaaatgctcttctgtttacttattttgggccacttagatggtatttgctttcttccaccctgccccataatagggagatagtttcatgtcaagttaagacattctagggaagaagtgagcttcctgggtgcctgggtgggacagaatggtgtgttcatcatttctgtacgtcacacagtggggaagctcaggtgggcagtgccttcccctttcttatccatctccatatggtcttaggaggtcacaggatgtgccagtcaactggtacatgctttaattccagcatttgggaggcagaggcaggtgaatctctatgaattcgaggccagtgagttccaggacatcgagaggcacatagtgacaccctgctttgaaaacaaacaaacaagatatcataggattcctgttcgatttcagcagtgggcacatatacagggaggaatgagttggccccagagccaacaagcactgcagaaccagacaaccctttgattcccacaaagcctaggagactctaagggcccctttaactcctaggtctcaccagtgctaagaccattagagttgccttaactttaggcaaagtatgaacttatgagggtagggggcctgttgggactagaggattgacatgcagcctgtggtatgctgacactaaacctcacttcctgcagttcatgttaaagtaggcatcctgtgccttggcttgtgaaattttgcaaccatagttgtcaaatgaattaggaaaatgagcattggcctacaacagctcaccagatccctggtgtcagcctgtgttcttcatgattagggccctgtgtcagtgaggcctagtgctccgtgcagtacagaggtcctgtagcaccggaggctgacttgtctctggagcttaagacccaggtcagagttaaccagagttgtcttagctggctggtccagtagacagagatgcagcctgggggctgcagtggaaggagagctgtgtccctccaattgcacattgctcccacctgtgtagaccagagtagcttcaagtcattaagccctcactgccagtctcccccaccactactggagtcccgcatgtgctagccttggtgatgggacccattacagatgggaaatgactccagggagccaggagccagggttggcccattcccctggcaagtcaactctcatacgtctagtgcatggagcctgtgcactacctctggggaaagcgattggaagggagcccccatgctgcaagcaggcatctggcaggccatgtgagtcacaaggcagaggatttcacagcagtgccttcccttccagcagaaggggcacgcttttctcagacctcctttgcttgaatattagctgtccttaggaagacattccaacaggcagggggtggggttatcacgctccaagctctcggaacactgagatctttgccaggcaggagatctggaaagtgccctgaactagttaggtgaaaggttagctattactaactattgccaggttcctggcaaagtctctgccacattcttcccatctcttccataagagggtaacttggagggccactcctgtctcaagctctgtgttgccctgggtgaacaacatcctctttcctgtttagctctgtcacgagtggggatggggtaaggtctttctgctggaagttagcctctggaccgttttttttcccctaatgtatatgggtgatttgtcatctgtatgtctgcgccatgtgtgtgcctattgcccacagaggccagaagagggtgttgagttccttggaacacataatagactattgcaagatgctatgtgggtgttgggaattgaacctgggttttctggaagagcagcctgtggggtgattttaactgcggagctgcctctccagtccctaggacctatattttgaaaccagttttgttttgtttagttttgtttttccctttgagagtaataggctttgcatcttttcagaaatgggcaactgtggaaggttccagaacagggcggtaacaagttgagaggaatgtccagagatttggagtgaaggaatgcgtggatgtggggaaggtctaggttgggaatggaacatagtaggccagggatgacctctctgggggaggtgacagggcagagcgaggccccaccctctttcagcctggggccaggctccggagagggtggatctgagaagggtaaggagggagaattgatgactgctcggggcttccccagatctcctcatttcctccacagtgagggtctgggaggggtgtttctgcagcgcaaaccctgagttgtcctgcacagggaaggcctgtacagttaggaggggatcatttgaaagccttagggggaggtggagcagccaaaaaagggcagaggaaagaaaaggctaacatgtttacagaggaaaggagtcagtggaaaaaatgacggcaaggtcaagtagatttgggagatggccctgcagtcaacagaggggaggggacagtggcagtgtacaggggggagaacgaacctccaagccttggctgtactctcaggaatgctccgactccagggccttcatactgcctgtgggtcaggccccagcctcagaaccagcctttgctgcccattcacagggactctgttcactggagggtctccctgtcggatgggaggtgtttctgctctcagagggagacggggctggccagacttcaagctgtctgtcttgaccccgggcctttcttcagatgcccagaggcttggctgggtgggggcccaggctttctaggcagcttctttgtctgcctgtggacaaaggggccaaacctttcccaagccccacaggtgtgaagaacttgttactgtagtgtttgttcagccctgttagtggcctgaaggactgttgacagaggtctgctttgtgatcagacttggctaaagctccctaagccctcaacaaacactggccacttatctcagagactttatcagaaaccatctaaagccctctttggcaggcaggcctccctgacccattcactcgggacgctgggtttccaaagcactttccacatttttgtctttttgctcttaccacccaccgcatccttgatatctgaataaagccttggtggggaagaggtagttaggttttattttcaaattggaatcttaggataaagggctttttaaacccggcttccaagaggacacactgagaggcaagggggtgctttgggagaattcagcttcaggggcttccgggctgataggagtggaaccctattcacttactgctctttagtcttctcttagagctctttagcctgctccagactcagaggaaaatacaactctgtgtgcacatgtgcatacacacacacacacacacccttcagcctgctccagactcagaggaaactatagtacacacgcacgcacagacgtgtgtgtgtgtgtgtgtgtgtgtgtgtgtgtgtgtgtgtgtgtgttgctttccaatatgtcagcagctacattaaaccacccatggtagcagacactgaatatatatgtataacactctcctgtgactataggagattagtaataatagcaaaactgaataattgtagcaacaggctaataaaagccctgtgtctcctctttcaagctatcttagctcagtgctgtccccatcgtatggtggtgtgggaggccgtgagctgactgagccagtgaagtgagtgtggctggactgatgagcggagaaagagtcagaaggagcatcgtctgctcaggggagatgggaaacctccaagcagccagagactcgctttgttgctaaaatagttttctttgctccggaccctgaagagtggcccaccatgcacctcttctctggaagacccaagcacttaccatttgccacacccttcctcccagccctggatgggcactgtgcttgccagtggtttttattacattaaagttgaaaagtgtcgtcctcaatgattgagtctcaggaaccttggctgggaccagactctgttttatgtcccctttgtcctcttacttctccatgtcctcatgtcctccatgcccttgggtttactccaactggtctatactgcactgtctctacttacaatctataatccttgcattagcagtgggccttgggctgagccattggagacaacagcatcagctgaccacacctgggcatctcctgaggctctgtcttgttccccagctccttgtgtagctccggaattataatagcattcaataaataatcattgaccaccaaagtgtgcctgcagccggacttcccagttataaggagacacctacagtctgctgcgtaaatggactggccatcagcatctagtttaccttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttcgagtgatggcctttaaacacagactgctgccggtaccagagctgtttgggccctgctcacatcagcctctgctccaaagaaaggcctttcagagctccgctcagcatgatgcccctggcgcagacaggagccaggtgtgcacagccttggttgcttagctgggccttttcaggagttgccacaaactaggctctgaagacacttactgcgggaggaatatttacaattaataaacaagagacagacaatttctaaataaatagtgtaccaaatagagtagcaaggtcataaataaaagaaaataggagtagcctccaactcttaaaaatagctctcaaatattttcatgactttgtgccaattgtttaaggcagctttttttaaaaaaaatgaagccagaactctttccaccttcttgaaggccccctgctgtaagctccaccctcaccttgacacaaggcactttctctacagggtgggtgacagtccaactaatttcttttccatttggttccattattcaacataagtctgcaggcaggcgacagcagcatcacctgggagtttgttaggcacaaatctggaggaactggggctgttgctcagtttgtaaagccggtgcttgtccagcatgcactctgggtcctgtctcggcactgcttaaaccgtgtatggtggctgacacctgtaatcctagaaggggaggcagagggatcagaaggttggaggacatccttggctacatagtgagtttgaggccagcttgggctaaatgagactctatctgagagacaggaaggggatgtacatttgggacttggcttagtggtgaaagcctgcactctcagcacttgggaggctgtggcaagaggatcacaagttcaaggccagcctgcgctatacagtcatactctgtgtcaaggaagagaagcttctagatgggtccccagctgaaccagtatgcagatgcaattggatcagtgaaagtagaccatcctggcccctctctggcttttttcctgtcttctctatctggtcccagaaggacccagaaagaattataataactattataattctgtctatctatctgtctttggcctgtcccagcagctctgctcatagctaggaagtctcaagtctttcatggacctgtctcccctctgggaatagaagcaccattaagcaggcctctgacttgcttctaaacttcctatggtctctttttctttacatatacttctagaaacaatgaggggttccagaagagctgaccatattcctataattgtgtgcctctgagagggtgcacagagagcctcaggtgagaaaccagtttcttttatagaaagcacccagccttgctgggcgtggtggctcatgcctttaatctctgtcctcgggaagcagaggatgatggatctctgtattcaaggttagcctgatctacatagtgagctacagaatagccagagctacatagtgagaccctgtcatttaaaaaaaacaagagaaaaaataaaaagaaagacaaaatatgtacccagcttgcagatggtgttttgtgggttatttttgtcagcccagaggcaggcatgtaagtccagaattctcttagcaattctataaagaacacaggcaagtttctcaaaagaactgctccagagaggaaggaaaaaatgaagccaactgcctattgattcatccatccatccattcatccatccatccaagtattcagtctcacggtggctgaaggacagaggaggggctctggggctaagaccagggcttctgacaagaccatgaccagatgatcttcctgttttcatggacaggccagagtccgggaaattttggagtggcagggtcaggatgaagtgctcctgggtgctttctggactgggatagtcttggtaggcgtgtgacttagtttttgaggtgtttgggtagagaattgatacatctatgtttttgtcaactcatcgaattgctgagacttggttctctgtgttcagagccctggggagagtctgtggtgtgtagatgagggttcttctcactgaagtacagaagtctatttacatgggattaaattgcttaatcaacacaaaaagatgcgtttaaattagttcagagtgaaaatacaggaaaactacaagactatgcctttagaatgagggccagacagcaaatcctcttgatcctgtctatctacctatctactttctaacctttctatctgtacccatccatttagctacctcacctagcaatccacttatccatctatctgcccaccctacctacctttccctctatctatttttatccaccaattcatctcagtcattcatcctgtgggtccatccatcagactgttcctctatttccccatcttccccatccatccacctaatcaccagtcagttactcctcccacccacaccaatccattatccgcggttcactattctatacatgcatgtgtgtgtcttctttcttgagtgttagctttctctcaattgtacaacaaaaactgtaatcaaggcttgctgtgggcttctccatgtcatccccagtgaagtaataaaattgattaagagcatctggcccacttgatcaatgtgaattctgatgggtctgctcctcagggctggccatttcctctgttaaaggaggagccacttgggtggttgaaagtatatcctgtctctccagagaagttgtgtgtgtgtgtgtgtgtgtgtgctgactataactcagctgcaggtgccaagtggctaggcatgttccagttgacaggagacatgaacgaaatggcttaaagttggaagttaacacagaagacatttaggtgggggaaggaaatgggagttggttcttggtgccctttctctttcctgtcaggtttctggttgaggagtggagttgggaagtccttgctccctacccaccattgcttctcatgagcctgagatgaagctataggggatgtggctggctcatcccaacatgctagctagcagacacacagcttagagtctttatgagagaccaggggaccccctagatagactaccaagtcactccagtggtgtggggctccttgatctgggccaagctggtccctcaggagggtctctgcttccccacccccatctctcctgagttgacctctgttcttacaaagctgccctttccttcccgccttgaaatctgataatgaaactaatacccaatatttttgcctgggagagaagcaggagataaacaggaaggcccagggattagggtgtctctccgaggcagggcccacggctggtgggagttgggtgacacctctttgtggacctgagagatccagatgtgagccactttgcccagtgcatttttccatctgtgtagagaaaataaaacaaagagaaaagaaaacaagctataaaatactttgcagaagtctgagcgtgggtaattatcacttgatgctctttgacagccccannnnnnnnnnnnnnnnnnnntgacagccccaagaggggcagggggtgctttttgatgttggcctcagagttttcttttgtatgaccagttgtttggaaagaaccttttgttggcgtgaggtgtgcatagaaggagatcgggcctgagcgttcccaaggggtaaggaaggcagccctgcattcccagaagggctcagaggcctgttggatgctgggcagctagagcctcctttacaggagtgtgtctacctctatgaaggacctaaagatgctgctctctgtgtgcagaggagggcagcgagaccccagcgatccttgtggattcccagtactgggcaggtgccccgggtcttggggtttctgttcttgcaggaaagatctaagttctggcctgtagttcaggtccagctgttctgtctggtgatgctggtcatcttctctgggacagtctaacggctgccggccaggactttacacactgactccggtgctaggctggctggctgttcactgagcctctcggagtaagtcctgttccttgtctcactgagtgagtccagagtcagcgtcagtgtggcagccctccatgtagagggtggggcagccatgcagcttctgtgtctggttgaactcagtcacctggggacacctgctcagggacactttcaaggttcttgggaatcaggtctgttctctagtctaaactggctttgagctgcttctcgacggcagggcaggcactgtctttaactccacctctgcttgtcagctgagtgactaatgggcacttgatttggggaccgattcctggaagaacatttaaagaagcttgtaacaccagagagcaaaatccagaacttcacacgtaaaaatagcatcccagtaagaaaccagtaagagacatttacagcttatatagtagaaaaggcaaacgttttaagccaaccatggagagagaaaatttgggccacggcttgaacaggcaaggcacacagggagatggaaatgtagactcaaggagacgtacctcctcttctgtagtcatggacacaagtcgatgtcaagtcccggccttttcccctgacaagttgcaaacattcttttcttaaatgttgataccaaatgtgtgtgttgttattcttttcaagggtgtggtgaaatgagagctatcacttcctgctagtaggaggcaaagccagttcagccttccttgagggcaacttggtgttttctgatccaaagttaaaaacacggagatccagaacttaactgaattctgcctttgagggctgtactacctacccatcattagtgggagcagagtgctgatgtgcgtgctccaaggtggttcaaggtttataacgtgggcagtagggaccagctttgaagagaacctgcttgctcagtgtgcctgtctcagactaaagacccacaatgtctaagaaccagacaatctttaaagatcatattgacactaaaaaaaatgtttgttctgagaaaaaggctacaaggctagaggcaaatggggatggtctacatttaggaagcatactaagtagcccagcaggaagcccctatactcacaatgcctggtgaaaacaggagcgcacttccccctttcttcctttagtttttaagtatgcagcatcaagcatcatttcttgagaagctgcggaaaatgtgtatagactatgcagcataaagacagggcagtgaactcaagtatccctttgggggatgtgctggggcctcatccaagcaagggctagctgtgggcttgggaatgacactgaaatgacaccccctggatggtaagatggctgcagccagacggagaggcatctcctgcaggaagacaagctggccttggaatgggagggccactcttacactgggcatgcttcagaaactgaccagagttcagaataaatgaagcaggagggattgggaggctggggagtagagctgaggccggggagtgagtaggtctggcttgttaacagcctccagggctatgctaagtgacttcgattttatccttatggacaccctcagattgatgtttagaaatcccactctggtcacagttgtctctatgaagtgactccaggactccctgaagatgcaaaaattccatcccttctgtaaagtggcatcatgtttcacagtgcctatatatcctcctgtgtctacataaaaccccttattaagactcatctctagctgggtggtgttggcgcacacctttaatccctgcacttgggaggcagaaacaggtggatctccaaatttgaggccagtttcaggacagccagggccacacagagaaatcatgtctcaaaaaacccaaccagtcacaaacctcatcactaaatggcttatactgcccattacaatgtaaatattatgtaaatgaatatactataatttttaggaaaaatgacaagaaaaataatccatttcagcaaggatgcaattccccccctccccccagataatttggatctacacagttgtctgaatcctgcagaatcaggcagatggaggcagaatggagaggaaggggcaatgtggagaaggtgcctctgggtccaagtacagacctcagagttgaagctggaagtgagggtttgtgggtcatgagtagagaggtgatatgagatgcaggacttagatcccaagggcatcagggaaggcagggtaagaactgacctctgagctaagtgcatagaccagggaagtgggagggcgagtgactgacaagggggagagccacagagaagaaagcaaggggtcctctgccatgctgggtggtgggatggagagggggcaggtgactcagagttcctggtggcagaaagaggagtaggcgaaaggaggtgagggtggatggttcacttagaagccggggcatctgggtgtggcctgttcctgctgagagacttcaacacacttattttaccctcttccctggaggcaacgagtccaaggttgtggtgtgggaggcctcggccatgatcctgtgaactactcaacccgtgtttccaagtgccttcgaaagaagcaaggaaaggctcctgagcaagccgctcctgactggagatggagggggacctgggatgcagatctctttgcagggtgtctgtcctccccttgccctgatggtttctctctgttcccctgcagcctgcaactgcaacctccatgctcggcgctgcagattcaacatggagctctataagctatcagggcgcaagagcgggggagtctgtctcaactgccgccacaacactgcgggccgccactgccactactgcaaggagggcttctaccgagacatgggcaagcctatcacccaccggaaggcttgcaaaggtaggttgtcttgggggtcacggagcaggggttttcagggacactaagctccctctctccccatcctcccttttttctttcttctagttcccctgcaaagtggagtagactgaggtgtgcacacataccctgcccccccccccctcttctctcaaggcctccctggtatttggaggtgaaaggcaaaacaaagggccaatggagacggggctcagggaagaaagcagtaggtgtgatcccttgtgagagtgcagggccagcctcccaccacttcccccttcgcctccctcctccccagcggctcctgagcacaggtgtgctgcataccagaggaaagagagtcttgttctccgggctttactgtcgggacaaaggaccctctctttctagcccctcacagacatacttctttggatacgttcgcactgcctcccatcccatcccacccccatcccccccccccacacacacacagagtcacaaggaggttggcagcttcaggacagagtcttaggaggaacattaatccatttgcaaatagctatactcttcaggaccaagtggggggaaaaaaagacggtgggagactggttttgttcaccggagcaagcactaatgttttagctttctggtgtttgttttcttgtctcaccgacaaaatgaagcaagcaatggtcacatgactctgggggtgaaaagtaggtcccccctactctacattattcacattagcctttgggaatttctgggactaagggattcttgctcctttgctggggtctagggctggggtatacctgaacatgaaatgtttacatttgagggcttctggaagacaatggggtctttagggaccttgactcggtagggtgcaaagtcatgacagatagctgaggtgaggaactgcagtggatggcccatctggatgctgctgagcctctgaatgaagcagagatggtttcctagccagaaatacacagcaggttgggtacccaggtacagactggctgtatgtgactgcatatgacttgagggatccggtgcaaagtgaagaaacggggctccttatgccaggatggcaaaggatctcagacaccaacggcagagctgcagccaaacgtgtgccttgcgagcatccatcgagccacttctgcttgtactgacacttccttactaagcaaacaacggcaacccagaccccactggctctgcagactctcctctagagaactcttggaatccccatgtacagatgagcaaagtatctctcaggatgcagacaggccctcctttcacgtctttggccaatggctgcctttgctggttgccaagagaacctcaccataaaggtggcaggggctatttccaaatcagagagagaaaacagattcgggaaagaatgctccaggagactctgacaatgggcaggtagcccaggcaatgaagtccaaggatattctacattgtcaggaagtatgagcagggcaaggctagggagatggtttgggggtcttcaaataacagagttggaagccgtccaactcctttgcctatatccagagtgtctgctgtctcttttacagaagaaatggaagctaggatctcataaatagctggccagcatggatttattgcccatttggccaagaactttaacctatgttagccaagtcagtgagcggtcctgtgccagagagcaggaaggtccagggtctccccaaggaaggatgctacctacttggtgcactgctgggttttgcctttggggcagggatgctcagcttccttcaccaactggggttaggggtggggcaggtacagacagaggacggggtgctctgtgacttcaaatgctggagccagccctggtggccatctttagttgcagccttggatattagctgtccccagccttggtgggaacccaagaataacttggagagggaaagctgagagggatcctggtcagggagagactggaaagagtgtgaagaagaagggcagtgacttaggagctcaaccccttggtgaggaaagagtgagatcctgcgccctgattggtgaggaagagtatggtgtgaaaaaaaaaaaaggtcttgcttcctgattgatgagaaagggctctcctccaattaaggggcaaaaatgtgacagaagaagccatctgattggtggggaaggaatccttagagagttctaggcctctgcctcctgcccttcctccccaggcgttgcctccgtaggagatgtgggaactttgaataccctcttgccaaaaattaccctggtgattcagattggaaggagctttaggagcggttcagaggccgcatggggagagaggggtgtggctctgaatctctaggtgaaaatacccacccctcttccaccacttgggacccttctgcctgtcctccagggccacatggtttaagcatgcatacttgttggtcccctgttttgtgctcttttgacagcttgtccttcaaggagtctggatctctttccctagccctagcctctgctgtacccctgaggagccccatgctaggccctcacaggaagagcttctcttctttgctttatcctaatttcacagaggaatcgggacaactggctctcaactctcaagttggcttgggaatggccgtggggccctctttaccccctgacttctcagggtctgggaggggcccgggcagggggcccgaggccacccatacactgctgtcgattggctggctcaagaccttgttcagtgtcgagcaggggtggacccagacaagaacagcttggagcaagggcatgtgattccaaacattactatgcagtctccccatttgggaagtttcatagcaacaaatttgttggggtctttctcccctccccttgctgaggagcaatccgggcctggcagggttggtgcatacaaagggctgtaataaacatgcccagggaacaggccgctggactctcagctattcagagcgatttcacagcgctgggccagcctcattatggtgtgggctgttgtcctatacaaagtcagatgagatgaatttctcccctttctctgcaaaatggttcgtgaatgatactcgtcctggaatctgtcaaaagatgggagtttttgtttaccatctgacttctttatggacttagcaggcactttctttttagagcctgcaaagaagacattgctatttagccacctcagccgtgcctccattgataacaatattaatttatcattttccccgaaccatctgtgatggataaagacattccaggaggctcccgtgaaccgaattgtgatgagaattaagaaattaaccaccacatccagcttccccatcacaaaggaccctcgttccatgtcactgagcagcggcctggtcttcccgctcactgccctgcccccttttctcttcttcactgaatgtggctgaaagaaggctgctaagacgtgcatgcgtgtgtgcgcagtgcggagccttagaaagatgcaatcattagtgggaccagccctgccctgcaatcttgaccgctcccatcaacttttcttcctgcagctctgccaagggttggtgggagggggagaagtgagaaccccagtccagctccctctggcttcttggggtcactatatggaactgtctccctggcccctctccacccttggttatttttcctttggatttttttttctttcccttcctggcatcataggcatcttttttacccaacttgtcactcttggttacatgtgaggattacctgggatggtgtaaaatgccacttgggccccaccccagggattctggtttcattaatgggtccatatgaggtggagacaagctggcctgggaaagctctctccaaggctgagaactgccagggcaggggttggtctataggagataaaggtggcagggtgctcttgccttggatccaggacatccccaggggagacctagtttattccattgaggggagagattactaattggtgaattcagatgttttaaagactgtttcgacgaacacttggagggggcacttaaaggtcttttaattttaaatcttgccgggtgagacatgtgtgtcatttgtgtgtcacttgtgcatctgtgtacttagacctggccaactgagtctcagcagagctaagtccctcccacaccgctctttgatttcatggcagtgtccactcaccctagcaaagtattaggtgtctattctccccctttctgggtccctcatgacagttccatgttccataatttgggtggtccggggagaagaacttttaccctcggagtcaagaagataatcggtgcctctcgcttaaggcatgaaggtccctatccacaaagtggcctccactttgcaaggagtgaaagaggcagctcagatcctgcagccagaagagaaactgcaggaagagcgtacctcagcatggtacctcatgtatacagtccacagggcatcgggctaatctcatggcaccttaaatctcagtcatcttacctgtggaattctcttcaggcttctggtcactgagtccctttcagctttgacattccacattctacctgtcattctttaggactcaaacatcttacctctccttgattcaacgggggtcattctttatagcagtgtgtttgtgattaggaagagccaggaaatacggaagggtggttttgttcagaggtcaggacagatgacaagtgtccttgatcctgtgactcacactcatcccgtgcagtataccatggggaaaccgtatccctcagcctagcactggtgtgcactccctaaaaatctttgctagccatctctaccccgctgggtgtgagtgtccctatccttctgccttctctcattcctagactctacacagacattccaggggttctcggtgcttgaccagaaaagaccctgatctttgagttccccaagttcttggtgcttctgggcatggcagtcagagcgctgaagatattgacttggcagacagtctttccttggggtttctgctacagaacatcaggtggacctcgtgtccagcctccaggtcagggctcaggtttcacttctgggtgaggcgtgtttcacagcctcagctttcctggctggagatgggcagaaggatcgatccattcttcctcttagattgtatacgttaaggagagcagagacaccagagtcctcacagcatcagtaggcatacaaagcagcccttttgctatttgttttctgtccttatttattttgatgacccaatgggtttcattagggctgcttatatggtccagtatgaggggtatttacaggggcctagggtccttaccaatggctatactgctgaagaaaacttctttctcccttccccaatgactattaattatttaaagctactcagggaggggtgatgccttgtgagcccctccccttagttaccaaatttgcctgcatgtcttaggaggggtgtgtccagggataccctgacttctcccaatgacggaatgttgacaggcccagttttgggtttcgagccataaatcacaaccgttgtggcatcaaaagtgcaatatcaatgtcacattctaaagaccgtgttctgtcctcccttgctcttacattctctctgctccatctctgatggagatccctgagtcaccgaaagggtgagagagcagtcccatccacggctgaggacttaacagttcttattctcagcagtaaggccagataggagtctctgcagtcctcactgccagctgcaaaaaaacgatcctctctcactgaagctcgctaatctatgggtacaaatataattatttaggtggtaatttgacaggcatgtcctatccatttaggcttgccctgctcttggtgtggcctagctctttggtaactagcctctcggccagagggctcagccccagtgtagactctatggccgattcccacagggctggacagggtcctaagggtgtgccctggtactgtggttgcacactgcctgtaaaggatttgcacgcttcggaagcacagatgatgaataagcccagcggcaggatgtgcccagcagctgcttgtggaggctcagcgcaaaggtggggacagctgcagacagccaaacacagtgtggaaagtgccacttggaagacgaggctgcatctgagggctgcctgcctgaccacactccagcgtgcagtccaccaaagcctggcctgatcctcaccagactgcttgtagctgtcctaggtcaagtgcccgggctggacctttcttcccatctgccgtcctctcagtccaagcctgtgtgcgcccttgcagaaacagtggcactctgggaacatgctaaggacctgtgtttttctcctcaactgtagaacaggtgcaggaagacgactgttcgctagatcacagcgggtcacaataatccagtttagaattatgggctcccctccccgtgcacttcctgccgtctgcaccttgatctgaaagtgtcagcgaaaaagcaaggccatccgccctaaaacactgactcctcagtgccttgttagcaactgtcgtggggagaggaaagcctggcttgaaggaggttgacacagacagctgaaatgaagactggggattactggagatctccaccatcggcccccatgccccattagcatggagtgtgtggcctttgagcttgctgtgacccaggatgtgaggggattgccattcccatcccctgcctcattctgccctccagatgcacaggacggatgaaatggcctctccccagaggagaaggcagcggcttggccctgaaatgaaaaagagaaaaagaagctaattgtgaggtgagatgaggtgagttatatggaagaaataaacagttggaagagaaagtcagtgaagggaagctttctatgagcccctggggtggggtacttagaaggaactggggtgtgaggagaaagcagagagagaccagtagtgcaggcagccccaaagtcatgaggcagctgagtgcctggtgggcccttggtcaagaggaagggagagaatgtgaggcaaggccgccttaccagcatctggcaggtcctatccccaaagcctgggaagctaacgcaaaatcaaggactaaagtaaagagggggatattggcagtcacagaagctccttctgcctctgggagggtgctccccccctttcttcccaccatggcattcccctgcactggggcattgaacaccctcaggcccaagggcctctcctcccactgatgtcgaacaaggccatcctcagccatatatacagctggtgccaggggtccctccatgtgtactctctggttggtggtccagtccccaggagctccagggagtctggccagttgacattgttgctccctctatggggctgcaaccctcctcagttccttcagtctcttctccaactccttcctcggggatcctcgctcagtccaatggttggctgccagcatccgcctttgtatttgtcaggctcaggacacagcagtaacaggcttatgtcagcaagcacatccacaatagcatctgggtttggtgactgaatatgggatggagccccaggtggggcagtctctggatggcctttccttagtctctgcaccatactttgtctccatatttcctcctgtgagtattttgtttccccttctaagaagcactgaagcatccacactttgtaaggcaagccacagtggagaaaccgtactcacatgttccgtatcccatcaagggtgagcatcgtggtgggaagaactctcgaagcgcaacaaccagaaggcaaatgatccagttcaaagtgggcaagagatttgaacagactcttcctccaggatgggcagatggcgaataaatccgtgaaaaattagctgtcactggggaaatgcaaattgaaatcacactcagatctctctcattgaaaataagaaatatgggccacttaaaagttccgtatgcttggcgaggacaaggacctactggagccatcacacacatagcagctcagtgcttccctgaaaagtgagacccagacctgtcataagaccagggtcccgctcaccggcatttctcaggagaaaggaaaatgtaggtaggccctgcaaaacaaacaaacaaacaccaactgcatacagatatctatagtggtcttatttgtaatcaatctattgccccaaactagagacaacctcagggtgtgtcaggggatgcatggataaagtagacacatccccactgaataagactgctcaacggtacagcagacacacgaactgattcctgtgccgccacagacaaaccagaaatgaggttggctacgtgcgagaagttaggctcaacagacgacagacctggcaatcccatacgcatgtgtagacaatgtaaatactgtataattttgggataagacattttgcaaaaggtgaaactagatggaatgggggctgacagcagaggaggagattcttgagagagctgggcaattctgaaccctgatagaggcggtgattagtaacggcatctgtgataaagacctgtagaagtgcactgcaaacaaaatagtggattttactctgtgcacattatagtaacaggggtttggagagatggctcagcggttaagaacactggctgctgctcttccagaggttctgtgttcaattcccagcaaccacatggtggctcacaaccatctatactgagatctaatgcctctggcctgcaggtagagcactcatatacataaaataaataaatcttcaaaatttatactaacaaaggatgagattccttccctagggctgtagcttgggtgtgtccccagaggtagtttgggtgtgtcccccagaggtccactattggaagcttgattccctgtgtagcagtggtaggcagtgtcgaaccctttgtttttcctcctttggtttttttcaagacaattttttcagtgtagttcttgcctggatctcactctagactggcctgacctgcctctgccttccgagtaccgagatcaaaggcgtgtgccaccatcacctgatggcatgtgtagagcagtaggtaagccctagggctggagagatagctcattggttaagagaccttactacacttccagaggatctgggttcagtttccagcagctacagcaggcagttcacaacttcctataacttcagttccaggggatctgacaccctctggcttctgtgggcactggtgtgcataaattgcacatcaattcatgaacaatgaaaacaaacaaacaaacaaaataattcttttaaaaagagacagggcctattagaagatgatgatgtcatcaaggccatcaccccgggagaggattagtgtcagtctctagtgaccccgcttcctgtgacagtggattgttttaagaagagtgagtctgacccttagtgctggctcagccccaggttcagttctgcacttatcaaacaggggaacaccgggtacacctggctctcttgtctctctggctccttgtctgtctaagcaggtgtttccttacctgaggccaaacagatggggccacccaatcttaggctttcagcctttaaagaggcgagataaatataaaatatatcttttcttttctcttcattctttctgttttttgaaacaaagttggccttgaactcctgactttcctgtcttagcctcctaaatggtgggattaaaggtgtgtgcatccatgccctgaaaactgtttgaaagcaatcagttttagggtgttttgttacagcaacagaaaatggactaagacctgatgacactgttccagggtcttatcttcttgtccccatttccctgacaactctgaaatcattaaggggggccacacccaccccaacccaagttcagcatttaatcccctgccctggcctttctgagccaccaccttcttgttcttcttggctgtcctccacattatgcccatgaattcattgcaagatgcctgagcaaccttggccatctctggtctgttccttctcttgcttgctccacaacctcctttggggaatttgagaaggaatgagtgtttgcacgctcctttgtggtcaacacatattctaccttgtacaacctctaagcaggggacagggtgtccatcaggctgggcacacaagcaagaggtatggggatataggaagcctttggcccgcccttgttttatctgaagatgctaggccctatctgtctctattgacccttcttcctttcctgaccttgaagcagctagaggtcagttgacccacaggtcctcagaaccctccctacctctctgcatatctgtatatacagcccagtcttgctcaaagcccagaacgatgtgcccctgtcctagttaagtttctagtgctggaatgaataccatgaaccaaagcaacttggggaagtctttcattctacagcttacagtccttatgaagggaagtcagggcagaaactccagtagggcaggaacctggagcagagactgaagtagaaagcatggagtagcgctgtctactagcttgctctccatggcttgctcagcttgctttttgatacagcccaggaccacctggccagttctggcaccactcacattggactccccttctcccatcagtaatgaacatatcccaaggtttgcctacaggctaatctgatggaggcattttctcagttaaggttccctcttcccatatggccctagcttgtaccaaggctgacaaaaaactaacagcatggccccgaggaagttcagggcaggcagcctttgtgaatgagccttgcaggtctcggaagccctgtggtctcctgattggctctgccatcaaactattccttgtggaatcttgatagttcctcaagttctctgatgggccagggccctgatattccagataaggtagcttctctgcctagtgtattgctttatgctctgggaggcttgagagagagagagaaaaaaggttccaccaaccccctggattggtgagaggaattactagcccttggctttccagcactttctatttctaggacaagagtagagaatactttacccaaccccaccccaccccacacacacacacacacacacacacacacacacacacacacacacacacacacacaggggtgtcaaggttctgaggctgggtccactgaaatctcttgcttgaaggttttacttcctcacctcacctggcctctgatgggccctcccccctcaactgtactctctactcaggcctttaccggccacccttttagaaatggctgctaatatccctgggcttataggaaatcagagctagcaaggactctggggatcatggaagccctagtaagtacccagtcagtttgttacagtctgagatcgcccagagatgtgacctaccccagaaaaggtttctcttccttggcagaggtggctagtgacttcaccaggggagctaagctacaagaagctctgtgggcagatgaaaggcagagccatctcctttaaagtccaggcactggcctgggagagccctaagggatcgatagcttgtctggggtgcagcacaggtgtgctagtcaccttgaaacaccagaacaaagcaccgtgtacctgctgacttagacaacagatagttaatctcccccagctctggaggctggaaatccaaggtcaaggtgccagctgggcagattccctttgagggccaggagggagggatctgcttcaggcttttctcctggccttacagatggtcaccctcatcctgtgcgttcacgtggactttcctcaatagctgccttgtaccttatccccatcttgtgtgaggacacctgtcattgattagaacctactccaatgacctatttttgccacagtcacctctttaaaggattcatatttgtctcatacatgggcacttgggattaggatttcagggtatgcacctcagggccttggcatgtgagtcagttcttaacatgaggctagagtagtaagttttctgggctcctggaggcctagaggacagccagatcctgtctggattgaggaccaaggctgtgtttgttcttgttcccaattacaaagggaccagtgctcagccagcacctctctttcccatcagcctgtgctctagattgatggctcttgaggttctgcttgatctcattccctggagccagggcacccaggaaaagtagaccgagttcccataggagcctcagaagacctccagttggccctgtgagctgctggaagggcccggtctctgcttatgctcaccagtagaaggcaagggccatgcttgggtgtgggaagccattggtcagtactagctgcctcccactattccagagttcttggaagtcccctccattggtaaggtccaggcacagtactagtggatggttggatagggcaccctgcaacacaagctccactccctgctctcacccaggacactgtgatgaacagtagtcatgaggttaaggtctacactctagatccacggagacaaaacccttagtgaagagtagactgatgccttgcagagaagtccaggaagaagaggttaccaattcagaatcagtggcagggacaggcaaggcctggatcctctgtcatctgtctgaagccacttgaattctcttgagcagtttgtccccgtctgctgacccagcacaaacacaggactgggttctctgcagccagctacattcgtgggaaacctgatcctgccatgttctcagggacccacacttccttcacattctctcttcatggaaaaacttctggtagcctatttcccatgagcaggtgctgcctgccccatgtagacgctatggaaggggttgacttccctgtaaaaaccatggctagcttccagggaaatgggagtcaccaggagggcttcctgtgacagaggatgttccagcctgggtcatgttctcagaaaaattagggaagctttctgttcacccccccattggagccccaacaaagtaaaaggccccttccccttgcctcgttctacacttaaaccatcctgctgtgtgcgggtcacggtgtgagtgtatgtgtgaatctctgtgtgttgtgcattcacccatgtgtgtgaccttgtgtctctgtgtttataggctaaggagtcacagccttttactttctcttcctaaggtgccaaggcttccttaggccctggctctctctctctctctctctctctctctctgacaaaggctattggaagtctgtttttccatattgtatttttcagggttctctagaggaacagaacttacagaaccggggtgtgtgtgtgtgtgtgtgtgtgtgtgtgtgtgtgtgtgtgttttattagaatggcttacgggctatggtccagctagtccaacattagttgtatggtctacctagggaaggtccgagaatccagtagttactgggcccatgaggctggtcttcggtatatctcagctgcgcttcaatatatatcagaatcccaaagaagtaggctctgatgccagtgaaggaatagacttgcccatgagagtgaaggcaagcaggtagagagagagagcttccttcttccgtgtcctttatgtaggctgccagcagaagatgtggcccagattaaaggtgtatcttcccacctcaaaggtctgggttagaagtgggtcttcccacattaaatgatttgatgaagaaaagaaacccatcacaggtatacccggctgtttgggttttagttaatcctggaggtggccaagaatagccatcacacccctgtagaggacctcaccacaagggcactgcctcttgttggctttttctctcacacttaaaacccactcttctttgttcagagggtgccatctgagccactctcctccctgtgtctgtggggaaaggtcttactctggggctacttgcctggggatcgggaatgagtgaagggtgggtctctactgggctgcatttggtgctgagccacacaatggtctcacagtgcctgaaagagggcagagctcatttccctgtgaaagagccaggaggagtgctgaggtgtgtcctgaaagggtgaggggtctggaatcctctcctctcagggctccagatccttcctcggtctcaccagctggttgccctgtcctctgacaatcagaccgttctcacagggtatgcgtatgagaatgtaggtgtgctggcgtggtctgttggagtcttgattggtacacctctgctggcagatgctttgttggtggcatggcctggatgtgagcctttagtgacttctgtgcatagatgatgatgggtgtagaagcgtacacacactgctgcctctgttagaccagttgcatgacctacagaatcttaggagaaagatttggaaactccgcagcaagttttggcttacatctaagctgaggatgaacccttaggatgagctgaccatacagagtacaggaccatacagaattcatctggtccctgaccttgccatcgctgggccagccagggtggatgaggtctcagcttgcagggcttaatgcatagtcttccatgttcatccatccagagcttgtgctgggcaagctcctaccaatgtgaagacactctgggccagtgctggtgcctaggtgtgatctggcttggaatcttcggtgaccaaccaagtaaacttttgtgaccttctaaagatccagaagttactggcacacagttgaattccatcggcatccaaggaggatggtcatggtgtgaattcgattgcagggggttggggggtgggggcttgcagagcaggccaggagaggtcagctggcacaagaacctggcgtccctatatatgcctatgcccacatctgtggctcacgactgtgcgatcccatgctgtggcctctattcatacatgaccaactgagaggcacgcccatatcacttctactgcaggaaaaagtcaaaggtcctttgcagccagctcttcctcactgtcaccctttccacaggtcatcaagactagatctcatttttaaaaggggtacagacttggatttagggtataccgatgaagacaatgattcagcagagacattttcccatctacaatggcattagctacttttccccgtgctagtgacaaggtagcccaagggaagatggcgtttgtctcacactcttagagggtcttcctccacgatggcagaggtgacctcgcgctatgcaggatgcccttgagcttgagacggcttgtttgtgtggaatgagccaggaagcagagaaaaccggaaccgggggcagatatagccatataagacccacccctagtgacctactttccaccatctacagtcttcacaatcacaccacaagccatgtaacaaatgctccaaaacatggaagatctataagggatatttcagcctcaaaatgtaagaaggggtaagatgggaacagccccagtgcttctcagagacactatgtcataggagccagcaagctgccagccctccaggcccctctgtcctccggcccagacccttcctcatcctggtgtttccccatgtttctgcatgttctgacaccactgggacgaacatgtgttcacattgctctcctttctgagcgccgtagacaggctggctctatgcacacatttccctgagtcgcctcacggccactcccagactggaggcctagggagaggctgcctctcggggccaagtgtactgaggagggactttttacattagctcttttgggatctcagttctcacttattttcctagatattttttgtcccctttggggacagaaacaaagcagcatgtggcatgaattgaaatgactagagattgctgttactgggacgccctgccctcctgggcttcctgcagcaggaacaggcataacactgcttcctttaccctgttccttccccagcgaagccactgctcaggcacagatgacttgatggtctctgcctgcgggggtagatgttgcttggagcctcatggtggtggcagagagctcccccaaagggaacactgggagggagctttggggtgctttcaccagagctcactcttcaaaaccaggagggtcatatgttcatgcagtggcctctggccttgattcatttccagtttgacccaggaggcccctaggaggttcactagttcaacagttactcgtttagttggggtttgaaggttaagtgttagagtgacccagaagtctgggatctgggcatgtggctgctgagcaagtggcagtatcctaggcacctcctccctttgcctccctctggccaggttccctgaacttcatcagctccaaacccttttccacccaggagcccacagagaaatctggaggagaagccagtacctctacccttcagtgcccccccccttccactgcttgacatcataattaagtgtctgccctccttctttctgggctctgcaggggctccctggctcccctctcctattcctcaagcaagcctttgaagtaggtccattttggtttgggtggtaggtaggcaacccatctcagaacccctagaacatgtgagcttggttaggcctacctgttctttttcattttttttttcctctctggggtagagaccatgggacagccctggacaggaagggcactgacagcctctctgatccttctgttttatgttcacacagcctgtgattgccacccagtgggtgctgctggcaagacctgcaatcaaaccactggccaatgtccctgcaaggacggcgtgacgggcatcacctgcaaccgatgtgccaaaggctaccagcagagccgctcccccatcgccccttgcatcagtatgtgtatcttcttctcctgtctcctggagtgggatgggggagggaccctgtaggggctggttgctcatgtccagtgggtttagccatcaccaatggacatctcttcgttcattggtgttcagtaagatccggtgactccaggagactccaaggcctggaaataccttcagaagcagctatgtgcattaaagccagactgcccatagctctcagtcctacaaacactgagttactggctccaggctggacagcaagactcctctccagcatgagcctgacccctacgtgctactttcatcccagacccagtgagcatggggacctgccacagcttcagattctgaaaagagcagaccgaagccttaggcctttgagagaagctactcagattcttgcacatggcccgtatgacccctatgaagggttaatggagcagtgaagtagaggtcccaaagagatgttatataaagagggtcggtactcaggccttggctctgcagcatctctgtattttgcatctggtgggtcatgctgctgtgaccatgggcagaaagtgagctctggctggcaagtcaggcctaacccaggtccagcctcatcctagtgattccttggctagggctatccaaaccaagaagggatgccctgggcagaggagcaggagagagtctcagcacacaagctagagtccaaagaaccaagtggattctctagagagcgggattggcatgctccacccagggagctggctgcaggctgtccccccacccccaccccccgtcccccttggcacagtgccttgtacctttttaatgatttaaacaaaaaatcaaaggaaggatactatttcaagacacaataaaaagcatatgaagtcacggggcatggtggtgtgagcctgtaatcccagcacccgggaggcagaggcaagaagatggaaggtttgaagctagcctggactacacatactgaggcccctgtattaagttttttaaaaagaagaaaaagaaaaagacatattgtctgcagctgctttgtggaatggcctagctgcagcagagactataacccacacagcctgaaatatttgctacttggcccttttcagaagtcagtcaatctcaatttctgaggttctcagagttccttagtcatctccatgactgattagtgacggggactcagaaccggccgagagttgtggggccagtgcctggagtcccttcatgccaggagccatctctgattcctagatgttcctcagagaagtcacagtcatccctgcctcaaatcggcgggaaccttagacagcccacatctctcctgccccacgacctgtgcttgtctgtctgtcccactacctgttcttgtctgtctgtcctactacctgtgggctttgcttccagaccaggtcagctctggttctgagagcagttctgagcagtttatgaatcaggagtctctgtcggagtgtccctgtgggtattctgtcagcagatgactcagtgttagtgtcaggcacttctgatgtcctctcagggtacagctggtggaaggggtgcgtagaatggaggttgttcagtggaagtgtgcatgcctaggacaccccaggccttgagttcaccccagtgaaaggaaaagaaatccttcccactatggcattcaaacaccagtctcacagcctatagaaacccttttctctgcacacccataaagctatgagagaaacacttagaaagtcaggtgccacgcatatttgggcctctggggaacctgttctgtcagtgagtagcgttccacccccccttcaggttgctcggaatggtgagtactaatccctcaaggacctttcaaagccagtgcctgggccctcttcgatgctctcttttttctgacttgctttggaaaagggagggatgatggccagtacaaaaatctcccccccacccccagacagtagatctgggctccattctaggaggccccaggtgcttgcatggccaatgcttagaaagcttgtgtcctgttttgtcccacctcggggagccatgggccttgtgtgtgcacccccacttcagacaagaagtttgggtatcctgtgtgccccatggccattagtatgaatactcatttgcagacctgcagtatcagagcaggccatttggatattgtttcctgagtttctgctgggaccaacttagccttttaagggctaaggaagggcctggtcctaggcccagcttcctaatgagctgctgtgactgaacacctgagatgtgtgcataaagtcactgagtgcaaatctgctctgcactgtgggctgtcctctgcctttacttcctaaaggcacaaagcctggttcctttaggagacacagagctcttaaagggcaagcctcaggttctaggtgtctagaatccaacgtcagaggaaagacaccagattcagatggtggctacagacaggattggaggtcactcacccacagttatgtgctccttcccctagagcattggctctcaactttcctagtgctgtgaccctttaatacagttcctcgtgttgtgatgaccccaactataacacgactataacagcggggcccagctgaggacccttggacagtagcactgagatgaccatcatgtcacatcctgggtacaagatcagccctgaggaccgccagcccctcccgctgcccctactcctgaccctccctaacagacaggactcatgatatcccttcccagtgaggacaggagaacatattgacatgcccaggatccctgggaccctgctgccagcttccctgtctccctttctctccctttttgttcctttgagctgagctatggagtgggtatgggggagggtggctaagcagcgggaagcgttttcaccgagagccttatctttccaaggaccgaaaataatgtcttttccccccctcatttgtctctctccccttttctgaacctcatgaagagattcctgtggcgccacccaccactgcagccagcagcgtggaggaaccggaaggtgagacaatcaatccccttagcgttttgcttgttacattggctgtatagtagggacacgagtgaggacatggggtgaccttcccccccacattgccagctaggctctgttttgtatgcgtggtctcctcagctgctctgaagagggaaccaccaggcacttcattataactctgctcctaagaataaaagtagaggacgtcttaagagagccgagggccaagaaccctgaaagtgggattctccctcctcgcccttggaggttaagttgccagaacctcacaaatcctgggtcaagggctcctcgccttcctgaggtttggggagagcagggtatacagtgtgggggttgagaggaaggagttcctgggcacgacgtcacagtcagaattcaggagctctgagacccaactgggaagatcatctcattttcacatttacctattgcatgaagaccaagtctctccttcatgacaaaggtaggtgccagccacggctgctggcagtgtcagtgatgtgttcaccatagcagctgaaactgtgttcacattacggatgccacaagatgctgtgtgtgcccctggcggctgagttcctatatctactgatagatgctcttctgctgtcattaggaaagcacacatgtgaaaagttgcatcccaccaacctggaagagttcagataactggacttcagtagtattttcctatgcactgatagatgctccttgccttaggatggggtggcatcctggataagattattgtaagtgagaaatactataaaatgtaatgaatataacacccagtcctcacacagctgatcaatgaactatcccaggggtgagcgggcatagctccctgatgccacccagcatcacaagagagggaacagatacaacctcatctgttcacaatgcgttcaaagcatggcttctacttgatgcatgctgttttcacactgtagaaaaccatgactgttttagtgtcaaaaaatactattctgagaaagggtctgctgttcttcttgatagaggagaggtttcacatccctggttcaggatacacaggaagctcagagttccacaggatgtgtgccctgttaggaccacacctggagacaccactcccagggtaggagtggtaatgaatggcagaatgacatgaaggtccccatgtcgggctggggattttactttctctaggtgtctctatagggagctgggggtgagcttggacactcaggtggtcacctgactctggatctaggggagaactgactgtatgctgggagcttgagagaaaacagattcgaggcttgacatctatagccacagcaggctgcacttaggaagacacatgctgggacatcctggaatcatactgggaacagtccaagataacccagtcctgtgctgttagtcgaggcttctagtagccttgattgaacctctggtgggaggagggtaacaaggaccagggaggggacgccatcacaggtgcctgggtgctagatgccagactacaagtatagaggctgaaatctccggctcaccaccctttcacagcctcatcccagaggccggaagctgattgttttctatactgactttttaacattaaaaatctgttctccccagcttcttgagaggcagggggatcatgtgtttacaagtctgaggacaagatgggcaacacagagagaccctgtctcatgaaaaccacacacaaaagagaattcttcgctcttgctgaagacaaggatactttcaaaacaaaacaaaacacaggtttttttttcttccttttttggattaaaaattaagtcaggtactgagttcacttgagcacatgatctgcctgctggtttaatctctagcattaattaattaattaattaattaaaattaggggataatagttttgaacttgggagatatacagtgggcactggattattttttatgtttgtgtatatttgggtgttcatatgtgggttggagggtatatatgtgtgtgctttcatgttgtatggaggctcaaagttggccacaggtgtcttttcagctgctctgcactgtatcttttgagacagggtctctctcttgttacactcagagctctccagttctggctagtctagcgagccagctttcctggcatcccccatctctgccttctgagggctggcatgacaggcagcttccatgtctgcccaactgtcacatggttctggttatctgaactctaaggccgttctacgttgagccatgtcctcagctccagaatttcaattctcttttaaaagagttttgtctgtgtgtgtgtgtgcacttgccatcagagtctagagcaaggcactcacaattggaccctgtggcattggttgtaaactgcctaaagtgggtgcctgcattccccttgggtcctctggaagagcagcgcatgcttttaaccactgagacatttcttcagcccgcaaatttgattctttataccgtgatgacttggtagtcatctgactacctgtgatacacctgagtcaactcacatggatggagcgtgcaggagcagggtacacagtttgccctaggccaagatggacttttaatgggctgtctgtctcctggaagtttttctggaccttgcaagttgactttgggtttcttgtaattacttttgttttgtttttgtttgtttgtttgtttgtttttttaactttctaacacaaatgggcaaattgaagtagagggccctcatgaagcatcagaaggttcttggctttaagccacaaagactaaaacagctgtggtgctgtagaatcaagtctgaggccagggcaatgctccactccagtcctccctctgagccactccccgcccccaccgctaaactccagtagacagcttagctccatcccttagctaattaccttttctgactcctttgggttttgtgactgtggtttcttcatttagagccatagcagatatgactgaaggtgaaccactccggtgcttttcctgaagagggagtgggaaagcaggtcatctgggacttggagcaatgcctaaagcctcagcctagtctttgtagcctgccctagcaggctctgccaagcagacgccattgctaagactatagaggtggcttttgtgatgaccaagatgacctctcacacagagcctggctggctaagtcgagacgttgagctggaggctgggaggcacttcagaagtggggttctggagctgggcacttccaaactgtgtgtgggcacagtgagtgaagacccttccagaccacctgtggaaactgtgcgtccacatcgtggatggaaattaataagccacggatttattctctaagctgagggatgaaaggtcaccctgaactcaagcccttgcagagccagcttcctgggagaaggttctttactgctcctaggcagggtgacaaggactaagtggcctgtcgcagggaagaccaggaagagagatagagacagcctgggacacatcttgtaactaggtagagggtggagggacctccactcctgtggctggaagaggaacagctgaccggtggcagctctaagcagtttttgacctgcggtgatttgcttttatggggtcacttgggtgagtgggaggagcttgggtttggagttagtcataggccaggatcctcaattgccgctagcacaggttctcccccattaaacaggaagggccgggtcctgcactgcttccttagtgcccctgggcaggaaggaccctttgctcctgctagagcttcctcttctgcagaaacacctgctcactcccctgcggcctctgacaggcagcctcatctgtcatttttttgaggcatgtgggccatgatggtagacacgccttgccttggctcatgtgcagggcgcattgcttccttggaggaccagccttcctgggactagcttcaggataccccattgggattccttgagagttgagtagggaagagatgtgcagggctggcccaagagcccatgagagcccaccgtacctgggctgtggcccttccctcagagctgctaaaacccataccataacatggaagggtagcctttgttggcctccctcatttccaaggttgagccaccttgtggcagctagccctgtccggtccaggagtgaggagctagctagcccctggcttccccacctctcaacagtggtcttgggatgctcccagattccttttcattgctttcaccatgcgtagggacctctgtgggctttttgctactacttcagtggctctgcggtggagccgagtgggtaccatgtagcctttcaggagagcccagagagactttatagctggggtgctggaggagacagccctcaatgctaacaggtatgcactgggggagcggtagcctccagttatttgctaaagaaaatgagttgagatttgcagtgtgggccagcctgggttcagagacacaggaccccactgatctgatctcttgccatttctttctctatataacttataccaagaatcctgttgcaaggggttgtggtgggattatactgcaggcaccgctgattcaagggtggatgcccaataggaattaaaaaccacaaaaacagctgggtttggaggcataggcctgtaatcctgctacctgggagtgtgagacaggaggatcacaactgaaaatctgcttggtccatagagcaaggtcaaagccagtttgaacaaatgagggagaccctgtctcaaactacgaatgtgaaaagtgagccaagcataaggcacagtggtaggatacttgctcgaggccctggtttccttccccagtgcagaaaacagaaacaaaaatcccagtacaaggcatggaggtggaggtgaggctgctccatttctgtcactcttctgtccagcctggtggtactggggcagagctccaccattttggtaatactggaacagaattttaattggagtagtgagagaatgccaagcaaaaataaatgaagcaataaaagtgcggaatggatgtttggagcagacaccgaggagcagaaggaagtggacgttcatggcatgttagggagagcaagacccaaactgtcaaaatgtcagctctcccagaagtgagccacagatttagcgtaactctggccaaagcctccattagatggggcaggattctaaagttatgccagaaggaaaaaaaaatcagtgtgttgtaagaaaaggcaaaatgttttttttaaaggtgactaatgagggtaattagttctactggatattctaaaatattgtaagcagggcatctaaatgtggcctaggaatggagaggtgcccagagggacttggtaccagggcagtgtgtgactacagatgagagaagcaagcgctgctgggaaaactggctgtttacataccaacaagcttagagtcccagctcctgcaggatagcaccagtctgtaataacataaaataagatatatgtgtccacatgtctgtatgacatagtcacacatatgtatgcatgtcatcagtgtgatctctggacaatgaagtcatccaagataggacatagaaacccacgaatcataaagggaagggctttgtagctctaaatggaaaactctggtacttcagaaatctctctaagcaaaaataaaaggcaaacttgaagctaagaaagctattgtgggggtgggggtgggggtgggatagggggttttcagaggggaaaccaggaaaggggataacatttgaaatgtaaataatgaaaatatctaataaaagtgattgtatcaaaaaaaggaaagctattgtattgtggctgacaaatggtcaaaatcctcaataaatgataagcatttatgactcaacaagagatcctaatatgaaattgaattgtagaagtgaaccagaaactcagagaatttgtacaatgagcacaggaagtattctgcttatatgatagcgttaccaaagcaaccatcttcaaaacttcccagatttagtactcacgtgcgtgggatactaggggttcaaatctaggatcctgcacatttgaggggaacactctaccagtaagctatctccctagcctttttttttctttatttttttaaggtttcattttcaaaataatttccattgatatgtgtgagtttatatgcaccatgtgtgtgtaagaacctcctgaagccagaggagggcaacagatcctttggggcgtggttgttagccaccatgtggatgctggtttcctgggactctataagagtagcaagtgcatttaaccactgagtcatctccagaccctaaccccctttttagtttgagatagggtctgactaaattgcccagtctggccttgaacttttttattctgatttcatcacctgaatagctgggattataggcccaacacaccagacctgcaagatctgacacaatttagtagataaaaagcaatccccagtcttgagaagggctggagagacaggcactagaacgcttactactgggtgagtagcctgtaccttttaggaagggagcttgggcatcacatgatccttgtgacagatctctgagctgtgggctcacggctgcctaaggaaacattggtgtttagtagagttgccgccaaagatgatgattaccacattgttggtagtaaccaaagagtggcctacatgtctactgtgttttttgagacagagttttgctgtgtgtccctggctggcctggaactcaactcgagacatagatgaggttggccttgaacttggagtagtctttctgtgtctgtcttccttagcactgggacttcaggtatatgccagtgcacgcggcttgaagcagccagcagttactcagtgtagtctgcctgtaggacatgtgaatggagagatccttgtgtccgctgcaagtgacagaggcaatctgtgcagcagactgtatgtagagagccaagccatccttggtgcagagattggtttatagagtgttctgattaaatcgtttcattatgtctgtgtatctcactgcttctcaaccagggactcttctgtccccaggggacatttggcactgtctggagacagtttcaattgtcacaactgggggtagggcgccacaggcatctcatggatgcaggctgccagacaccccacatgcgtgggacagccccacaacaaagagttcgcggtcccttaaggccaacagcaccaggcttcagaaagcctgctatatttatatagtataagccccatgtgttctctgcaaatttgttgagggaggccagtcttcctggacggagtgctcactcattagctatacagcgcactgcagggatggggctgaggagtgggaaggaccaggctgttaaaagccagcagacatttttgtgggattgtgtttagctgtttgcctgatctggttttttttttccatgctaaaattcatctttaaataaaagttgtcttgggtttcactataaattgatgtacctcaaattaatgtgatttaactcattaaacatcttttttacatttatttatttatttaccatggcaagagcgtggaggtcaaagcacagtttcacaagttagctctttccttttgcccggtgggtccttgagttcgaacccaggttatcaagcttcaccctctcactggcctttactagacgttttatgctgagaaatttcacggatgtagcagggatggtaaagagcagggttctcatcacctaggttaataactccattctgttgtttgtttcagcctctctttgctttaatgttcatatatatatatgcatatgtatttatatttgtagtctgggatcacccaaggtcttgtgcatgccaagcaaatgctctcccccctgggctacaccctcatatgtaaatgcctttaaagaaaaacatagactttacaccagcctatccctaaacgtttcagaacgcacctctggaaaataagtgtctgacacacagcccgtgttcaggaatttcttggttgttccccccaatgtgtcgtgcagctgggctgcttatggcctctccgttaagtcattccatgatggtgtgacccactgaacattgcatttagaaagggtcctgggatgctttcaagaacatggtggatgggaagtgtcaccgccagggaacggtgctgcctatgtggtgcctgctatcactagtgaccccgtgagcccttgaggaggaggtcatgctgtgtccagcctgagctcagggcaaccccctggctttgggatgtctgagttctgaatttccctcacaggggtacctcagagagaaatgtccagagctgccttgtgtcatcttggtgagtgtagaggggttagaagatgaaaaggatgaacagtttttaaaaagggccatgctttttaaaatgtgttttgttttgttttgtttgtttgtttgaggtgctaggggtagaccccagggttccttccactctgggcaagctctctaaaccaatcatactagggtttcagccagagtgtccaccctcagcagaaactggctttgggctggggtacttgtggttgtggttggggctgtccacgacacaaggtgtggagcttttcaggcaagtgatgataattggtgtccccttggcacaaagcagcagcccctagttgaacatcactgggttaaatccagatgttgtgacatcagcctagctgccagaacttcccaagtaaaggggaaccagagatagagcgaaggagaaggagctatgggtctcttccactagccagtgtgtcttgccctctaccccctggcttgaggccagactaatcccgtatgtattatgggatgtattatgtattgggttgaactttgtggacttacagtgcctacaggacactgttggggaccttcaagaggcaatttgatgtggacggcttttgagtggcctaggtgggtcttttcctctttccttctccctctctagctgccctctctattctctactctgtcttctctctctctctctctctctctctctctctctctctctctcacatacacacacacacacacacacacacacacacacgctccttccctccctccctcttcccccttttctccccaccccccatctctctgtccactgccttcctttgctttccctggtcccctttccctccctgctcttccttcttgagcctgcacagagggcagggtggaggtcaggctgggcataagcaatgttaaaaagcatctgtccccacccctgctgccagggatccttgtcaccctaagccgcacagagcaatcaccctattgttcttctgtctctgggcttttgcatgtggcgctatccccagcctggagaaggacaaagggatgagtcgggaggtcagaggagcaagtgggatagaatattttagtccttcgtgggcgttcttctctctaggacccgagggagatgcataatgaggcaaatgacaggtgtcagggaaagaaagaggataggaggctctggtaccacaccccacatccacacccacatcccacatcccagggatcttactggcaggggctgatgtgcaggtttcatcagagcttggctgacctggggaagatgatagagcatctcggggtgttccagctcctacctctgccctgaactcccagacttcttgtgaatactgggctaagctgttgctgtcagtgttgtccctcagaaccccaacagccattaaagtggagtgggtgagtaaaaccccctccagccctgaggctggagcatagcactcatgttgacttctttgactaaatacactctcagatatcagaccacctgccttagttagagttttattgctgtgaagagacaccatggccaccaagactcttgtaaaggaaaacatttaattggggctggcttacagcttcagaggtttaatccattatcattatggtgggaagcttggcagagatggtgcaggaggagccaagagttctacatcttgatctgcaggcagccaggagggcactgtcttctgcaggcagcagaaggggggactgtgtctcacaggcagccaagagaagtctcattccacagtaggcagagcttgcttgagcactaggagacctcaagcccatgcccacagtgacacacttcctccaacaaggttgtacctcctaatactgccattccctatggccaagcattgaaacacatgagtctatgggggccaagcctattcaaacctctataccaccccagacttaatggttctaacagtcaccattagagccatcaaatccacccttaagaacctagctatgaacaggtcagtgatatggcttccacatttgatagatggaaagctgtgtcctggaggagggcgaagacttgttctaggtcacatgggagattgacagtttacagtcagcctggtttccttacagggtgagatggaagcagtgaatgacacacacacacccctaaccgcccccccccacacacacacacactggagggagatccgtaattcatggaccattcgagacaatgagtttccaagaaagcagcacaaagatttttttaaagttatacttttttgtctttcttatttttattttatgtacaggagtgctttgtttgcatgtatgaatgtgccaaatgcctggtcagaagagcacactggatcccctggaactggagttgtggataattgtgagctgccatgtgggtgctgggaactgaaccctggtgttctgcaagagcagccagtgttcttgactactgagtcatctctccaaggttgtcttaaaggccctcactgggctgggctccacaaggccagaacctttcccttcccaccttagcaggtgggataactcatagtttccatagtatttataatgccccagtttgggatcagagaaaggagaaacaacctttagctgcatctccttcagtcgcagggttggtgggtaggttcacctgagcctcacagaatctccatcatcaccagacagagaagcctcaaggaacccttttggggccggataatccagcattgtcttcactctggattttatgtctgccctttgtcctgtatgtggtggtagttttattgtatgttcaaaaggtgatatgatgccagccatttctttaggttatttggggtcaagtatcttgagttaggttctctagaacctcgggggcctaagacaggggttgctattgaagtcatttactgaggggtactccaggcaaggaagacaagagagtatagggctaaaacccctccagaactccgaggaggcaatccggtgggagaagataccatagataaggcagaagtcaggacactacacttctaacatcagctgaccattggcttgtggcctccctactggaactggaccgaagcttgtgactgcccagatactgcccggcaaatcagtgcgcatcaaccaaaggctgcaagcatgcgtgatttgcagccagtacctgcggcagctgggatgggtgtggtgggctaataaggaggtcagagcgggacatctaccacatttgctacctcagccctctgtgactatgggtttggagtgtgtggattcaaccaaccatagatttaaaaaaaacaaaaaaacaaaaaaacaaaaaaacacccaaactgcattatctgtactgaactatcctaaccttttcccttgtcttcccatgaatacagtctagtaactgttcaacatttgcattacatcaggcactatgagctagagatgatttaaaatatgtgtgaggatgtgggtaggtcctctccatgactccaccacactgtctaaggaagttaagtatcctcagctcttggtccctgtcaggggtcctggactcctccaattttgagggtcaagtaagtaatttagaaggttttgtttgggcccaggcacaggtttctcttttggccagtccctagcagttctctactgcagaaagtctcggctgttctcaggggtcctggtgcccttctcacagctaactaactggacactcagacatcttgcagctcttctctgccatgcacaccactgctgctgctgccgccgccgccgccacagcctccacttaagaatttcttactgcctgtattgatcaggtatgcgtgacaataaacctcttgcagtccagggattgcttgctcacgcaacagccatcacccacaggtgtccctagttggatgatttctttctggcagtgagtccatggtatggctctgccatcccttggggccgccgagtcactgctgggaagcccctgggtgatttctgtagcctagaagtgctcagaatcacctgtgctcccgtctctttggttagaacccagtcacatgaccatacctaaccgcaaggggtactgagtaatgcaagccatattcatgcatacatggagaatgacatagtggttggttaccacgtatagtttgcacataaatcatttggaacacactgctgacttctggtgcatctgtggccacctgtcactgtgatgctgtagttattggcatcagaaagccaggccatttttctgtgtaggaagcagtttaacccagtcttagccagcagtgtgcttcctgcctgacagctgcctggagtttaggtacagggaaacagagcaagagtgctaccaggctccaaggcatgacctcatctatactggcttaaccagctgagctggccagccagccgaggtgatgctccagggctaccatccccttctttcacggcttcccagggagcccggctcagctcatctgaatccccccttggcgttgacagcaattccagtttgtgtccactgttggctctcgctggagaagtgtgcagagagccaactgaatccctgttgggacagctttgttttccccgctgaacacaaaatcccctgttcactgggagatctgacaaggagaccctgtggggcaggccggtgggagcagataccagtgaatacagcgccacgaatagcttcagcttattaaaggcgaatacacgggataactctgcccgccgagggggagatagaatgggggcacagagctgttacagtggattagcagccgcagacagacggaggcaggtgcagccttttctgcaatttggaaaggcttaggaaatacagagcctgtgctgtgaatccgtctcttggcctcacttgggctacaggctggaaagtgtggggtttcttgtccagcctggcttgggagtagttttatatatttccccttgttcactcatcaactcccagaattccttgggggttctgaggaggctgtgcacttgtccgcttattcaatttctgcctgttcatccatcccagggtgctgggtaacagagctgagtagacacagcactgtggctcccagggacccttcgagctgtgctgtgtgaggaagacatctaagaacagtgaatggttccaattccattttttaactgttagccaacccccagatccacagatactgatgtcacctcctgtggcctgacaggcgttgctgagagcctgctgggtcttcgctgctttagaaatgaagcctcaggtccaggggggcttgctgatcttccagatgggctgctgtttcccagaggcacaggtggcagataagagaggaagatatactggtccctgggtatccaggacctgaggttattagagtctgcaaatgcttaagtcctttccataagctagtagagtgtttacatggaatcgtcttacatctttccatatactgtaactcatctcttaatagcacatgtctagaatgacacacatactgtttatatatagttttaaatttaatttttaaattatgacggtgtatgtgcctgtgtgtgtgtatgtgtctaggtgtatgcacatgtgagtacagtacttgtaaaggccagaagagggcatcagattccctggagctggagttaacaggagaggtgggtgctgggaccagagcttaggtcctccagaatagccacaagcactcgtactcactgagccagctctttcaagagcggttttctttagagaatgatgataggaaaatgtcaatgtttaatacacatacccctttttctaaaatatttttatctatggtttgtttagtttgtataggcagagcctgtggttgatggagggctgattgaattagaatcggtaacaagattggtaatttggagtcttcaagaaagaaaggaaaaaaaaaagccaacctctaaaacagtggttcaagacccccttggtgattgaacaacccttttacaggaattgcctaagaccatcagaaaacacagatatttacattatggtccacaacagtaacaacattcattatgaagtagcaacaataataatctatggctgggagtcaccacagcttgaggaactgtattaaagagtcacagcattaggaaggttgagaaccaccgctttaaatgactgaccataggggacagaattggaatcttggaaacgtcttaggaggcttcttagcttgtatgcagatctttgtctctgcatcgtttcctcctgtgatgggtacccacctgcatctctcctggaggacaccctcaccagctgggtagctcatcacaagcagagggaagctctgtctatactctccagggtttgcagaactgctggcatggtgagagtcttggattttgaggctaatgagaagtttctgaatgtgtgagcatgtctctgggaggaaggagagaggatgtgtggatcaaccctcagaaactccagaaagctcagctaccaagcggggaggcacctgagaccagacagctccgagggagccgtgtgaatgtgttcttgggggggggggggactctgggtattactctccagctcccaatagaagctggtgttcgtgggtaccagcctctgccatccatatccccactcccagctaagtgaaagttgtgtggtgttttgtccgccaaaattgttctagattctaagaggcctgcccagcaggtagttcaggtgtgctcatgggaatcacaaatttgaaaccaacctgggcaaaaccagttttaaaatgaaatatcaaagagtttggttgaagtttggcattcaagcactttcctaatgcatatgagatcctggatttgctttgcggtttgtttgtttatttgtttgtttgtttgtaatgagggtcttgagcgtctgtggatcttgggacctgaagatgttcttggagcctttgtctctcccctagatactggggtaactctgtatagaccccaggatactatgctcaaaatttggcagtaaaattgtttttagtctttgtaagaataattaattaatgtttcattcataattaaactatgatgtcctgaggggcttcgcttgtgggtcgcagctctgcctcttaggaagcttttaccattcactgctcctctccagagaactgagggaaacagctgagtggttcctgtgtgcgctggattccaggctgtttcccactgggcgggcccagctagccaccaggtggagaggagggagggcttcgttccatcctcacagaaacaggaggctgcatgaacctagacagacactacgggggttctaactgcagagctgggtgtatgggggttcacgctgagtctgtcagtggtaccagaagcagagggaacaggctcttcctacagactcttcctggagggctttcctgttggttcagtgcatgggttggtataggccgttccaaaaggtggacctaagaccatccggaggttacagaagtcagatgaggctcagccaagaacaatcctagcctaccccttggaccagtcgtaaacttcagctcacaccagaggcaacaggaaagccagggcaggcctgctgctggtatcatgagatctcctttaactctgccagagtatgttttgtgtcctgtgtctgttccagcagtcagcagaaagttacagaatgggtcacgaatggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagatacgaaccccaaggaccttgtctttcttccttgcttctttctttctgtttttttcctgtgtgagttctcttttagccctggggccagaagtcatctgtcattttgatagaggattttagaaatagtttggggaaaaggaatttcctccctgagtccaacatcacttcaaatacagcagactgaatacggcttgatttcccaaaggcatggctcacggccgaagggcagcacgcacacagaggaggcagtatttagggaagggtttgacagaagggacgaaagatacaacagcagccatgtagaggttcttctcagatccctttaagaccgggcagcctctgcactggacaggggcacttaggggtacgtgctcaagtggtcctcagggtgtctgtgtctttggacagagatctgccttagttccagggggtggctgacacagagctttttttggcctctgtctcctcatgggtgacagtcagggcagccaatactggttcttctacttcttggtggtaggggtcacacggagagcaagttgcagccatcctggttttgcctaccacatccaggcattcttactacctgggttgggtaccattactgctccaagactgaggcagttactacaggtggggtgcagggcaaccctgaggtctgcagaggtcttcatggcatctcctttgcataatcaacattggctttttgttgttggtggtggtggtggtttttcgagacagggtttctctgtgtagccctggctgtcctggaactcactttgtagaccaggctggcctcgaactcagaaatccgcctgcctctgcctcctgagtgctgggattaaaggcgtgcgccaccatgccgacattggctggggacctgcaggaggacagccgagggtcaagagaaaattctggatgtctgggagctggtttagccagccaaggtgtcctttctccagtcaggagggcgtttttgcaaccccagaggctctgggcaagaggctctaatctaattacatgctttatttgagccaatttgttttccaatccatcttgttcagcaagaagaaagagcatgctggggactcatttgcaccctcttgttccaagggaaaaaagaggggctgctccctcctgtggtcagtccagcccctgacctcttctagcctggaaccccacccccagtcaggcccgcagaatttacaagggaggcccggggccaccctaagcagaagggcctggctgtttataccacgtccttaagtccatcatgcctctgtctttccctttggggggaggtcccagtgtgttctggaagactgaggcacggtggaccctgagctcaagtagcctggactggggctgctcatccctagggggttcccctgcacagacctcccatctctggagtgagagctgcctgccgagtccaagggctggtatttaaaatctgcaaatatattttcttaagaaggtggtggattttggatccgtgttattaaagtccaaataaaacaccggagcccatccaagctcccaggatagggaagatttatcggctcccaccctcctcctcaggcactgctccatgtgtgccaagcctcacttttatgttctgcggtgtttcccaaattgcctttttccaccctttggaatctcgtttccagcctttacttttctaggctgccccagactggctgcttcctgtgggttctgatcctgagcctagtgacttccgcgcttggactaaggcaagcaggacctagggtcttagcctaccacacgcagtggcagcctggcctgttcagcaaatacctgcagagagcctgttgagtagcctggtcctggggacccagcacacggcctctgacttcagacaggagcagagacagataaaccgagagtcctctccttgcagtgtgggggatgccctgaggacaccaatcctctaaaaacagggggacaggcagaggtcagccataacttcagagagtcaaggacatatttgagcgagacatatcttcgggcttaaacagaaattggatgtgacagaaatacagtaaagttgggttcctctcacgggtctttgcggtagagtaagaatcatgagagcttctgtgatcctggtgctgattacatgtcaagccccgtcttaccaggattgtaaaagatgacagccgtagctccatcgacctaagtcaggaatccggagctgtaaggcacagtgctgtgttgaaggacatccagttgtgtggggccccagtgccagcagtctccaggctgtcagctcctctgcactctcccccaacatcccatttcctgcggtgttcccagtagctaagactgaagtgacaagttgccttctgaagtcccactgaagccacctgctcccctcccccgccccaacgcaccacaccctaaagacactacagtgccctgtacagaagctagaggcggtctttctaggtggtagcctgtgtctctgagagcgtctaggcctcctgacttctgtgtatcccctctcacctccatcccagtgccagtgtccacattatgatcagggtgctcacaaggctgaagaactagccaggtaccttatgggcagccagccggtcactatcactatcacggaacctaggttagtagctctgctcgtctgaacaggcttgctcactgcagctagcctattttacacttccctggggccctaaggagtgttggtaataaaccccatgccaagttgtggggcactggggtctgctttctaggaagaggaccagcccattccagactgtgaaatgcatagtaagatctgagaaggttctccgctgtgctcagagggaggctgcccagcacatgagaaggaacaggctcatttgagtcccaatggagatacaggtatagatgctgagcctatgcaggccagttatacagttggttctctcgtacccccaggcattgctcaccccaaactcccgggtgggtcccccgggccacctttagcccaacggtcccttccaacagtctgtctctgccctccactgtcattcctgcctgaatccggcagcgtgttgctgacactgtcgttgcttctacccctgttcaccgatggagacatggatgctcagaatggtcaagggccccagaccagaaggcataacttgtaggactattttaactgacagtcatggttcttgctagagcctcaactcagttgcttccacttaaagccttggtctccagagtgagtacctggcatggtgagccacatggacagcctggaagaggggcctttactgtggaacacaggtttttaggaagaagggaacttagatactcaggagactatgacagatctatgggaaccttgcctggtatataagattgggtttgcttgtttgttttttgttttttaaaagatttatttattttatatatgtgagtacagtcaatgtcttcagacacaccagaagagggcatcagatcccattacagatggttgtgagccaccatgtggatgctgggaattgaactcaagacctccggaagagcagtcagtgctcttaactgctgagccatctctccagccccaaggattggtgtataaggttttattgcatggctttccatgaaaagtttgaagaaggccaggtcctgggtaccttatacagttgcatgtaccctccaggagctgcctctgccccttttagcacatgaagggttctgtcagatggtggccacttctggggcagaggcagaaggaaagggcagtatttcctgggagtatcaggtcggggtgatgtgtcagcctgtctcaaccagctgattccccatattcattgtatgatgaagcagggtgtgaatccttgttcttgtgcacccttctctaccagggcacctatctactgtcctgaaggaagaaacaggccttggcaagaagcaaccctattggaatacagtacagagctaaactcgcacacaagggttgcctaggtagcccagagcccaatcctaagaggaaggaagagccagacctgactccttgtgaccagaggtctgatgacaggccaggtttggaccacatggtggctttgcaccagtcttgaagtagaaagcaagccccccaccccctttttaagtctcacatgccttcagaggcctcacaggatagccctgtgttctcttcttgctcattctctgaaggacaccccagtgggctgtgctaggctggatcctgcctcaaggccctgtgtgtgccaacctctccactctgctctcctctcccagatgaccctgcccctctttacactgttcaggtctctgtaagatgtctacagcaagctcttcccagccaccctgcctatgacagtgtcctcactctcaacagcatgttcttgtcatggccacggtgggtatgtggttggctaatgatgctcgctgtctcttgatctcttggtgtcatctgtgtttgcagttgggagaggtgctggcttgacctgagaagggaccggccagtaccaagggttatagagacagaattctcatcctacgaggaaatgacccctgtcctcaggacatttttaatgttttgggttttgtggtgtggagactaaacccagggcctcatgtatgctactactgagttacatacccagtcttttcatgtttaaaatattgtgatagagtctcacagagttgcctaagttggctttgaacttgttcagtagtccaggcaggccttgaatttgtggtctccctgcctcccacgtagctgggattatgagcctatgctactggtgtcaagggttttgtttgttttttgatttttgggttgttgttgttgttctatttttctttctattttgagacaaggtgtcaatgtagccatgtagccatgcctgaactggagctcactgggtaggccaggctgatctcagattcaaagagatctgcctgtgtctgcctccacggcgctgggattatcggatgcactaccacatctggctttttttttttaatgtgagaattatatcctgtaaaaatttaaatgtagatcaggcagtgaagtaacaatataaacaccaaatatggtcccaccagacccaacacttcagtgcttggatggccgtccctgatcgcctcgctctgaggtctttgcgcctgctgggatgtgatctctcagactggtggttctcagagctacctcaccaggatgacattcatatctctgtgggtccccacttgcctcctgtcctcctctaccaatgtgtccccctcaacgacctcactttccagctgctgttctttcatgacactcacaatggaactcatgtgactggcctgcccccagccctgacaccatagtgccagctgctgtcatttgtctcatgatccacatagaactctccagagtcagccatgtaggaaggtgcacagggaaaacctctctcaagcaaatggtaaaatcataaaagcaaggttgccctgtcaaaggagagtggcctcaggattggggcagtcagtactaggggtgctttagtctcttggcacaagagtgtgtgtcatgtctggagtctctcctagactggtggttctcagtgctacctcaccaagatgctaccttcacgtctctgtgaaggtcagagaacaacatgcccaagttgctctttccttctcccatgtgggtaccggggactgagctctggtcatcaggcttggcagcaggcactgtttacctattaagcatcttgttgaccctacctttgggggctttcttcaacttgagtgtcacattacattcaggtcctgtgtcagtctgttgccagaagtggcttcactttaggagcctcataaccccaagtggacattttattgttgaggctcagggtgatggatcagtgggtgagaccagcgcacattaaaagagatacttgcatggaggttatggagctgcatgaaacttggatcttttggagaagtggctggatgcttgcaccagtgcctgttggtgagagggctgagaaggtggtcttacctgacaggaaggaaccacctgcagccaatgagcaggagcaagagtagtgtatttttttggctactttactgggttcttatatctaccgccctgcttcacccttatcccctccaatccccccaacactctgtccagtgtggtggaccacactgactggtgctcctcacttagctacccaacccacagcttcccaacggcagtagcccaggaacaggggcagaggtatggctgaagagtgtgccagggctcttaagactgaaaccccctgttctgcctcctgctagactaggtaggagagaagttagagtgggaaaggggatgttgatatcactagcttacttcctgctgatcaggggaattgagttccttggggcaagccccatctttgtcattagaatatctccaactaggaatccagcaatagcaaaagcagcagcaggctcccctttcgaggctcttctcggggctcttgcatttgtaccgtctcaagagtctctaaaattccaaatgtaaaccatctgcagctggcaaaaatcacgcccctgctagagcacgaggcaaatcatagttagcggctgtgaacaatctgaagcagccctttatcccacacctgggactaaaactaaaccctattcacataattgttttaaaagaaaccacaattctcactacaagcaagaattacacttgtgggagttctttccccactgctcccctgatagctgttgtgaactcctgtggcttaccctgggtaccctggatgctgaacgcattcaagttgggcttgctggcctgggcagagtccatgcagcctacagctgtggtacaaactggttccacttgtcttctatcatgtcagacagactgcagcagagtgtacccccttcccttgagccatctcctctagttcagaaggagccaagaactttcccagcacctagccatgggagccaaagctcatccatgtcctcgggatgctctgtcctgtgtggtggaccacactgactggatgctcctcacttagctacccaacggcagtagcccaggaacaggggcagagatatggctgaagagtgtgccagggctctaagactgagacctttgccagctctccgccttgctctgaggggaggtgccagctgcggtaccccaggctcccgccacaggccaccaggctctgcttgccatatgcttggagatgagcctggggcagcgagcaggctgacccagcagggttttggcatctaggtacaggaggcagaacaggggggccagctacccaaggtgcaggagaggcctgaaggggttcagcctgcagggcacctcttggcttttagctgtgggttggtcagaagagcaggtgggaggaatgaaaaggaggtaggctgctcccgagagaggctaggatgccagccagacgggatgagccggcccaggccaggcagatggccccttctgggtcccagcagccctcctccggacagagaagtggagaccaggtggcacctggggcggagcctggcagccctcgtctttggttggggaggagagcccagtagaaggggcaccttatagcaggtgcccctatagagctgccagggtttccctgaacattcagttggagacctacaggatcagcaggagtgtgatggggaccactggggagagtggatgggtttctagaagtcagatgatggtcactggtgtgccggatcttctgtctagtctggagtctggagttttgttttaagactgagacatatgaaatgtggttttgttgttgttgcttgttggcttgtttgtttcacattgtgaactggttaatctcagggctcttatgcagtctgtcctttaataatattccatttctttttctatttctaaataagttgagtagcatgggacagccgtgtccatcacaggctcccacggccctgtttccgaaaccgactcgttctagacatctcaagtctgtctattcagttcggtcatttcagttctcccgaaaacatgcgtctcagtcggattccaggattctcgcccgaagtcatcatacaatagccttctaattcacaacatttctgtaggtcatgctttcctcattcttctgagtctgtctgttttccttcttttattcataattagacatgacaatgttttgtctggtctttttttttaagtttgtttggaggcatttcaaagactcaggctttgtgttcgtgtaattttactccccctcccccccacacacacactcctttcggcttctgctgttattaattcttcccctctctctctgagtttggttttactaatttctctaagtttctagggctgagtctggcttacttattttgatcttttcttccgtcacaacaagcattattaattatagtgtggtcaggaagggtggcgtgtacaacttcagcttcttggaattaacttaatatttttctacttatacgtctctgtctttctccccttaatatagttcagtgaaatactatacacataaaatagttaaaacacttttacatttgtttatttacttatggtgtgcatttgtgtgggtatagtgtatcatggtgtgtatgtggaggtcagaggacatcttgggggagttgattctctcttccactgtgtgggctctcaggattgaactcaggttgtcaggcttggccgcaatcttctttaccctctgagccatcttgctggccccataaactaactaattttacttagtttctttattgtgtgtattttaagcatttttttaaaatcctgccttttccgatattaagatttctacttcttgattaatttttgtttgtctgtatttgctgttagacaatacctctgtccctatttaaatggtcctttaaaattccacttatatccctgcatataagtaagcacacttgtcaatgttacaatgtacctgacaaaacaacttaaaaggaggaagggtgtattttggcttaggatctcgggggaacagtgcatctgggcgtggcaaggcaaatggtccaggtggtatcagtaatgtcaggtcagggagcccagcagaggcagggaccactctctttccttcttctcttgtctctgagcccctggctgctggctgctgataacacacatgttagggctcctcctgtctgccattcctctagaactgccctagagatatgactgtgtgtctatgcatatgcactctgtgagtacaataccggtggcggccagaagagggtgtcagatctcctggagcaggagttataggtggttgtgagcggtcagtgtaggtactaagaaggtgtgcacacatgacctctgtatccaaccagctctccgccccaagtgattgttcgtgcagttaaattgacagtgaagaataactgtccctaccttcttagacagtaactgaatgttgtgaaatcagtattggaacaggatcctaactttacttttaacattttattgccaaatagttgtggggtatttttgtgattttttttctttaagtttttataaaaatcacagggacccatcttgcccacccctcttttataatcttactttatcaaaaaatgcctgcttatatttactattttctctggcttatcttttggcataatcttaattataatttatatcttgttctccggtgttttgtggtatttaaaaagaagtatcttatttggcagagtcaagcatcaaataacatctttgacatttttatttaagcagtttgattccctgcctcattctactgtgttttgttagtatgatctacattttcaactaaattcttataatcagatattcttaatgttcctctgtaagcattttaacatgttttgatatgccttaagttttagaaccaaatttcaaacttttgtctttaatgacattggggcatattgtgtcataggataactttctcctttgaaagcccttttttataaattcattttataggtggttggaaaacaaatactgaattattttccgagctctgcctatatacttgaggatgttctttttgtatgtatgtatgtggccagtgtgtatgagaagactgtcataaaattattgtgttggaaaatttctccctgaagacactatagacatcactcagtgatcatctgcccatttttagttatttttttcaatctctagtatatttttcttatcatatgtaatatataggcacttcctatgtattagagacatatctaggcattgagctgtttcctttgcttttgaaaagagtgtatcagggctggagagatggctcagcagttaagagcactggctgctcttccagaggttctgagttcaattcctagcaaccacatggtagctcatgaccatctgtaatggaacccgatgctctcttctattgtgtctgaaaacagtgatagtgtacccacatatatgaaagagagagagagagggggggagggagggagggagggagggaggaaggaaggaaggaaggaaggaaggaaggaaggaaagagtgtatcaagtccttttcttctgcacatgtggttctgtcttgggcttagggtcctacctatccttgattccgattctgtttggccactgctgaagtgcagtcatgtgtcagctctctactctcttgcatgtccgtttcgtctctggttttcgcatctgtatcctttccctctgcatactgagagcttcggtagcacacactccacgctgagtcacttgctacagtacccccttcccttgctgtctcagaagtgacttttaattgtgctcctgtgacttactttagtttttatttccccaactcttgtgtaccccatggcctttgagttcagccttgtcacctccctggtttcacggaagccatatctttttagaaatacttgagcctgttatacccattgcaagtggttgccatgggagaggtaagtagatgtgaaggtttatggcccccgtgtgtttgtggcttggccctctgcagacccttgcatggctctgatgactggatccccatgtcagacaggcagtctattcccttgctacctggccttttcttggacttctgttctgtggagttggtaccttctctgttaccactgcctgactttctgattctctgcatctgtgagttagataaaaatacaagttcagagagggactacaaatggcttacagccctgccttccttaaatcccctccctgcctatgctttctgtctgtctgtctgttttctgctcattgtcttgctgtcatctcctcctcctcccccctcttcctcctcctcttcttccttcccctcctccttttttttgtgatctttctgttcgtcagacaaagaactgtttctggaggtaaacgccggctaggccctgcttcatcccccaccatctgcctttaattaattgagattgctcccagattccggcattgggtcatctatcagctccgttcttggcattcgtgtgaattttcattttttcactctctttatagctgttttggaacaaaacaaggagaggccccatgagcggctgccaagtagataccatgttgtaggagtcagagctgggctttcagctgagactcgtccatgtggatgcagtctctggagctgtgtgtggtggtagggaaagaagcaggtacaggcgcagtttccttacccgtggaccacttgtccagtgacctcagacgtctggacccaacacagaggccacagacagccaaggagctcttgccgtgtctctgtgaaggttattcgctttctccagaggaagccggtacagctccaacaggtctggcgtgttttcctagctcagtattgaactgtttctggaggtaaacgccttccgctgcaggaggaaggggtactttgcagaggagactaacctttttttttccttctgagtttgacttaaccacttgtctggactttcctctgctgagccagaggctgggtgcagaaactgtctgctcttacattccggagccaccaggagcattctgaatccagacacccagagaaggaaattaaagcgtgttgtggacagatcagatctcagtccttagtggtatctgaaactcaggggaattctacggcagggctggcgttggggaccagaggttaggctcacaggcggcctcagtgagactttctgaaccatagattctctttcatacaatatacagggtacaggatgttcatcaaggcctgcgagctgattgtgataccacagggtgtgtacagcatttgagatatacagggatggctgagccctggcaaccaggttctgagagcaccatgatgtcaggccctggtggcccattctcggataatgtctgtccagggcgtacatttgtctctagaactttgctatgcctaaggtatgggcagtgatgctgaagggttgggggtgatttgctccttggattggaatgttttccttctaaccctaaaggatagggctcccttgggcagttccagactcaccttttccagtattataaattgggcaccatgcctccctcctacaaagctgacatacccagtagtatctcctccacctgggtcattgagtgggtatgcagtaccgagcctgtgtggaggactcaaggtactatgatttcctactgatgggaaatgaaagcattcacttgggccaataacttcacacacacatacacacacacacacacacacacacacacacacacatacagagagagagagagagatagacagacagacagacagacagacagacagacagaagctccaaatggactccaagtcatttggctccgcttgcatttcagttaccttaagtggaaagtgtagtgtaggagacccaccagctggctcagaaacaccagaacacatgcacaacctggtgggttcagactcggagtggcagctgccattgagatggcacagccaggtggcacagaggttccccagcatagctcctcccacctagctgtgatgggtgatgtaatgacttgtatgtgagggatgcgccctttcccgtcttcactttgggcttcaccacactcagtaaagcctacgctctggcagcctgaccttgtcaccccagaagctccctactcctgaaactaaccgccatggatgcagagcaacacatcacagggcgatggttttctttcatttcttgaaaccggttcctttctgaaattgggccccacgaggctggccccaaattatggcatttgccccatggctcctgatggtaggctagagttgtgctgactgagggaggcatccatcaaaacacgtagtgccttgagagaaaagctgcgtgctggggggtagaggcaagttctggagagacagccactgagtgtcccctgcagatcttagccacaggctggtggcagccatagtactggagtgtgcctgcctttcctgttttgtattcagacaccattcctttctcccatgttgaccgtggtaggtaatagtttacctaactttgtaccttagttttcttaacctgcccaatggaaataacactgttacctgctaaaacctgctggagatccatcatgtatagtgatgcaggcagggcgggtggctggtggtttcccatccggcgatcatacagacctcaggaagaaatgccatcaccttgtttaggcagaaatcgctggcaggtagagggcaaggttaggctgaagtcgtaactgctgcatttggggaggtcggcaaggccacttcgggaaatataaactttgtatctactgaatgccaggctctctcagagcccagcacccccaaagctgtggccggcaggtatggccagcagccagtgaccagcagtactctcagcagtggggcccattagggctaacctcttttcgtgggcattttatttgcacacttcactggagtggacaccaaagaggttttcaaatgtttcatgggctgctaatttcccctgtgacctcttttgttggggcctaacctcagccagaggcttcatgccatgaaagccagctcctgagacagaccccgacagccgggtgacaatgaggcctctatctgctttaatcaggctccagttgaatcttaaggcaggagggattggtgtggtgctcagaaaccctgggtggctcgatacagtggtcccagaggctctcatggaggctgaaatattccaccaggctgagggaagaggggtggcttttgtcccactggcctctttagaaagccagcctgccctgaatggccacccgcttggtctggcccatggataccactgggtatctagggaggtggcccactcggctaccagcccattctttagtggcctaatgagtttctatctgtgtcttcccctgcagactgtgactcctattgcaaggcctccaaaggcaagctgaagatgaacatgaagaaatactgcaggaaggactatggtaagcgggggcaaaggggctcctccggggtggcttgcaagtgactcgtgtcaccgagtccctgggacccgtgaaatctcttgtccgagaatatcagtcccttctgtgtccgagattctcccaactgaaccctgcacaggggcatctggatcagagggggccatcgaggctgagattcctatcttgggctctgttagctctgcccaaagggctatgaggctgcagaccactcgtttgccctctggtcttgtgtgtccttgttcatactctggcattgtctcaagtctcttgcttggtgaggttctccagcatcacagtgggtgggagatgccgggtgtttatagatgaggagtctgcactgtaagactgagcatccttctaaccttgaggatgctcggatcctgagcagctcctggggcctttcaaggggaacacatgtcacacgagaggccacactggattagctgcttgagccagacttgaagtttgccccttagtcaggctggtggccagggcttctcagcatatagaaatgaatcattaggttcaaacaaaatttgagaacctctgaaacctcattttcttatgagcattcacacacaggtgtacccctcacactgaagccagggaagaccccaagcatccggacagccccacgtgtcacaggccacgtggccttccccagaaccaagcaacagcaacatacaggttttaggtatcgattcacaagttgccaggccatggacatccaggttcaagccccaccttctactaggggtccatggtcaacttcccaaagaaaaggccccttaaggaatgatatcccagagcagtacagaagcttccagctcccacagaggaacaaacccgggtttccacaacaagtttactgtccttgagaaataaaggaaggacttgcctccttcaagctggggtagtgggtacaaggaggacatgacctctaaggtttcacccccacttctgccagagactaatgagggcaggcacaaaaaacaaacaaacaaacaaacaaacacaaacaaccccccaaaaacaaacaaaaacaaacaaacaaacaaaaacccaactctccaagcctctgttgattgagaaagcggggttcctgtactttcccaggctttggccttgaagcctgatcgatgctcctggcaaagcaaaaggcagggtgcagtgaggactgtgaccactatcacccctcctaccccatcctcagcacgggcaggaatgggagtgggcaggcctgcttgaggaggggtgggtgggggtgggctgggactgagttatctctgaaaagtactggtccacaggatcagtctgttccttggatgcaaggggagaaattgtgacatcaccaaaatggatcccatggtccttccacctgattcttttggactcagcctggttttgttctcgcccatctattattccagggttaccctgccccgtggtagtgcccacatctacaccaggttgacctttcctttattgagcctggagctttattgaccctgaattcagtgggtattcctataatcagcaggagggggcatccttcttgtgtggtgaagggttggttatggtctctgggcaccatgctggcctctcttttctggcgtatcttctcaggtctgacaagacctggatgtatagacgccccacccccgccccaactgtcactgcctggctctgttttttgttgttgttgggtttttttttttctccttctccagcagccctgggaggttccgaatcagtccattttctgttttcctagcaaaatatctgggctttatttctgactcacagtttctgaagtccaggagtgtttatatccactcagcttctagtgaggaccttgtgctgtgtcaacccacagtacaatgtgacacagagaggaagaggagacacagggagccaggtaccttgcaatagcatgctcttaagatcgttactacctttcatgaggacactcatgagtgtgacctcctcccgacccagcacacctccagagggccccaccaccactcagtcccattctgctggggacctccatacaggctctgatagagacataccatgttctaagcactgcagggatttctggtttcagtaaggtcatttgaagttatgggaatctcctcaatgcagttcagtctaccatgctgcaagggggctcatgtgagttccacagagggctcagaagagccaggcaccgtgggatatgtcaggccttggagcctggtttgagaaggtggaaaggcagctacaggtccgtgagtactgcaggggtcagccagcaatataagctttgctctgaggctgaggagaggcttctccttgggctttgctggggtgtggagactcttctatgtatccttggttggacagacacagcctaggtgaagtgtggctaggtggctctcccatactcagaagaccgggccagcccaggggacgatggaggacaggagagaatctgcctagattcagaggaggtaaggccaggccaagtcaaagaagggagctagctcagaggctgcctaatccctgcttgtttgctgactgacactcaggcagggggccaattaggaaacacatttccttcacacccaggacacttggatattcctgaagctgctaattagaacctaggttttgccacccctgctgagagaagagcccctttctcctccagccccaccaagataagcttgacctgaggcagctagtgaactctctttcaggctccactgaccctgagtggtagccagtagacagaaacctacagggccaggaggcctatgggaagagactggctggccagcccaaggtgtgccagccctgagtccataccaagcttggatgggtggatttaagacaaggcaagaaagaacagaggtcaaggagaacctcaggccaggaccttgcctggctgctggcccccatctagagaggaccccccacccccacctctaacccggtggggaagacggttcaatctttcccatgtggaagcttcaccagtctgggtgtccatcctcacgtttcagatggaggagatataatatccaagggctaggcaccatgtcgaacgaggctgctagtaacccacggaggtcaggtcatcggcacctgtccgcccctctgctgagccacctcagttctctgttgccctctaggggatcccgcttaccttacaaatgctccagaagtcactgccacgcctagcgtggaacccctgctatgaagacaggttttagtctttgcaagagttctcagagcacctctcctcactctgaaggaacccttcttttgtgggacggtgtgtgtgtccccttcacaccatgactgctcccgtcatcacagacataggtctctggacttctgcccccgccgtcaagtgctctggcccagcaccatcacaggggatgtcgttgactgtggtcatctatgtcctgggtgttgttgcttcttgggggaaaggctcctctgtctctcactcacatctttaactttgtacagtgtcatcctcactgcattgagctgcagctcatagacaccatccctgtacaacacacacacacacacacacacacacacacacacgtacgtccgtacgtcctgccacagggatctaggaagtcctggtactttatcccttctcaccttggagattttcccttatacacattcactaaagccctaggccgtgctgggtgctacactcacagatctggcacaggggattggccctcagggagtacacatttggaagagaaatacacaacgagagcccagaagaagcctgagtggggttgctcaggatctgatagactgtgcccccaaagcagggatccctagtagtggggaaagtctccatggctggtgaggtctgagaacaaggagggcaggggtgctgggtgagggggtgggtagggtcggaaacagcctcctgggccgctcacatttacatgcagaaaatatcatgagcctactactgagggtggtgcctgtgcccctagcagctgcccagggagccaagtgtcctcttccttctccctgggatgcacatcagcccttgttgtgaaaggtgagatcatctctcaccaattcttggaaaagtgtttcattcccagaaatgtttattagtcaccccccgtagaaagacatcttggcactactggacggaaaacggaagatgctttcacatgagcctcaagtcttccgcctgacggcccctgaagggttttgaagggttcagcttgaggggaagtgctgtggacatcttggtcctgtgtggcatatgtgctagtgtgctgtggcccaggtggccctgatggagagctctgatatagctcagtgtgcctttgtgtctaggaacctgtggagtcagtggaaatgctgggtgcggatagctgagccagggctggactcccccacggcccttgtgaagacctagtctctctgcttcagcctcagctgtgtgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagacatagcagcccttagagggctcacacatcccacaccctagttcagaacactggctctcagctccagatcagacatggaagaatagccacactaacatcttgatgggtaaaggaaggagacatggtttcccccattgtagagtccctgaacttgcaggcagatgggatggcatagtgacaactatggcaacaacggtggcagagatggaggagggcttgtggtggtgagtggggaaagaggcagatgtggaaggggatggattacggtgcaggaaccgagcagacagttggccgtggtagcactgctgtcatggtagaagttctgctttgagcggcacacagggcccaggcctagctctggtctcagactgggaataaaggagtgcagtctcagagctgtgggcctggagttttgccacttgagagcattccctcccctcttcctcctcagtggccctgggatcaatggtgactgtcaacagcctcagtctcttcagaatgccagatatcttagcagccatgtcatagaaatatgctttctatatcttctccagtgactctgggtatggacacaggtactagagtgatgtagggcttctgccttttcaaggcaaggtcctgatgtgagctggaggctgctggcagtaatttctgggaagagccactgtcacctggacatcctctggttgagagaatggggcacagacaagacagcagtgtgcagcacggtgcatcagagcttgctggccctccctagggtcactggccccctgaggatcctcctgtttctccagccagatgtgacccccccccttcctggagtgccagccacatgtggatgccagatgtggagctggatctacatgagtcagcctgaggtcgcggaatgtgggtgaccaccaggttgggcgggaaaggccaggaaaccctagtgacagctggacagcaaagattctgtgcccacataaagtggccctccctagggagccagatgggagctagtgcaagcatccctccccagccttgagcctggtcccctgccactattgctccagtcagtccagaaaggggagatggctatcctggatctgggtagccaggttctcatctgcctgtgtgctcgtttgccatattcttttttgccccttatagtttcctgcatggtttttttttttttttctttttctttttggaagcagagacagctcaaggtagctcagagaaaccacagagatttatccagtaaaggatgtctttccccattttacagaagctcagagtggatggtctagccagtgtctagtgagccagggcagagttgtggtagacatcaccagggactctagtctccattgcaaaggacactagcacaccagtctttgatcctgggcttcctatccagcagtctccatagacaccccagtttctccctacctgcagtcttggaggatgcaccaagcagcttcggggttttgagagacatggcctgaggtaaccatacctcgaaagctatcacacttacactacttaatccaaggagaccagctgccagtcatggcagtgccaaccctctgcaggagtcagtttattgcactgctggctctgtgctgtgtggctcctgcaatggggctcaggtgttttatttctgtctcctgggggaaggaagtttggaggctggttggactgtaaggaacttgtgggttttcagagcctgttgtggatggagcatgttggttctggtccagtatgggacagaactccagatgtaggtatcttagggaagcttggtagtgctattccagccagggcatctgggagggaagagctattctttgctcccttgctagcttcctggagctggagcctcaagggggaaatggaggtcagcagtatttgcttgagggacttctgtgtgctctgctgtcttctgtaaatggtataaatgtgttgtcctgagttggcccatatcccctcagcactaggctttctttgaatcctggagggggttggggggtgatgggacctggtcctacatcacacagaggaggctgttggtcaccttttctccttcagaggccagaactccatccctgccaagacctccggcctggggctcactcatcatccactttcccataggaaggttctgaatcaatacccagcaggctttgctctttccaatgcctattttggatgtagatgtgtaggttggaggtgggagggtctagccagtatgggaggcaggaatggatggttggagcatctcatgagaccatgcaaggtgttctgaggtgggatgtccttttagcagcccagtttatcccgagaggtaagccggtagggtcactgtacaacataggccagtcctccagatgaggccaccacagacttacacttgtgaatctgagtgaagtgggtatcgtggctggcataggaagtgcctcccaaaggttgggaacttagtaggcgagacctggttgaagtgtgggaagtgaagtgggttgtgggactgggcccatacatcttgtccccagtcccctgcttgctttctgcttcctggctgttgggagctaagcagctctgttcagcttattcttgccaccatgtttggcttgaccactgggccttaagcagtggcgcccactgggaacatgtcccacaaccgctgagtctgtggcccagataaagtatctcctctgtcgattactcagatatcctatcacggtaacgcagaagtcgttgacccactgggctgagccaggtaggctgcctgttgctcagggccaggactaacaccttcttccaagatggttctctgatgtcccttagctccaggagatagccttttccctcccaaggttggagcagcgggaggcagcagccaggatctcaaggcggtgtggctggcttctgggtctgtcacagcgagtccctactttactgacgagcagtaggcagggccgctgtctataggtctaagcatgtgtgcccaccacaggtctgcgctctccacaggcgccacactttccgtagagaagccctgggagcaggacctgacctgggctggcccggaagtgggtagtcaggctgcatttcatgaaagccgctgaggctcaggacacactctttccacttggagatttacggggcttttgattttaatggtttctgtgggattggtgtcctcccccatcgtttctggctgttgtctctaaggcaaatgggcgacaacccttccttagcaggacaggcctaacaggaacgtatagctgggtagggaggggaagggaagcgaggggcagccctttggaggggcggttgtgggtggcccctagggcccactttgagcaacctataaattctggggagctctagaaaggcaaaaagcttcccccacagaagtgctggagacaggggagtggctaaggggcacagttgtggcctgcctagtctctgctctcccttggctaacccagcaggtggcctctgccctgatggaccttcctctcagctgtgggctctcagcaagacagttagccagcaccacctgccttgtcctcctaggtcaggcagagttcctagaacccagcctcagtggggaccttagatctcagaggcaggtcctttaaaccttcatgcagggctatctactcctgttcccgtctgccaacaccctgtccttagaaggcctagagctccctgtagatcctaatggccgctagtccagagctggagtggggctgtagggaggcgggttttgagtgaactggctctaggtagaaagcagcaattttccctaggctccaagcacaggataatggccaggggttccccatgctgcaggttgcctctaatggcctgggaatttccctggcactggacttaagggagaggttgcgaccactgggaagggtggtcattccctctcttccacggtaggacaaacctggagctgtggttagggatatgtgtaaacagcagattgaattctgcaccctgagacagagagagagacatagctccaagacatcccggctgcccttgagctgcctcaggcactcttccaccctcagccttccacttagtccctacaccaggagcagcataggtggccctcgacaaatcagactcctgtgggcctggccttccgagtcctctccccacctccccgccctgaaccccaccagagtcacagctgggctctgtcaccggactgagtgggcagggcacccaagcttgctggagatgcaggttagaattcaggtaggggacggtgggctttgtggcttaccccgccctggtggctgagaaacatgcttagcatggtgaactgggaaattgctgagaggagctgaccaggtcctacccaggtacaaggtgctgagttctgggctcctctcctcccacccacccccattagatttttctctaaggttgtgctccatcccatagctggttcctccccaaggagcccagctggggttgcagacagcctggaagggttcttcccagctctgactttgtctgcaccaagcccttggaaggcacagaggctgggaatgcacacactggctcacttcagctgttgccactgagcaggagacgagggagggagggtaggcctgtggtgtggagtcccttctatatagaagggcctgaagcatcagccaaaagtgtctgtcgcatgggccctcccgcttctgctccaacactggcccactctcggagctgagggcttccattccagcagctacctgaaattgaaggactcccttcaatgctcctggtgcccatgatcatcttggtgtgaatcatctcatcaccctcctttctgaatggaggagacctcacctgaactccacactagaggataacatcaggacattagcctaaagatggggggttagcaccctggtgggtgggtggggtaaggtttattgtgcagccatttgtactgttctagcaaagtgcatctgactgtgtagaaatctatagactgcagtctgggtggctaagaggtctaagaccaagctaccacccttctctgcttccaaaatgccaccttgttgttgtggcaccacatgatgggagggacaagggctcagttaagcctctaagagggccactgctctgcacatgagggtggagcccacatactgctgagttcactttttaagggctcctaactcctaaatactgccctctgggcgggacaccaatttgaggcccagggcagggtgtgagagttctgtgtggccccaagctggcagagctgttgctcagtcacctggccaagtgggatcacatatcagcaagtggtatctaggtgtggtctggagaccttggtcattcctgatcagaagcagcaaccagcagccggtcagaggtgacagcagtcctggtgtgtgccacgcggctgccagagcgtgctctccctaagcgcacagagcaggtctgtttgaggtcacggctgcgatgtgtattttgaatcttttcagcggtatgtgcactgcagggacttggcccatgcactgtgtgtgcagctcatacttggtgggctttgtaatgtgcggaggcgttgccaagggcagcggaaatgtggattttttttttcagcataatcacatgaatcctgctgccaccctcccctgcccctgggcctggactgtctcagcctgcagttaggaaggtccctacagacagaaggaactaacttcttaattcttgaacatagccgtgtccagtggggacctgcagggctctggtgaagcaggtcctcttgaggcctctggtagtctctagggagtggagcctgcctttccaggataattcacggacaggcctggggtgagccggtgatgcttatcttcagagctgttgcaggagcacgagaaggaaagtctcctggggaacctgggggtccagcccaagcccaccttgtctagccagctcttctcctgagtccttttctgtaaagctgagaccctctcaagcctgtccatcaggctgatgcccaagacctctctagttatcctggcatgaggcccaccctcatgacctcatcataattgcctctggaaaggccccgtctctagattgttcttctctgaggtgcagggatgtaagggctccagcaaaggagcttggggcatcaatgctctgagtctgggattagactacatcatcaagggccctgccagagggccctccacacatccagcccattcttggtcaggcaacactggctggccaagggctgccacacagggaaactgctgtgtcctgagaggctcattctgcattcagctcattcccaggaaaggaaaccagggctctggcgggagttctcccgaccacttagctgaggaggcactcagttgccacggtgacctctgtcagcacagtcacttctctaggctggagggtttccccaccccccaccctcagagttcacactgagtgttgaatcccttggtgacaaaaacatggaaacggttgccatggcagccattctttggagccctcagactgaagtgcaaagttcaggatgcccagaacagctgaaatgaaaatatgggaaaatctgccacttccctcgcccaggagggcaggttggagcgtccggtgctcctctgcaccagctgtctgcttcccaaccttggccagccaatgtgggcacaggaagggagcagggtgctctcccctatacaccagagaccttaatggggagtcacctggagcagcagggacccaggcaggctttctgactgtggaagaatcagggaagtgatgagctgggcttccctggggtttctaagtcagggggctcaggacagtcagttggtcaggtggtcctcagcatagtccaggggtagtgcttccctgccctgagggaggaggcatacactgtgtgacatatggggtcagcgcagggaaggagcactggcgatggggataggaacaatgtctgcctcccttgaatgagactgagcacagctgaggccttctctaggaatctcctggactgtagagggtgattggctgtgtgttcctctctcgccagcaattcccaagtaggctccgagaggctctggtggcctaagatgggccaaccacgggcttctacagccagcagttttcgggaagccaatgcaaacacactacttaccacacacagcctctcaaaagcccagcaccaagggaattcttgaagggaacctggtgttccctccatcttttgctgttgttgtgtgtgtacacacatggagtgtttgtgtgtgtgtatgtaggtcagaagttgagtttgggtatcttcctgttgtcctccaccttgttgggagaaagaagactgtctgtcattgaactgagaacatgccaagcaccaaggatctgccgtcttcatggcccagtgctgggattgtagttacgagtcctgctttgctcatgagttctaaactcatggtctggcaaatgcttccttgactgagccacctcctagcctctccctcataagcatgcccttctactttaaagtgccttcagtagggacatcttttcacatatctgccgctcctctccagtgtcttcccccagtagcagcagcactcctggggagagcatgtgaactggggactttacccagttctggtgagtcagaagctcaagggtgggtggagtcagcaccgcaccatttgcagaagctctccagggacctctggcgcagtctggtttgagaacccctgtagaagaagactgggggtggggggagggagtgggacagtgctgaacctgagaggctccaagggagctagcagcctggcagggagtatttttgaggaccctggctgaccctggaaaagcactctggccatgtgagtggcagactctcttgatgctgcgtactaaaattccctgatgggctgtttcaatttcattgaagtcaggatgattttgggggacaggtgccatcctaaggcttggggtgaagtggctggagcctttggaagtctaggcatgtgaggtgctcctcatttccagaggagtcagccctgctgtcatcaaagccacctgccctcaggggcaagcagactatctagagagctaggggcatgcttaatccatctaccccgcttccctggagtctcccttatggatctcaacatgttccaagaggcagtgttgggcggggggcaccttcaacaaaggcaggagcaacacttcttgggataggggctttggcccaggtattagctcaggttctgggatgagcttagctcacccattgcccgtggggagccctttgcagtcactttccagatcccactccaggttcttgtaggacatcgtgcaggtcgggcccatcccatcccaggacctgggcacctggctgcacttcccagccatggcccacaccacttgtttgcttcctcacagctgtccagatccacatcctgaaggccgacaaagcaggggactggtggaagttcaccgtgaacatcatctccgtgtacaagcagggcacaagtcgtattcgccgtggtgaccagagtttgtggatccgctcacgagacatcgcctgcaagtgtcccaaaatcaagcccctcaagaagtacttgctgttgggtaatgccgaggactcacctgaccagagtggcatcgtggcagacaagagcagcctggtgatccagtggcgggacacatgggcacggcggctgcgcaagttccagcaacgggagaagaagggcaagtgcaagaaggcctagcgcggaggtggcgcgggctccaggagggcgggcagggcgctggcaaaggctggcannnnnnnnnnnnnnnnnnnnnnnnnnnnnnnnnnnnnnnnnnnnnnnnnnnnnnnnnnnnnnnnnnnnnnnnnnnnnnnnncgctcttatgcgcatggcagaaagcaccctgtattgacaggccaggccctggagaaatgaggacaagacatagctacctcacggcgctccttccagaacagagatgcgcttccctagggctaggtgggggtcgccgtggaggggttagggaggtcctgagaggcgggaacagaatggcacagtggtctacagtcgctgtgtttgatggttattgaagggggatgtaagaactgtgaatttttgggcctgcagcctgggcaggggcaaccaatccaccaccagacactagtcacgcccccctcctttctccatcacccgctgtctaggaattcccacaggactccagactctgacaacaggtccctatgttagagggcccgatgacactgggatcagccagctttggtctccactgccacctgctgggctggtctcctgggtggagttcaccatctgtagggaggggagagttctcctggggcctgctctactccagtggggctggcccaggctcctggcccatcagagggcctagggcctaaggaccctgaagtcaagccgggtggtcactgcctctgctggagctgcctgtggaaggaggcattgcaaaccaaaacctcccagagagtttccttgctggaaacttggaaacagccctttttatgacattttccaggggagggggaggggtactggcgggggtttagggcagtgacactatttgtgtaatgacatcagctcccacaaggcctcacagcaatgtcaacagctggagagggcctggttaggtctggaatgccagcggctgtctaggcagtttgaaccaggcttgggggaaggggcttgcctgagtcagggtagggtcgctgctcagcaaggtgcctggcgtccaagctggagggcaaggccaggaatggtcaggttcttggggtccaagcattctgtgactgcttcctgctgccgccctcactgctggctccccagaaaagggacatagactccttggttaagaaacccactctagctcccagctgtcttggtctagcctgggcagtctggtctattcctttctggctgccttctttgtggaggtccccaggccctcctgtatgcctagctctcttttctcttagagacttaatgtcctcacgcaggcagctccaagcttcccttctggttgcttcccaggcccctttagcctttccctgcctccctgtactcgggcctctagcctcgcgccccgcacactggatgagaggcctggccctctcagtcaggaaattggtttcatttctcctgcccacttggctgccctgaagggccatatgagggatgaagctcagcccctcagtgacacggctccctctgcttctccacttctgcccacatcaccactgccacttactgagcaccctcttggtgccaggcactttacccatatgctcctggcctgttttcaccacaaacctgcgaggcagggattcactcttgtcttcgtgttcaccagtaaaaagacatgtccacgtgcccaaggtcacaccagcaccggtactcagactctgacctcaccacagttgcacatcagcagttagccctcttgacactcccacagtaggcgagggttgggtgggatagtggttaccactgagacccaggcagcttgtctctagagaactctgaggatatgagcctggagtatggtctgggacagacccagcaacacctcctgaggaggcatcgggagtggcggggaatgaggaatggactccctagtggaaagccgcaagatccaggaagacaggcatggccatctgagagggcctggagaggtggcttagctgcttccctagccggaggaagactaaggcttcagagggaggctggcatgagcacacagacctaccctggcaagggtcaggtggcttccctggtccaagcttgagattgagggcaaggtccactatccaggagagccagtatggtttgttgggtaccatctgtagcaaataacatccagctgtacagcaggggtctcatttctgtaccagcatgtctaatgctctggccagcttccacccttgaaccctggagtccagtctcacctggtatccagcgaagtctcttaactagacttcccccacgcccctgctaagcaacagagacgtcttgttagaaatctaccaaggcctcctgccctgccctctgtggcctgctcaatgggggctacattaaatagccaaaatgagccaagttgtggataaggtcattgctgagggagcagggtttgtcacagccaccacctctgtggaccagaatccagcccacctctcctctgcctgagagccagccttagggaggcagctgtctcctacccaccctagggaggagatggaaagggggaagaagacatcctctttgtacagttaggaaggggtgcaaaatggaagtaggtttttgagtttgagagtgtattaacagagttgtgatatgtaggtctttgaagaaaaccataccaggttagtcacttaccagtcaagatttcccagctgtccctttgcttaccatttgggtagtctggtcccctgtcaccagaatgcctcctttgctgacacacagtggcacaaaggtatgtggtgaaggtgatgacatgctcctaggtacagctgtgagctgtggtttctggccagagcttctgtcccagaaagcagggcaggaggcaggaccatccggctccttcagatgggagggagggtcagatgccaagggcaaagcctagggaggctggggtggcctctccgagggccttagggactttctagaactctgcctcagtggttacatacaggcagtgggtacaggctgtcttagaattgcccctgagctggaacaagactgaaatgaggagacccttcaggactgacctggggaatggttcctttagggtctcaacacttgaaggactccatccaggaaacctagagagtgggcaagataggctcactaatgggccgtggttcacagacagatattcctgtggaccagagccatgccataccccaggggtatcaaaattgtctttgtggggccttgcccctgccaaaaactaagccagcctcacctcttgtgtcagcggacttccttcccctttccctgatctgggtacaccccccggcctccctcctgtgtcaccgattctgctcacacagaattgtaaatgtttagttgtgaccatgacatattgtttgggccagtgttcctttccaatgcatactaatatattatggttattatatatgaatatatttaatgacatggagaaagttgtggattttctttctttttctttctttttttttttaaagtttttttgttgttagagttgtaatggacccagacggaacttgtaacgtgggccctacatgatagaactaaatccagatatcattaaataaactcttgtatactgttctgtgtcccagcctttcttggtggtggcatgtggggaggtagaagggcggagactaacagcaacttaaggaatatggcgtcttgccctaggacaccctagcaagacagaatcttgtgtgttttaaacaaagagccctaactacccaaaaaaggcaggaaaagtgcagccctgtttggaaagtcctataggcttgctggctccgactgctgtctgaacaggctctcagatgggccaggccacacagcaattccaagtcaccgctgcggcagatccttcctggtcctggagttcccaggcaggggtagaagagaaagggggtccctcccactgcgccctaccgtcaccactagattcagagcttgcaagcccttttggacttgtataatttcctcctcttctattcaagatgaagtagagatgacagaggttgataaaacttaagaggtcatgcaaaaaaaaaaaaaaaaaattccctgccactgccctgcccccagcccacccctgccctgcccccagcccattgctgaggcacagggactgggtctgtgccagcaccatgcagccaccaggagctgagctcagtggttttggaaaggctatgtttaaacttccaaatggttgtgatttcttcactgaacaacaagccagccccctgggcggatgtgttgccatggcccatggactggactctttcctgcacccagtgcttttgaagacaagactcacctgctggcctggtccagcccctgagcaatgtggattttgaggtgtccttgctgtcagggcatgaaaagtcttcccttgtagaacagacaggcagttcgaggacaacactgttggaccaacctccacagaggagcagggttctaagctagggcaggcaggaacacacatgaactctggtgtcccaaaccatctcagaaatgggtccttgctggacgcaaggtggtgggtagtttaggatagaaagcagttcctggttggctggtcagactgaggaaagagcaagccttgtgtgcagtgtcagtctcccagggtcagctggggctaagagctctgtggccatttggcagtttgactctcatctttggtcattttaagccaagagttcagttctcaaggacttttcatgatacggctttttttttctctccacaaagctgtctgtgtctgagtgtgttctgacccctcacagctgggctctgcgctggcaggaaacacactgttgatcagagttgtgagaatggactgaacagctcacttgcctcttaagggcctttcacctggctgaggagacaaggcactgacatctgtccagtgctaagaaatcagtatgagcagggcctctgctaagcactggcccaaggtggtgaggaaagctggaagaagatgggaggaagtcccaaggaagctgagtagaccttgtcagtacctggggggctggttcggtgaaaggccagaggcctaccaaggagggctcatgcattgatgaggcacactcatcccatctctgcatctctcagggacagtgccttgagtggggatgcccacccagagtagacacaccctatggtctcaggctaaataaagacatataataacctccccaagaaaagcaggagtaaaagaatagcagccagtaagaaatactgaaagtggatggcttaactcattgctttaccaacctggaaacacagtacgacaacaaggcattctggaaggagaccggggcctttagttgttggcacacagttgggaggaagcttgtgaaacctatggtatagtaagaggatggatagtctggtcttataagagatgagaggatatccacttaactttagcaggatccatacattattctggatgtctaatgtcattacctgagggaacagtgctgtttggctggctgctggcagttctgactagtcagggtgaatagctcttgaaactgagggtcagttgggaattctaaggcagccctgtggtaggaaagccccaagcatccagactcatggatctggtgcacaagcccggcaggctggctggcagcaggcagcagatcaaaaaggtgcagcagtttccattcagatctgtgaaagctgtctcgccccaggcattggacagcggccgccgaggaggctgtcttggggctgacagctaaggtttagtacaattattaacaatcataatgcttaaatggaacaaaagtaccagttgtatccaggtatctggatttctttatatggtatccagatttaagatgcatataattaataatcagttaagttaaacaattcatatgctgctgttttaataaggtttactttcattgacaaagtccctgaagacaggggtgctctggctgcctggccactctgtgttctgtgagtggtgtacttctagaacgctcacagcaggtcactggttccagaatgctcacagcaggtcactggttccagaatgctcacagcaggtcactggttccagaacgctcacagcaggtcactggttccagaatgctcacagcaggtcactggttccagaacgctcacagcaggtcactggtctacagacctgacatagtaactgggaaactaggccttgcaaacaccgctggcaaaccccactctacaggagctgtcccctgggctttgaagcagcaggctctctggtacaccccactcagctgggcatgcctggctgctttggatggtgcggggaaagccatctttgaggaagactgcctggggatgagtctccctgcctgcagtgcccacggtcctcacaccatgaacctctcaggcagctttcctcctgcgctcccctgcccatggtatacagaagggaaggaacttgtccggggtcacacaatgccctgactgggcctagagcccattcggccagaagaacagaagccactgtgtgcagacatgggccagtgtcttcctgaaaagggctttcagtgcaactgagccaggccttcgtggctctggttcaaagtgtcccacgagttgccggggcttcgtgctgagcaagtcaagaggaggtgagaaagttaaacagactctcaatgctgctgcttctgagccccaaagtggggggctcccaggagacactgtttgtacagatttggggtttcccacaagactggatgatggagctctacagattcttggtcttacattggatgatccattagcaaccaccctgccctgacaaatgtgtctcagggtacactgtgtcttaaagccctggccagcagtccagcaaggctcctgtcttcccaatcacacgcccctgacacaagcccacactcttcttcacctccagtccgcccctcacagcctgcttcacaccctctgccagttgccacctcctggtatactatgaccctgacaatctggctaagtcagctcctagggccttgggatcctcaggaacttgggcatcattggccaagttagcagcaaactttgcccctgcctggcttgctcctacagttcgtgtacttagaagagtgggagacagggtcctgagcctgctggacacctcggcttagactagtgttataggaagagtccccttccacctgagccaagtggcttgctgtgcttcagtacctcacccagtcctcccagcagccctgaggtggggcaaggtggggcagcgggggattgtcacctttttgtacatgaggccactggcacagaaagggaacctgtctgtctgtggtcacagagctgataagtggtatggcaacccccgtcggcagcgtgtttcttactctcttgtcttctgttacttcgtcttgtcccgtgggaggccagggtaagtagttcagccagaactcgagctgaggtgatgtgctctcgagatggacacttcactgctggcctgagagctcccagaaaccctttgctgtgccacagagaccccattgctgtcctgcctgtctgcattctggtatgagtcagagtcaaacaaaacacttggaatcctcggtctcagggtcccaggaaagggcaccagtctaggtgacactggggctttcttcctggtgcctgattctgtccagcgcaggctttggattatgttctcttaaggaaagtcacaggacctaccacaggcctgtctcctcctcactgaagccaatgctacggcaagacttctggcattagctttaactcttctttctgctatgagaaagcgaggctaactgcccatcctgctttctgtagagagaggagagagggctcgctgccccagcacccatctgtagacccggtatcttttgcagtcagtttcgctctgagtcctgtctctgaaatacttatgtgcatgccctcacttggcacacacatggcttcagagccagtggagaggctggacggaggcagcacttcctgctttataaccaggctttcctctgactgctccctccctcaagatctaaggctgtgggctacttagaaaggtgtcaaatatgtcttttgttgttgttgtttttttttttttttgaactccactgcctctgactcctaagtgctggggttaaaggcatgtgcctccacgtctggattttgttttagaaaggtgtcatcaatcttgaaggacgcgtttattaacaaagcaaaattgaaaaggttcacgtccagatacgaagatggtccagaaactcttagagcagaaatagccagcactgttgggcatctaagctttgtgggaaattacacatggtggctgacagagaggctgttggctatgtcttctgtgtggctcttgccttacgtagatcctgctatctggacacccagacacatgatcagccactcatttgcacaagggcacgtggttttccgcagtacaagcagccaccaaggtcacacactgcctattaatatgacagccctcaggatgcccagcacacagagggtgactggaatccattggcagctgtgggacaatggccatctgagggacttctgactaccaacaaaatcactgacagaagacaggggacacaactgggccagtgctctaggaaggtctccagagctgctcagctctgttctctacccaaacaaggtacaccaagagcccagagcggtggaaaatttattgagagcaggtgttatgtaccaaaaggatgctgggctttcattcgtagttggcaggtgtcacagcgggtggtccctttattgctatcagttggttggccacactgcaacgaccacaatagccacgagcagcaataaaatcaccatgatcatccctgcaaaagagaagcagaacacgcctcttttaatgagccgcaccagaagaaagcgtcacactctagaagtatgtggagagaggagagggcagtgaacacaggccaggctttgcaggccggtgggcacagcagatgggactccacggagcctataagcagccattgccaccttgagagctgtgccaatactcctggattgcaagacagaatcctgggagggccagggtcaggcctgcgcatctggctctcatgtgcacaccaagctccccgctctagctttccagtgcctcctaagtgacaagcatggatgctatagatggcgctcagcttggttacagggtttacaactctgaaacactgacagagcaaaatgcctaatgttaacaggtcattgctgcctgcggtctattttttgtgcaacgaagtttggattatttattttattttttgagacaggatctcgtgtgtcccaggctgatcttgaactcactttgtagccaaggataactttgaacttctgatctttatgcctccaacttcccaagtgttggcattccagacgtgtgtcaccacatctggtttgtgtggtgctggagagtgtaatccagggtcctttgtttgttttgttttgttttgtttttgtttttgtttttcaagacagatttccctgtgcaacagagccctggactcactctgtaggctcacagagctctgcctgcctccgcctcctgagtattgggattaaaggtgtaagccaccatggccaactaatccagggtcttgtacatactcagcgaccattgtaccagccgagccacaccctcaggccactttgacatttttagtcaccaccaaagtgaaggaaggagccgtgacagcctgtcctccgtctctaaagcttacactatttatctgttccctcgtagaagggagcccctgttgcgttactggttgttactggattctggctttcagcctccagttctttcgtctagggagtgccttcctttcttccttgggcacgacctaggctcctagaatagtttttcagctactacttcggtgtgtctgcagtgagaaggtgtgtgcgcttgggtgacattatcagatcttggagattcaggagattgttatcttttcattcacttctgccttgggaaatgctcctgcctgcctgc

SEQ ID NO: 96 - DNA, 1876 bp, Mus musculus
cacagcatgatgcgcgctgtgtgggaggcgctggcggcgctggcggcggtggcgtgcctggtgggcgcggtgcgcggcgggcccgggcttagcatgttcgccggccaggcggcgcagcctgatccttgctcggatgagaatggacacccgcgccgctgcatcccggactttgtcaacgcggccttcggcaaggacgtgcgcgtgtccagcacctgcggccggcccccggcgcgctactgcgtggtgagcgagcgtggtgaagagcggctgcgctcctgtcacctctgcaactcttcggatcccaagaaagcgcacccgcccgccttcctcaccgacctcaataacccgcacaacctgacgtgctggcagtccgagaactacctgcagttcccgcacaacgtgacgctcactctgtcgctcggcaagaagtttgaggtgacctatgtgagcctgcaattctgctcgccgcggccagagtccatggccatctacaagtccatggactacgggcgcacgtgggtgcccttccagttctattccacgcagtgccgcaaaatgtacaaccggccgcaccgcgcgcctatcaccaaacagaacgagcaggaggccgtgtgcaccgactcgcacaccgacatgcgcccgctctctggcgggctgatcgctttcagcacgctggacgggcggccctcggcgcacgacttcgacaactcgccggtgctgcaggactgggtcacggccaccgacatccgcgtggctttcagccgcctgcacacgttcggcgacgagaacgaagacgactcggagctggcgcgcgactcctattactatgcagtgtctgacctgcaggttggcggccgctgcaagtgcaacggccacgcggcgcgttgcgtgcgcgaccgagacgacagtctggtgtgtgactgtaggcacaacacggccggccctgaatgcgaccgttgcaagcccttccactacgaccggccctggcagcgcgccacggcccgcgaggccaacgagtgcgtggcctgcaactgcaacctccatgctcggcgctgcagattcaacatggagctctataagctatcagggcgcaagagcgggggagtctgtctcaactgccgccacaacactgcgggccgccactgccactactgcaaggagggcttctaccgagacatgggcaagcctatcacccaccggaaggcttgcaaagcctgtgattgccacccagtgggtgctgctggcaagacctgcaatcaaaccactggccaatgtccctgcaaggacggcgtgacgggcatcacctgcaaccgatgtgccaaaggctaccagcagagccgctcccccatcgccccttgcatcaagattcctgtggcgccacccaccactgcagccagcagcgtggaggaaccggaagactgtgactcctattgcaaggcctccaaaggcaagctgaagatgaacatgaagaaatactgcaggaaggactatgctgtccagatccacatcctgaaggccgacaaagcaggggactggtggaagttcaccgtgaacatcatctccgtgtacaagcagggcacaagtcgtattcgccgtggtgaccagagtttgtggatccgctcacgagacatcgcctgcaagtgtcccaaaatcaagcccctcaagaagtacttgctgttgggtaatgccgaggactcacctgaccagagtggcatcgtggcagacaagagcagcctggtgatccagtggcgggacacatgggcacggcggctgcgcaagttccagcaacgggagaagaagggcaagtgcaagaaggcctagcgcggaggtggcgcgggctccaggagggcgggcagggcgctggcaaaggctggca

SEQ ID NO: 97 - protein, 596 aa, Mus musculus
MMRAVWEAAAVACLVGAVRGGPGLSMFAGQAAQPDPCSDENGHPRRCIPDFVNAAFGKDVRVSSTCGRPPARYCVVSGEERLRSCHLCNSSDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYYYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGFYRDMGKPITKACKACDCHPVGAAGKTCNQTTGQCPCKDGVTGITCNRCAKGYQQSRSPIAPCIKIPVAPPTTAASSVEEPEDCDSYCKASKGKLKMNMKKYCRKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 98 - DNA, 238417 bp, Homo sapiens
atataaggtaacattcactggttccagggattacagatatggatatcttttgggggggcattttttttgagacggagcctggctctgtagccaggctggagtgcagtggcacgatctcagttcactgcaacctctgcctcccaggttcaagtgattctcctgcctcagcctcctgagtagttgcgaatacaggtgcgcaccaccatgcccagctaatttttgtatttttggtagagatggggtttcaccatgttggccaggatggtctcgatctcttgacctcgtgatccacccacctcggccccccagagtgctgagattacaggtgtgagacactgcgcctggccctggggggcttttttagctcaccgcacagagctggtcaccactttaactgtccataattctgtggtctttagtcaattaatttgtagtgcactcctattttgtgccaggcagtctgttaaaccctggggattctgagggaaaagaatagttccttcctcagacgctatgaaaatcagagctatgtggaaaagaaggaatctgggccttaaaggtatctaagatggatcttgatgagctcaaattccccatcaaagtctgcaaggccctgcttggtctagctctcagcctcccctctgagctcatccctaccactccccatctcattacttaaacaagctctgggccaggcgcagcagctcacgcctgtaatcccagcactttgggaggccgaggtgggtggatcacctgaggtcaggagttcgagaccagcctggccaacaaggtaaaacccatctctactaaaagtacaaaaattagctgggcgtggtggcggatgcctgtagtcccagctacttgggaggctgaggcaggagaatcacttgaacccgggaggcggaggttgcagtgagctgagatcgcaccactgcactcccaagcagggtgacagagtaagactccatctcaaaacaaaacaaaacaaaaacaaaacaaaacaaaaaaaaacaagctctgtcttgggacttttgcacgtgccgttccctctgcctgaatgtacccttcccccaaataacatctgtccccagagcttccttcctcacttcactcattctgctctactggatccttcttagggagtccttccccaagtacctgcttaaaatccacctcccctcctggcacgtcctgttccctcccctgctttgtttgtgcttctgatgtaccacagtggagttgctattgtctgggtcagctcagccaccacaaggatgttgagatgtgataactagaagttgtcagaagatcctaaacgcatcctgtttcatttccaattctcttcctgagaatgtagtttgctttttattttcttttacttttcttagtagcacattgggcttaatttcaagtaaatcagaatgggggtgggatggctctttaaagggggatgtatacattctaggagccattttttggttgtcataatgactggtgtatggtgtgtgtgttgtgtgtgtcaggggtgggtggaacctgctggcatttagtggacaggggtcagggatgctaagtgtcctgtggtagccaggtctgttctgcccagggaagaatcttcctaccacaatgccaataccacctctacagagaaacactctttttttcttttttctttttctttttttttttttttttgagacagagtttcactcttgtcacccaggctggagtgcaatggtgcaatctcggctcactgcaacctccgcctcccaggttcaagcgattctcctgcctcagcctcccaagtagctaggattacaggcatgcgccaccacacccggcttattttgtatttttagtagagatatggtttctccatgttggtcaggctggtcttgaactcccgacttcaggtgatctgccctcctcggcctcccaaagtgctgggattacaggtgtgagccacctcgcccggccagtaatatttttctatcatcttcactgataacctttcattctctaagagtattttaaatgatgtctcccagatccatcacctgctaacctgttccctggcccattcacacaaggtcttgagattctccagttcatcctcttgctgttgccatcagtccagtgtcatctctaaaccttgaggtttcacgaggggattccctccttcagagtctgtgtaaccggtaaacaagctgagccccaactctggctcagaggccccccactattttctccatctggagcaacatccttttctttgcaccctttgttccttcctcaaggcctgtcttccatccatgacaaagcctccctacacagtgacccattttctttattttaatagcatttggggtggaaccttgtcaaaagctttttgcaaatgaaaataaattacatctgctggttcccccatccacaggcattttcaccccttcaaagagccctggtagattaaaggatttggaggatttggggtttgtatgggcttctatgcccagctcctgagttctcagccaagacacctgcaaagggggaggcctgagctgaagatacagataaacgacgttggggaaatggatatctccaggaacgcttcccactagattggcctgctccccatgttctaaagccttttccaggacagtcacatctcctgaaatcctgtccagggacctgggattccctgagtaatcctccatgcagcctatcaggtgagctgggctctagatgccttgaaatgaaagactgtccctcgtacttctagggtaagagatctggtaggcagacctgagaattatacatatgaaaaaaagcaaaaacaaaacaactcaaaacctactatacattgaacatccatctactctctgccagggtctttcctttcagatccaagttttaaaatcgccgaccaaccctataaaggtgaatgcagtgaccccatttcaccatgaaaaaaatggatgctcagatgggcaagcaacttgcccagagtcacaccattaggaagtggcacactggaaccaaggcctgtccaagtcaagttctttcaatctgggaaggaaacactatgaatccaggccactgctcaccctcctggagaggccaaatcctcctggtcacctctgcctgctgcaattcccaggctgtactactgggagtactgggaactgagtcatctagggtctgtcctcttaactggaccagaggtgttaagaagcacagtccatccagaccacacagctcatactcttggtagaccagaagcccatccttcctctcagggatgattgagacccagtcaagcccatcttacccacaggttctgactaagagctccaaactctggacctagattattttagttcacacactgcttctctacctaccagtgatgtgatcttcagcaaattatttctctgtgtctcagtttcctcctccagtaaaatggacacaataatatacctatcttacatggtgtttatgaagattgtgaactaaggaatatcaaagtgcttagtagatgcttggcacacagtaaatgttacacataatgcttgatttaaaaaggaaaactcagccaggcacggtggctcatgcctgtaatcctagcactttgggaggccgaggcaggtggatcacttgaggtccggagttcaagaccaacctggccaatatggtgaaaccccatctctactaaaaatataaatattagatgggtgtggtggcgggtgcctgtcatcccagctacttgggaggctgaggcaggagaattgcttgaacccaggaggcagaggctgcaatgagccaagatcgtgccactgcactccagcctgggcatcagagtgagactctgtctcaaataataataataataaatacaattaaaaaattaaaaggaaaacccttggtcacacccaagacaaaggcacccccggccaccccttttctcctaagcctttgttctcttcttgtcctccctcctcacaaacattagcctgtgccatctggtgcccccgttcctggagtgtaccctcccctgtatcctcgtcctcctcactgattgctcctcccaccctcatgctcatcccagttgcactgcagtccttctcagaggtgctgtccttcttccaaaccacacatccctaagacccaggagtggggcgctgttgtcctcctccattcccaatgctccttccctcttcattaaaacaacaacaaaacaaaacaaaactccgggccgagcgtggtggctcacacctgtaatcccagcactttgggaggccaaggcgggcgaatcacctgaggtcagaagctcgagaccagcctggccaacataatgaaaccctgtctctactaaaaatacaaaaaaaattagccaggcatggtggtgggcgcctgtaatcccagctacttgggaggctgaggcaggagaattgcttgaacccaggaggcggaggttgcagtgagccgagatagtgccattgcactccagcctgggcgacaagagcaaaatttatctaaaaaaaaaagcaaaaacaaaaaaacccccacaaaactcctgttcctttaaggccagaaccacacggctgtcccaccttctacatctcatccttagaatgacctcccagtcaatttcactcttttctttctttgaagacaccagcactggtcagtcttcgtctctgccccaaactctgatgctggttccaaaggtctttagagcccaggtggacagcccgtccagcaccgtggccgtctcgtctctaatcaccctccattctgcctcacagcagaagtccccctcttattgtcctcggaaggccttgtcatcccccagagctgttccacctctggaatcctctagttttggaccacaacctcctcagttattccccacctcatagtcttctcttttcttgaatcctttagctatccaacagaatttcctgtgataagggaatttttctttattggtgctgtccaaattaggggcaactaggcaactaagctctccatgttactcatttttaattaattcaagttgaaattgaagtagctacatgtggtgactggctaccatattgaacagcacagctctagcccctggcctctctgtttcctcttccatcctgtcctgttttccttctttctttggcattgtcgccctggcccatcatatcagccacccactcccctttccttctgtcccacctcctggaaaacactctcaacttgagattaatccaactgtctctttctctaggtctatccaaaggctgctgggcgctgctggggaagagggcatgtgtgtctcatggccttgctggctgccattctttctcatagatagtcacaaacttcaataggccctttaattctgcccagcaagcattatcctcttctctctaatgacctcaagcctccagtgctcccagctcctcccccatcctcagcagatggtgtcacttcctatttcattgaaacaagagacacttggagaccacctgaccaccagttttacaagcatagttttatctgtcttccacctctctcctcctgctggctccagttcctatcaacatttaggcatggtcaaatagccttatcttacaaacaacaataaaaaatcccaaccttccctcaatcctatgtcaccttcctgctgtgaccctctatctttcctgccacttatattcacactttcttgaaagttgtctacacctgctatttccactttctcacctcccgttcactccacaaccccagacagcctggcttctgtccctaccactccctgcaaccactagtcaaggtcaccaatgacttccttgtagtttgatccaaaggacttgtttcagatcttatcttgacctttaaggcatgtgactcaacactgctcagcacccctccttccttgcaacgctcttacccattggtttctataacacccgagtcccctggttttcctcctcctcctctggctacttaaaagttttcttgaaactgccgcattctccccctcctagggtgatccgtctggcttcacaggtaagacagtgtgccaggaacggtgtttccgcctctcaacgcattccttgcagaaacacctggtgatttgctttctcacccaaaatctgcactgttgcgttttgaactccagtttgctctgtggatcccgctgcttagagcctgacatgccttcacgggtgtgtatttatcaccgccactttaagaacttctcacgacacttggacatctgtttttttcatttgtcccctcaacagacaggctgcgttaggaaaggacactgatgaattagaagggatggaagaggctgcagagtggtcagaaaacaatgtcctatgggaaatcattaagataactgggaacattttgcccagaagagataaaactgagggatgatagaggactggtttcaagaatctgaagaggcagagaaccttgatctgggctgctgtgtagcgtagggtttgggccacctgcagacttaacagagaggggggtttggaatggacgtagaggagttccaccgtattacaggaggttctagacctcctggatacaaggtgagtaagacagtcctgctcaccaggaactactaaagatgataagcgtagacctaagtgaccacaataaaactggaaggtgaccccgctcatcctctcctgaagacccctggcctaagctcagctggcaatgtagaaaagccacactctaccaagagccatttcaaacttactgccatgcaagggccatcaaaagctctgtggacataggctgggcgcggtggctcactcctgtaatcccagcactttgggaggccgaggcgggcagatcacttgaggtcaggagtttgagaccagtctggccaacatggtgaaaccccgtctctactaaaaatacaaaaaaattagccaggtgtggtggtgggtacctgtaatcccagctacttgggaggctgaggcaggagaatcgcttgaacccgggaggcagaggttgagaatgcgccattgcactccagcctgggcaatagggcaagactccatcttaaaaaaaaaaaaaaaaaaaaggctctgtggacagaaacaacattcaggaggaaggcttggaaagcacttctcaatccagtcttgtagatgctccaaaaggtaccccagtcagctgagcaccccaatttgcttcttttccattcctctttgctggaatgtcttttcctgacttgggttttgatgcgatgccatcagcttacattcagggggatcacagaaactgtccaaccgagctcactgttgtgactgttttggggatgttgtcagggacgtttgctcattaccccatactgtgttccctttctgggccacgcccccacaagaaattcctatctgattttagtaccaagaatagttgtaattcccttgagcagtaggtctgtttttatctcatggacactgggaattgtgtaatgaacatggtctcctcattttagctgcaggaaagcttagggacaaatttgtggcccactcagaagaggtgtagaggttggaactccagggtgcattggacctgtatcctcctctcgactttgtctcccttcttagcttttctttgttctcttacttcatattttactgtgcaaaactgagagcatacaagcaaagataaataaaaatcacctgtaatctcattattccgagataaccactattaactgtgttgtctttttatgcatactttttaaaaaattaaaatgacattatactgtgtgtttttaatttgcttttttcatattataatatgtcatgaacatctttccctgtaattaagtgttctctaaatgatttaaaatttctgtatagatcaagcgacctcatactaacagctaacatttctatatgcatgtactatgtgcctggttttatgcatatttacatttgcatacatgagaaagcatatttatatgtgttacagacctgcaatatgtatgtctatatcccatcagctataatattcaaatgtgtcaactcacgtgatgctcacaacccagtggggtagaaagtattatctcccttgtacagatggaggaaaccaaggcatagactttccatagtcacacagcagaggcagaatttgaacccaggtaccctggctccgaagcgtttcctcctaagagctatgctgcctttcagtataccattgcgatttcacaggtcaccatggttaaccatttcatttatttcctttgacctcacttttaatttgttattgtgtcatattttatgtacccttgtaagttacctgaaatcctttctgccacaaggtgaggtaaggcataaataaacagtgcagagtgtggtaaacggcacaagaaggcacagctaaattgctaccccggggtaagaagatgaatccaggctgtcctgcaatggaatggatttattttcttgagctgtggtgagctcccatccctggaagagctggcttgggtggccgtctctctgggaggctggggaaggccttcttccaaggagacggagctgggccagacgagccccgaggccccttcttagattctcagggtttatgaaaatgccaataagacaaactgaggcacttaatggagctaatgcagcaaggcagcccttgggccggaaccaggacctggggcttttcatccgggtctattactggaccacacatctacaagtaacaaataaacgagcagagattccgttccaaactctcggcccagtgtattcctttcccagagctctctggctgctgttgcaagatgaccaaaggatgctgtcactgtcctcagtctttttattggggcgatggagaatgaggcaaggaggggctgggtggccccgcagatgccccatgacaccatcattcggcaaggttatgcatttgacgaatgccctgcagtggaaggagcccaggcttctcttcctgtttttgatgtttacttgggggttgatcttgtgcgagtttcttcagctcccgggaccctcagtttcctcatctgcaaaatggagttaatacaacagcaaagctgctgtggaggtcccatgagctattacagggctttgcacccttaaaaatgcggttgaggaagtaccgatacgcctgcctcaggggatctggggagggctgggctgtccccatgcctgagaccaggcaggcccgtcttggaggggcggtggccagcgtccaggtgctgccagcttcctaccccttcagcctcctgcccaccactgctcccttggctagaacgaagccgcgttcccgacagacaggctcacgcacggtgatatccgtgggagtgcgggcgagcagcccctcctcgccggaccccgggggcttcgggcaaaaatggagagcaggcagaggtcacatcctcctcctcttcctcacgctcccgggctgcgtgcccacaggggcacagccctgtgcgcggtgccaccgggggccatcaggctgggttagaggaaggcccgacctccgcgcagcaaagaaaacaaacacagatgtgtttggctgggaccgggagggagaaagtggcccccttcccccgcccgcgcgctcccccgggcgtgaggctctccgggcggcgcggggcgcgggcgaggctgacagtccccggcggcccctcctcccccacggggtgcgcgcctggcccggcccagccccctctccggggtttccccgggtgctctcctcgctttctctttgtctctgctgttctttctcgggctcccgggttcccacccgccctgtgctctccctctcgggcgtccgggccggttccctttaactttcttctttcccggggtgaaaactttgctcggagctggcggcagctcgcggacgttattggccggcgccccgcccggcggccccgccccccgcccccgcgctcccctccgcccctcactcccagcgcgagtggcggcggcggcggagccttcgggggcgagcgcgcgtgtgtgtgagtgcgcgccggccagcgtgagtgtgtgtgcgccccgggcgcgggcagggcagcactccgagctcggcgggagcggcgggagccgggcggccgcgtagtcactcgggcgagagaggcggcggcggggccgggaccggggctggggctggggcagcggcggccgcgccgggcatggagctggcaagcccgcgctgaggcgggacgcgcctgctagcagcgagcgagaggctctccggcgaccggcgcgcgggctccccggaggggccaggcaaacttttctttctcttttgccccctccagaggtaaagtcccgaacgcggactttccggcggggacgcgatcggggggcatctgagagggaccccgggctgcgagacgaaggggcgcgggccgtgcagagtcggggtcccccagctctcctgcgcccgaaacttggggtgcgaggggggctggtcgcggacggggagaccggctcaggcatgcccctcgggcggcgtgggggcggcggtggcggggaagcagagcgttctcccgccgggcggggaagaaggggcgcgagcggtgcggacttggagggccccggcttcgccgcccgcgggactttgggggagagaggcgggcagtcggctgcggggtgggtgcccaggaagccgggcgttctcccgcatctccgctcgccaccccgccgagagctggagggcgcggggcgggctggctgagcgcagctcccttctctccgcaggcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtgggtgagtggggtgcggcggcggagccggcggcgggtggggccgcgggcgggagctgctgggcctcgcagcggcgagttcataggagcgcgggtcgagggaacggcgggaggcgcgttcgccgatgcccgggacccgggagggctcagagcaggtccactcgctcgcgtggcgctcgtggtggacgcccgaatttgcgcccagtgctctctgcgaagccaagaagcagcaggagaaatgttcccgggagggggtttggcagaacatttgcagataggtctccgctaaccctggatccaaacgcaaacattcattgccttccccctcgttgggttggacgctgggattcacctgcacccacccccctttcccaaggctgcagctgggctcgcggttggggaccccggcccagttcctgggaagttccaactccacacctacaaatcccttgggagatggcaaagaactgtttgtagtttggggtcagttcggtacccgacgagtatcactcctgccctccatttgtcttttcatgatttgaaactatttttgtctctcttttgaacagcgtgtttgtgttagcaaaagaagaatgatgtgatttcaattaattactatctgctgattacaacggagcgttcagtaattattttaaacgaattcaattctggtctaaaaaagtataccagattttttttattagcttcaggctttggtgaaattaaacagttttgaattaactaagggtccagcttctcactttttaaatagggtttcatttcctgaaagagaaatctgacaaaaccgggtgaatacggctgggtcagaaatgaagctaaaaaaggatacgttctgcttctgaattggacgactttgctgctgcagaagctctcagaaatcagtttctccccataaaaagaaaaaaagggtgaggggaggtagcaagactacaccttactttttcagtatgggaagtaaagctccaaagcccacatttatttgagcgaaaattatttagtctgtaaatgtcccatttggtgtgcatcctttatgaacgtacagatttttcctctccatctccccatctcaaacagccagtgtgaggctcttcaattgctttgcccctcttaggcacatttcaaagtttgctggtccccacaaacacacgttttgaggtctggttctgattaattgtgtcatgttgttgtcgaatagtttgtgcctcatgactgtggatgcagagttttgagcaagggaatggaaaacatgtcttggagggccggatcgccgcagaggcccagtcaggcgtcctggtctgaagacgccgggcctcccgcctcctgttgcaagggaggcctccatttttacgctcgtgtcccgctcttgcagacataattgtttgtcccctttcttttaaggatcagaactagtttccagtctgaagacacttttcaagatttcgcagagagagagagagtgtagttacactccgacttagtagtcttctagaataaaattcctttgatctgctcagttccctcggaaatgttggtttttcccatctcttcttttccccctccttcctcttttcttttcttccctttgtgcgtaaaagccctttattgacatttaaagggattcccagggttttgctatcagttttagtttgtatgtgcatatgaaagataactttgtcttgtcaccagcagggtctaattggacaaatgcaagtgaatacatttaggcgaataaacttgatgtggtggtgaaatttctctggcttgaagatttgccttagcgttggtattgttcagattcaccacccacccccaggtcttgccgtcagtttggatgtggacacgtaacctgcgtttgttataatgatggtcatgcacttgaaataatctctatagtttgggattttgtctcttgaccaaagcactaactatgcacacaaattggattgacctttttttttattggctaaattgagcaatcaacatattaacgaatgtaattagtaaccgtttttgttcaaaaagtttaattaggcttaataagtacataatctacatgacaaatgattggctaacaatatttttctgggttttactgaagttattttaattcccagtagttaaagtatctttaaatcttgccaattattcagtcatctcataaaagcaaagccaattcaactatgttaaagttatttatagtttcctttttgaatagatgttctgataccttgtagatatagctgggaacatcagattgaagttcccataaagtcttaattgaagtcttagtgatttttccatcattctgtaaaagagaaagacagcaaggacaatttaggggtgatttacaattaaaggttgagctttttatgaaaaggccctgtagtggagatatgtgaatgaattagtatttgacaggtgttctgagatactaaagggcactgtgctaggaaaaagcattaataaatccttcaaaagtaactttggactatcagaggctcagattttcctcccaacataatctcttcttgcgaatttcacgctgttgacatataaagtcaagctacccagagtatttacaactatggcaaagtcaagaagtatatattttttaattcccataatcagtcttaataacaatgagcctattactgtgctgtttggtctttgcttttataaaataatgatatgtgatttataataaattgaaatggtacccttccctaggttaaccctgtgccccaccctcccgcaaagaaaaccccctaaaatttaccaatttaccaatattatcatttgactgaacagtccttcgacatagggccatggtccttatagatgactaagaaatgcacatatcctatatgttttctttggtccagttttcttttcggtgttgtttcaaggtcaagctttctatggaataaaatgtgaacgttcataaagcccagttatactttaaatgcagttttggatttcttccggggggggggaacaaacaaccctcaaaacaatatgaaagacaagacgatgtataatgttacggccttgacagctctcagtggaataactaaatactttcttccgcccatatgtatcagcagtgttcacatgcttttatacacatgtgcattcacattcattgtgtaaagaagtacccatgcatggtggggctgtgtgtacattcaaggcaaaatgcatgaacagttgtaaaccacctgggttgctaggccccttcccccctccccgcccttcccttttttcaaaagagcatctgaagaccatattgtgtttcataaattatcgacatcagttttaatcattgtccccctgacgtcggagctgtgttagtatctagtatttagcatgacgaagcatgctgtttaatcttactgtggagttgtcagcatgagcccctgcctggcttgtgacaggtcgagcttatgaaaacttgttttgcgactcactctatggctttgcattgctcagctgtaacccaaaacccacacaaaaggtgtctctgcaagacgagcaccgtgctgggttggcctcttaatggtcataggtacctgcaacataatgcttgtgattgtttaaatgtggctgtgggttgggggtcgggggatgtcctcatgctgtcaatagctctggtgcttgggtccaccctcattcatccctggcaagagagggaggttatattggaggtgttgccatgagaaatccaatgccccactaaagattcttgcaaaaatcagaaagctgaaattatttgctgcttagtccagagcctggcacatagctatagatgagtgaatgtttttaatagtcataataattattatgattattgtcattatgatgattaaccctggaggacttactctttgccaagcgctcacattaatttagacatttaatcaccgtgactacgctaataatagggactgtaattgtacttcttttagagatgaggaaaccatggcctagagacattagatggtttaccctaagtcacatagctactgggtggtgaagctgggactccagcctgacgtttgtgctttgttttgttgtatccactgtgctgcttttccatagaatgaatggatgggtggatggaagaatggatgaatgaatgaatggcagtgatatatccatgtgtaggagaaaggctggaacaacctattgcttcttgctagaactgggcgtggttccctggttgtgttgcattatgtattttacatcatattattatattttattatattatattcatacatacttaacatgaagttgtatataagaagttttcttttatcttagccatcaggcctgctgggagctgggagttgggactatgaattaagggggtttagatactttcctgggggttcttggcatccacaggtgttgctttcttggccaagtctttcttgatttcagggcctgtagtctctttcaaaggtggcgaagctgagctgtgggtagtcagaacccctctttaagaaggccttcctccagcctggccaacatcgtgaaaccccgtctctactaaagatacaaaaaattagctgggcatagtggcgggtgccggtaatcctagctactagggaggctgaggcaggagaatcgcttgaacctgggaggcggaggttgcagtgagccgagatcacgccactgtactccagccctagtgacagagtgagactctgtctccaaaaaaaaagaaggccttctcttttcaccctagtgttcactatccctttgcttcactggaacgtattgaaaaaatccagaaagtggctgaaactattgttgacaaagagaggaggtggatgggggatggtatgtcccggccactggtgtggtgccgctaggtacagttgacatgagtcagcagcacagggctgtcattcatctctactggccccatggcagctggagtgaggttctctgctggggtcctcattagcacctggtgatcaggaacctcgaggcaaggaggccgctccctgctccacccagagcagggaggcaggttcgtcaggggaaaccttctggggtgggtctgcgtgtttccaggctctgccgtgctctctattagccctgcccagttttctctctgacctcctcctcctgtagaaaaatgagatcctcagaaaactatttgagactttatgtccagagtaaatattggaaaggcagtgggttgaaattcagatgttccctggaaggaatcccctcgttttctgctcacagctggtgtcgatatttccttcttgagatgagttgtgcttttcattaagtaaattttttgtcttgggattaaaccaacattgtattcttaatagactttcatgtttacacttcaaatgtccactggattgttactcatgttatcttgatggcttctacggtgtctgcaatgcacactgcctttaccaaaataaatggctctctagggaactggattataaaacagccttatctgtggatgcacaaatacggatattttgtgagccaatattttttttttcatcctttcagaaggtgttaatcataccttgggtttctgtagtgcctttcattatagggagacgggaggtctcggagggcttttgaaatgctcaagacttaagcctaatacttgtagagcaggcccacagcattttgcctgttgtctggaagcccttgtggtctctgcaggctcagaaggcatggtgttggtctgggtggcctgggagctgtggagtttaaaatgtccgtccatggtggttggggggttgcgtcctgaagacagaccacaaactcctattgagtgccaggcattgtcctaggtgctttatatgtgctttgtttcaattaatcagattgccacaaggaacggaagcttttcaaagacagatgtcctggccatcaaagggcagcttttacacaaacgggactaagtgtggataagtctgcagggcacgtctcggcttattctgtgacactgttgcatgcagagagagcagggggtatcaggagcgtttgcttggaagactgatcacataaaagccgtgtcctattatagccaactcggagggacggttgttctgaatagtacttgaaagaagtgagctgcctgggccagtcctgtagatacagacgttcacctcaaagatatctgctctcatgaggtttgacttgcgtagcacaacttagtgagctcagtattgcattcctgtctccttactccaaaaatggatttctattgtaaactaagaagtagattttaatttgcgttttaaaagttatatcattggccgggcgcggtggctcacgcctgtaatcccagcactttgggaggttgaggcgggcagatcatgaggtcaggagatggagaccatcctggccaacatggtgaaaccccgtgtctactaaaaatacaaaaattagctgggcgtggtggcgtgtgcctgtaatcccagctacttgggaggccgaggcaggagaattgcttgaaccagggactcggaggttgtgatgagctgagattgccccactgcactctagcctggcaacagagcgaaactccgtctcaaaaaaaaaagaaaaagttacataatttatgtgaatttccccccacatcaaaaggccttggctaggtgtgtattcagccccaaatacattattttgtgccagttctcccctctgatggagagaagggactgtggccatgtgattgatgagatacagaatgtctcccatcagacccttttctttttctcccagagcttaagttcctgccccaagcacagttctatcagaggcagctgctggcactcagagcacaaaggaagatactctccgaggagaaaggggtacctatggttcaggagtaccgccaaggaatggaaagctgtgctccgctcttgcctgtgtcaggaccacccccagcaatccctggaccttctgtcattgggattagtgtactaactacagttagggtgaaatgaattcacactgcagtgcattggtgcatgtgaagaagacctagaagaaagatgattctgtggctggacgcagtggctcacgcctgtaatcccagcactttgggaggctgaggcagggggatcacgaggtcaggagttcgaaaccagtctggccaacacagtgaaaccccttctctactaaaaatacaaaaattagtcaggcgtggtggcacgtgcctgtaatcccagctacttgggaggctgaggcaggagaattgcttgaacccgagaggcagaggttgcagtgagccaagatcacgccactgcactccagcctgggtgacagagcaagactcagaaaaaaaagaaaagaaaaaaaaaagaaagaaaagaaagatggttctgtaagtgtggtagacctccggattatttaaagggttcaagtaaatttgttgggtgagaactttaaaagcagaaagtaacactccagttcacttctcaactcagctagtgccttgctgaggaaggtgctagaagtctgtctccctggaggattcaggaattggcctgtgtaaggtctcagctcgctgcacacgtggtcatattttagttgggaacccatctgtgccccctcctggctggtgctattgctagattttctagatttttcccgtgtctttttctgcctgaagatgagagattattggttgttgtgtccaattttcacacatcccagagactccacacttaattgagacaatctgtaggactacagggacctctaaaggggctggctttaaataactgagtcctatgtaaggaaatgaggtagatctctgagtttcctgagggcctgtatgctgtgctgcattccatatttgaagtccccaagtgagggacacttcctgcctgcttgattgccattgtcagggcttctgatttcgtctgtttctgctttggggcggccgtggtgagtacccagcaaataaatgtaccaccactcccgcattctaaaaccagggcagacattggcaatcaacggcagcatgctttcctcctaagtcgagaaatgatcttataatattagactcctcaatataactccttaggcagaattagcccatgagatgaaaactatctgccatttttggtccccttctgaagaccttccccttccccaacctgcagacagagaagtactttgtatacatggacatttctggagcatttactgttcaggtggctctgtttggtctgggcatgtaaagaaatgtaaagtagaccaggtgcggtggctcacacctgtaatcctagcactttgggaggttgaggcaggcagattatttgaggtcgggagttcgagaccagcctggccaacatggtgaaacctcatctctactaaaaatacaaaaacaaacaaacaaaaaaaactagcctggcatggtggcccacacctgtaatcctaactactcagaggttgaggcaggagaatctcttgaacccgggaggccgagattgcaatgagtcgagatcgtgccactgcactccagcctgggtgatagagatggtgtctcaaaaacaaacaaaaaaagaagataaaaaaaaaaaagaaaagaaatgtaaagtggatgccctccctgcaggtgaaatatgtttccatcaaggaggctgtgcacgtgagaaggtgcagacgtgtccacttgcactaaccctgaacagggataggcgcccccagtgaggcactttgctgagtgtccggggtgcagggaggggccgagggtcttgagaggaagagcattttggatttggctcctgtaccacgaaaggattggattttagtccacatcacatttgcctgctgcattggttctgttgtagtgtatttgttttctcccatgccaagaatttgagagaccatggttccctgaaaagagtggtcccccaaggaatgtccgccccgacgtttctgggcaggtcctccagaactgccttggattttgaaacaaaagcttatcactgtccctacactcaaaagaaattatgccccaacctgggccaggaccctggtgcctgaggcttcctggggcttctcccacgtgaaggtcgttccttccactcagaaccacatctgtgtggtattgagggacgaggactcatctccgtcacaaaccactgccctcagtgctctgcttacgtttgggctggtgcagaaagtgccgaacaagaatagttccaatcccagcatgaaaaagaaaacacattgtgtttacagatacagaatttggcatctgaaacgtgaaagtacctttgggttgggcggccccagggcagagctgttggacacggcccccccagcccctaccctcagccctttggccagctcgttttcctctccccgaagccagacctcagaggtgggcaggtcgatctcagccaactctttattccgacacccagccctgtttcactctatggctcagaaccgggagagaattcacggtgagaaagtgcttggccttctgagctgccatgaggaaggaaactgcttcttgctccaatccacagaaatcaatccttttttttttttttttgacagaatctcactctgtcatcgaggctggagtgcaatggcaccgtgtcagctcactgcaacctctgtttcctgggttcaagtgattcttctgtctcagcctcctgagtagctgggattacaggcacccaccatcacgcccagctagtttttatatttttagtagagatggggtttcaccatgttggccaggctcgtctcgaactcctgaccttaggtgatccaccctccttggcctccaaaagtgctgggattataggtgtgagccaccgtgcccggcccaatcctttttaaaccatgtttttgggcagacttgccatcctggtacccagaaatgctagagaagaatggggctgaacagtcctatttcttacctcagtttattgtttgaaccaggggtagagaggttgtttgtttgtttgtttgttttaatagaagatgtctgcagaagaagtgaggcatatgtaagtgagaatcaagttgcgattttcctgatctgtagaaagtacttagttctggccaggcacagcagctcacaccagtaatcccagcactttgggaggctgagacgggaggattgcttgagcctgggagtttgagatcagactgggcagcatagcgagactgccgtctctacaaaaataaaaaagaaagtacttagttggctgggcatgcgtggctcacgcctgtaatcccagcacttcgggaggccgaggcaggcggatcacctgaggttgggagttcgagaccagccagaccaacatggagaaaccccgtctctactaaaaatacaaaattagccgggcgtggtggcacgtgcctgtaatcccagctacttgggaggctgaggcaggagaattacttgaatctgggaggcggaggttgcagtgagcagagatcacaccattgcattccagcctgggcaacaagagcgaaactctgtctcaaaaaaaaaaaaaaaaagaaaaagaaaagaaagaaagtacttagttacttagttttaagtcaagatcagagagcacaacattctatctactaaagtgtgaaataccaagatacatgtattagggacaatggtgagagaacacccgtctttgacttcagactggctgggtttaaattccagttccaccaggagtgtggacttgggtaaattaagctgtctgtgcctttgatgccttggtgtcctgggggcccagctcaagaccaccttgatagattggatagggtggggagtgtgaggagccctgtgttctgccttgaaagagggctcagaggaggggtacaggaaggagacccagaggtagggttctgatcctagaccttgggattttatcagcacacatttctatagcctttattatcaccatgtactgttctaagccctttataagtattacctcatttaatcctcatagcggccctatcagggcttgttattctttttttttttctttttcttttttttaagatagagtcttgctctgtcacccaggctggagtgcagtggtacgatctcagctcactacagcctccgcctctcagattcaagatattctcctacctcagcctcccgagtagctgagattacaggcgtgcaccaccaagaccagctaatttttgtatttttagtggagacggggtttcaccatgctggccaggctggtctcgaactcctgacctcaggtgatccacccacctcagcctcccaaagtgctgggattacaggggtgagccaccgcgcctggccttgttattcttaagtaaacttctttattgtagtgtaacacatgtagagaaaatcccatgaattatgtgtccagtgcaaagactattcatgatatgcacacgcttgtataaccagcacccgcatcaagaacataccagcaacccagaagctgacctgtgcgtccacccagttaccacgccccctacccaccatacatgggttttgattatttttgtttattttttatttatttgttattttttgagacggagtttcgctgtctcgcccaggctggagtgcagtggcgtgatcgcggctcgctgcaagctccgcctcccaggttcatgccattctcctgcctcagtctcccgagtagctgggactacaggcgcccgccaccacacccggctaattttttgtatttttagtagagacggggtttcactgtgttagccaggatggtctcgatctcctgaccttgtgatccgcccgcctcagcctcccaaagtgctgggattacaggcatgagccaccgtgcccagatgggttttgattatttttgaacttggtataaatggaatcatattctggcttcttttgctccatgttacatttgtggtcttcatccacgtatagtagtagtttcttagtttccattgctggccagtattgtgtgatataaatgtatcacagggtatttctccactccacttacggcaggcatttgggctgttcccaggttttggctattaacagtagcactgctgtgaccatacttgtccatgtcttttgatgcacatctgaatgcacttctgctgggtgtgtatcaagaaggggaattgctgggtcctagggtttgggcatctgttcaatttcacttttatttttaacattttttgagacaaggtctctgtcacccagcctcctgtcatccagctttctgagctcaggcgatcctcctgcttcagcctcctgagtagctgggatcacaggtgcacatcaccgcacttgggtatttaaaaaaaattatttgtagagggttgggcatggtggatcatgcctatcatcccagcactttgggaggctgaggcaggtggatcacttgaggtcaggagttcaaaaccagcctggccaacatattgaaaccccatctctactaaaaatacaaaaattagccgggtatggtggtgcacgcctgtaatcctagctacttgggaagctgaggcatgagaattgcctgaacctgggaggcggaggttgcagtgagccaagatggtgccactgcactccagcctgagcaatagagcaaggctctatctcaaaaaagaaaaaattatttgtagagacgggggtctcactatgttacccaggctggtcttgaattcttgggctcaagggatccttccttctcagactcccagggtgctgggattacaggcgtgagccaccatggctggcctgttcagctttaatagacagtggttaaactctctatttagtggaaagtggttgtacaaatttatatctgtatacagttttacaggcaaagaaactgaggcacatggaggttagttaaggtgcctgaggtcacacagctagcaggtggcagaactggaattggaatccaggcagtgcagctctggaggcttgcttttcaccactgggccaagtcgtctcttatctttttttttttttttttttttttttttgtagagacagggtctcgctctgtcatccagtctagagcacagtggtgcaatcacgtctcactgcagccttgaacttctgggttcaagcaatcctcctgcctcagcctctcagagtgcttagattacaggcatgagtcacctgcttggcctgccacttatctttaatctgcatactccctgacaggaaaactagtaatactgggaagcaaaggtgactttgtacaagtgtctttacttctctgggcctcagttctctcctgtaaaacgaggggttgggtcacaaaggtcatgtaatgatattctgtaggtctagtggaatatactgccttcctgaggacttcttcagtcttccttaacgaactcaccccattccctgctcaaccagaagcagctctataacttgaatgatacattttccaaccctacccctccactggggttccctcaaaggactgctcaggctctaactggaggacctcacttgggcctaccctccaaccctactgacaatttccccacctcccactctccagctcttccacttgcaggggtggggacatgggactctccctctttgccttccagtgtgttcgctagctggtcttctctctttaaatcatgagtgttcaggtgtatgaattttcacaaagtgagctcacctctgtgtctaccactaacatgaagaaatacagtatttccagaaggctcctcccaaccccccagggtaaccaccattttgacttccaacacaatagatttaatttgcctatttttgaactttatgtaattgaaatcatactgtatgttctcttcaatatctggtttcttttgctcagccttatttccttgtaaatagtcttaaacataacttttcctatagtctttgttagtttgatggatgatctcaacttcttggggatactgatcctctcgcttattttgtctgctgacctttgctcatggtgaatgatttccttatgtgttttgtactttctgactgtgagcttatctttatttgggatttcgtggaaatcccactgctgttagttatggaaatgcccctatccatatgattttgcattaattctgccagacattctagaggtatcactggactaggaccaaattttccattaattaatcatcttgaaaattattatatcaaatgaggagtatgtacttggcctctaaaccttcccaggcctggggtttatttttctccctcactgaggactttttctgcctttacccagaactctaggtagagacaaatttttgctgtcaccttagcccgatggacaaagcttcttcgtccccttttgacccagggggcatttggaaggtccaggtttttctgctactgcgattacagctgcagtttcctagctggtctcccttcctttatctttgtccctcagcctccctggtctcttcttaacacagcagccagaggtaactgcctgtgtgttagttccctgttcactcagaggaacacccagaacacttacaacggttgcaaagccctgtgtggtctggcccctgcttcctctctattctcatctcctggcactttgctgctcactcagtctgttccagctcccaggcctccttgctgttagtgggtacacagcttatagccctggtacagcagctgagtctgggcttgagataggcccaaatatgcaaataaatgactccctaggttccttcaagtctttggtcaaatatcacttctgtgaggcttacccggactattctatttatactgcaaacagctcccctatttgtgtctatcggactctctctctctgtgtctctctctctttctctgtcttctcctctctttctctctctccacacacacacacacctgagatcacccttatcctcccctactaactccttttccccataacactcataccacctaagacactatttaatttacttatttattatgttcttaattgttttcccctcctcccatttgttcctttctatcacttgttggaatgttaaggtacataaggtcaggaattctcttttattcacagggggcctggcataagtaggtgcttattaaatatttgataaagaaagcaggggtcccatttgcaactcctgggcttgcaagacctgaggccttatctccggtctgtgtgtgggtgctaaatcctaagctcaaggcattaaagcctgtttccaggtctaataatcagtcagtctttcccctttctctatcctccctgctgttccctccctcctcccacacacctcatgatcactggggtctcagggtttctcttaacactttggctttcagatttttctttcctctagcacctggggatttccttttatttcttatgagatctgctattcattaaatttttttaaacttacatttcatctagtatttctagatgcttgcagtggtaggggttctgcattacctcagtccaccttgttgccagaactcgaagtaatatattttaatctttcacacatctggaattaatcgtgacatatggtgtgaggtaaggatatccattttttcatcaaatatttagccagttattcagtgacaactattgagaaacatcattttttgtcactgatttgagatgccatatttattaaatgcttaagtattatataaacttggatctgttctctggatttttccattttgtttcacaaatctgttttcctgccactttctatctgtttggatatttcagtatctggtaggttcagtattcactcattattcatctgttcattttcacttattctcattgctattcttgcttgcttgtttctttatatatttatttattggctttagatgagtttgtcaagtttcattacaaatgccattagtaatttgacagcagtgttgttaaaatgaacttggtgatagttgaaaacattgtaactgtatcaacatgtctcttgtatgtaatgatttgattatttaaatgtacccaatagggcttttaggatatcagaaaagtaggttttaagtctggtcaaaatcatgaattgtacttatgtgtttctctttgattcttccagatgatttttttttacagatttattgagatataattgttcagtaaattgcacatatataaaaagtataacttggtaagtttgacttatgtatacacctgtgaaaccatcaccacaatcaagataaataacatatccatcagcccaaaatgttcctgctgtcttggtaatccctcctgcccctttccaccatggtgccttctgtcattgtatatctgtttgccttttctagagttttgtgtaaatggaatcatacggtacgtgtggtctggtttctttcaccttccatgcttagttggattatttattcatccatcatgttaagtgcattaatagttcaatcctttttatttctgggggggtattcattgtattgctataccacaatttttccattcacctgctgatgggcatttagcttgtttctagtttttggctattacaggtaaagcagctatgaacattcttttagaagtctttgcatggacatacactttcatctctcttgggcaaatacctaagagtggattggctggatgatacagtaggtgtaggtctaacttttaataaactgtcaaactattttccaaaatggtagtaccactttacatctatatctgcagtgtatgagagttctagtttctccagtccatttcctcatcagcatttgatatggccaatcttttagaaattttagccattccaatagatgtgtggtagatacccttccaattttaagttttacaatttggaagtatagaacatctacatttatttatgtcttcttttatgctattcagtaaggttcataaatttctttatattagcatcacacattttttcagaagagtttacttctatgtatttataattttgattactattatgaaagggattttttccttctcattttattttctaagtgggtattacaatgtatagaaaagctatgaactatatatacatttttatgtattttgcaaccttcagctttactaaactctttttaattcgttctcacagtgtttcagtttctctggacttcaactatatatatgaatattttagcccttcttttccaatacttgtactatttatttttcttgtcttactgcattggatagaatgtcaaagtaatggtatatataataatggtaatgtactcttgtattactactgatttaagtgagcacatttctagagtttcattgttaaatatgttgtttgttgctagtttcatatggatgttctttattgtactcaatggagagacctctattcctgacttactgggagggttgctctttcttacttttttttttgtttgtttttttgttggagagataaggtcttgattggttgcccaggctggagtgcagtagcatgatcaatcatagctcattgcagcctcaacctcctgggctaaagcaatcctcctacctcacactcttgagtagctgagactatgggtgtgcaccatgcccagctaattttttaaagaaatttttgtagagatgaggtcttgctgtgttgcccaagctgatcttaaactcctgggttcaagtgatcctcctgcctgagactcccaaactgtgctctttttttaaaaaatattcaagaatatgtagaatgttaatcctttagatattaatcaaaatgatcatatcatttttctgctttgactattaatgtaatgcatttctttaattgatttctgaggtataattcacatgtcatacaattcacccatggaaagtggtttttagtatgttcgtcgattggtacaaccataactgaaactaatcctataacatttttgtcatccccaaaaggagctttctacgaattagcagtcactttccatccttcaccctgatctgcacccacaccctaagtaggcttttgatctttacagatttgcctattctggacatttcatataaatagaatcacgtaacatatggccttttgtgactgacgtctttcaattagcataatgttttcatggttcatccatgttatagcagtacttcatttccttttaatggctgaattccattatgtaaacatatcaaattttgattcattcatcagttgatggacatttgagttgtgtccattttttggctcttatgaataatgctgctatgagcattggtttacaggtttttgtgtggacatctgctttctctggggtatctacctagcagtggaattgttgggttataagacaactatctcatccaggtgcggtggctcatgcctgtaatctcagcactttgggaggcggaggcgggtggatcactggaggtcaggagttcgagaccagcctggccaacgtggtgaaacttcgtctctactaaaaatataaaaattagccaggtgtggtggtacacatctgtagtcccagccactcgggaggctgaggcatgagaattgcttgaatccgggaggtggaggttgctgtgagctgagattgggccattgcactccagcctgggcgacagagtgggactctgtcaaaaagaaaaaaaaaaaaaagacaactaactgtgtttaactttttgaggaatgccagattggttttcaggcagttatactgttcctaggaccctagaacccaccagcaacatatggggatcctagtttctccatacccttgaaaacacttactatctatcattttgattatagccattctggtgggtgtgaaggggtatcttgttgtgcttgtgtgatttcctaagtttgaaatattccagcattcttggaatgtatctatttggtgatgtgttattctttactaacattttattttagatttttatgcctatattcaaaagtgagatttgagctgggtgtgatggcgcgcctctctagtctcagttctcgagaggctgaggcaggaagattgcacgagcgaggggtttgaggctataatgcgctatgactgcacctgtgaatagccactgtactccacaacatagtgagactctgtcccttaaaaaaaaaaaaactgtgaggctgggcgcggtgtctcacgcctgtaatcccagcactttgggaggccgaggcgggcagatcatgaggtcaggaattcaagaccagcctgaccaacatggtgaaaccccgtctccactaaaaatacaaaaattagctgggtgtggtggcgtgctcctgcagtcccagctactcaggaggctgaggcagaagaatcacttgaacccaggaggcagaggttgcagtgagccgagattgcgccactgcactccagactgggcgatagtgcgagactccatctcaaaaaaaaaaaaaaagtgagatttgtctgaccttttgtcactttatattgccttttgtatcaaggctgttttaaccttataaaatgaagtgggaagtttccattctattttatgctctggaatagtttaagtaacatgagaaatagctggtccttgaaggtttgttagaattagcccatctgagccctgtgtcatttttgaaagtagttatttgacaaccatttcaatttcttccatacttatgtgtttattcagaaatttttcaactgctttttgagtcaaatctggtaatttgtttttttttaaaaatcatttacccagattttcatttttcaagcataggattctatataataatcactaaaatattttttaatgttcatatatggctatatcacctttctaattgctaatagcaaacattttttctcactctctctttgcctaggtttgtttgctttttgtacatttgtgaaagtgataataataacatttgatcatatttaatgaacactcactgtgtcctagaccctatgctaaatattttggatgcactttctaatttaaaaaatctataacactgtgaattgagcaaaattattcccattttacatatagttgagtagttaagaaatttagcttgcccagagtcacagagctgcaaaacccagggccggaattaaaaaggatctgtcagttttcaaagcgggttcttttatccactattccagactgctgcttatttttaaatgcttttttatcatcttctaattgtctctctaatctctctcttttttttttttggttgagatggagtttccctcttgttgcccaggctggaatgcaatggcgcgatcttggctcaccacaacctccacctcccgggttcaagcaattctttctgctgcctcagcctcctgagtagctgggattacaggcatgtgtcaccacgcctggctaattttgtgtttttagtagagacggggtttcaccatgttggtcaggctggtctcaaactccggacctcaggtgatccacccgcctcggcttctgaaagtgctgggattacaggcgtgaaccactgcacctggcatcatcttgtaattctcttaatttttttatctttattaatttcttacctaggcttctctgtggttatcctaattttttgagttgaatgctcagttcaactaacattattttcttattcctgttgagcattaaaactaagttaatgacttttcctctctagagtagcgttgaccacttcccataggttttgatttgtgctgctctcattgtcactgtttttacaatgactgtgtcattgtagttttgatattccttttgttcctggagttatttatgaattgggttttcatctccaggaggttatatcctttaaaatatttttttaaatgtccaattttttttgctgtttccggtactttttttttttcctttttggggcggagtctcactctgcggcccaggctggagtgcaatggcgcgatctcggctcactgcaacctccgcctcccaagttcaagctattctcctgcctcagcctcccaaatagctgggactacaggtgtgtgccaccatgcctggctagtttttgtatttttagtagagacggggtttcaccgtgttggccaggctggtctcgaactcctgacctcaggtgatcccacctgcctcagcctcccaaagtgcaggcattatagacatgagccaccacaccccagcctctggcatgttttttagtttggtttttgtttgttttttagaataatctcatgtgtatgtaagatcacctcttgtcagtgttccgcaggaattgaagaggaatcctgtttgtagggcacaatgtttatatttattgactcaatctaattgggattttattctccagatactctatattcttgttttcctttttgcctgcttggggcaaaaaaaaatattcatggaagtctttaacatgtaactcgatcttccacagattaagtgacaaagtcattcaacttcttaaatattaacatgtgcaaaagtacataaggcaaattagcacagagtaaaagcggggggtcacaaaacagtatgcgaaaagtagaattcagagcagagtacattatacacaaagctaggttaatttgtacagatacaggaaaaaaatgcactgtcattaacttgaatggattatgaccccggcctcggactcctccttggtacacaggggaagttggcctctcagttctttcccgtgctcacactctaggatggtggttttggggttcactactaagtgctgccagggatggaattaactgggaataggattagaagcaaagaagaggccagaatgattcctagcctgaagctggagcagtttgagccgacagctggggctgagtttattgctttggctcactcccgtctgtacatgagcatctgcctcattgccttttggcctggcaaaggggatttgctgaaatagaaatcagtctgcaaggaaaggatggtgaggccacagcgactcactgacatggggtgccacctcccgtcatgaaatatgaccccaaatggcttggtttggctgtgggatatgccaacaccacccccgggagctctcagctctgtggaagagcatttccataggcagcttcctacagaaacgggcaggcgacccagcttcacgcctgcctccatttctccttatccttctgccaaggggtgattaattcatggaagaaagatgggatgctaaagagaggagtgtgtttcacagaataccagaaccatgagaaaggctgaaaattaatgagctaagtatctaatttaagaagttagaaaaaaattaatagaataagccagaaaaggagatgggggcagggaaggagagataaaaataagagcagaagtcaatgagccagaaaacaaatattcagcagagaagatcaacccaagccaaaagttgattgtttggaaggactaataaaataaacaaatatctggaaagattggtcaagaaaaagaggaggcacaaatgaataacattaggaatgaaaaagagacataactagagatccatcagagacttaaaaaaagtaaggtaatgtgataaacaactgtatgctactaaattttctaagtgtcatttccgtatcatcattagcaaacccctggagaatttcaacagagtggtccatagaccacttgaatcaaattcttaggtggaatcaaagaaaaaacataaattggactttatcaaaatttaaaacttgtgcttcaaagatacaatcaagaaaatgaaaagacaacccatgggatgggggaaaatatttgtaaatcacgtgtgatgaaggtgtagaatgtgtaaggaatatgtaataaatcttagaactcaacaacaaaagacaacccagtttagaaacgggcaaagaacttcagtggatgtttttccacagaagatacacaaatggccagtaagcacattaaaagatgcactaaatcattagccatcagggaactataaatcaaaaccacaatgagataccactttacattcactaggatggctatacttgaaaagaaaggtaataacaagtgttggtaaggccatggagaaattgaaaccctcatgtactgctggtgggaatgtaaaatgatatggctacttttgaaaataatcccttccgaaaccccccaaataagagtccaggcatggtggctcatgcctacgatcccggtacttcgggaggccaaggtggaaggattgcttgagcccaggagttcaagaccagcctgggcaacatggcgaaaccctgtctctaccaaaaagatgaaaattagctgggcacggtggtatgtgcttgtagtttcagctactagagaggctcaggcaggaggatcgcttgagcccaggaggtcgagttacagtaagctgagattgtgctactgcactccagcctggttggcagagaaagaccctgtctccaaaaaaataaataaataaaaaagagaaaaaacaaaagaaaataatccctctgaaatgagttgtgatacgatccagcaattccattcctagatacacgaacacaccttacagatattataggttcagttccagaccactgcaataaagggagtatctcaataaagcaagtcatacaaattttttggtctcccagtgcatataaaagttatgtttacgctatactgtagtctgttaagtgtacagtagcattatatctgaaacatatacatatcttaattttaaaatactttattgctaaaaaatgctaacgatcacctgagccttcagcaagtcataatcttgtcactgttggagggcttttcctcgctgttgatggctactgactaatcagggtggtggttgctaaaggctgggtggtaatttcttaaagtaagacagcagtgcagtttgccacatcaactcactcttcctttcatgaaagattttgctgtagctgcataatagtattttacccacagtagaacttttttcctaattggagtcgatcctctcaaaccctgctgctgctatatcaaataagttgatggaatattctaaaacctttgttgtcatttcaacaatgctcatagcatcttcaccaggagtagagtccatctcaagaaaccactttctttgtcatccataagaagcgactcgtcatctgttcaggttttatcatgagattggagtgattcagtcacatcttcaggcgccacttctatttctagttcttttgctgtttttaccacatctgtaattatttcccccactgaagttttgaactccttaatgttatttatgagggttgaaattacttccaaactcctgttaatgttgatattttgacctcctctcatgaatcacgaattttcttttttttttttttgagatggagtttcactcttgttgcccagactggagtgcaatggcgcgatctcggctcactgcatcctctgcctcctgggttcaagggattctcctgcctgggcctcccaagtagctgggattacaggcgactgccaccacgcctggctaattttttgtatttttagtagaggaggggtttcactatattggccaggatggtcttgaactcctgacctcaggtgatccacccgcctcggcctcccaaagtgctgggattacaggcatcagccactgtgctcggctgaatcacgagttttcttaatggcatctagaatggtgaatccttttcagaaggttttcaatttactttgccaagattcatcagaggaatcaccatctgtgcagctatagccttacaaaatgtgtttcttaaataaagccaataaaaacaataaaaacaaataaaggcttgaaagtagaaattactccttggtccatgggctgcagaatggatgttgtgttagcaggcatgaaaacaacattcatctccttggacgtctccatcagagctcttgggtgatgagatgcattgtcaatgagcagtaatattttgaaaggaatcttttttttttttttctttctgagcagtaggtctcaacagtgggcttaaaatattaagtacaccatgctgtaaacagatttgctgtcctccaggctttgttgttccatttatagggcacaggcagagtggttttagccaaatttttaagggccctaggattttcagaatagtaaatgagcattggctttaacttaaactcacctgctgtattagcccctacataatcagcctgtcctttgaagctaggcattgacttctcctctgtatctatgaaatggcgtcttcgtccaatagaaagctgttttgtctacactgaaaatctgttgtgtagtgtagccactttttttttttcttttttttgagacagagtcttgctctgtcacccaggctggagtgcagtggcgcaatcttggctcattgtaacttctgtctcccgggttcaagcaattctcctgcctcagccttccaagtagctgagattgtgggtgcccaccaccgcacccagctgattttgtatttttagtagagatggggtttcaccatgttgttcaggccggtctcaaactcctgacctcaggtgatccatctgccttggcctcccaaagtgttgggattacaggcatgagccaccgcgcccggcggaaaatgcttcttaaaataagcatttcttagccttttcctggcttaatgaagtaaaatctctgggatggagcctagaaatctgcactttggtgaatgcattagatgaaacaagtgtacacagagttttaagaatcactgtccactgatttcagtagaattccaaataataattgtaaaaaatgaaatgaaagaaagaatggtgaaaatagaaaatcaccatttgacaaaaagttcgtggtaatagttggaggcaagaatcacaaggtctgctaaagttagggggtaaaaatatgatgaaaaatagaatatttgcataatgctagttagagtaccttcccgcaaccacagaaggaaaaagaataacttacagtgaagaaacctaaagatgccacctgaaccaactgatcagaattaacatcaccagtaatgggccacctgaaccaactgatcagaattaacatcaccagtaatgggccacctgaaccaactgttcagaattaacatcaccagtaatggacatagtgacatcatgtgccacctgatatgtgatatgatggcccaggaagaatactttgcttctgcaggattcttgctaacctgaatttaattttgaggaaatacgagatgatcccaaatgagagacattctagaaaataactggccattactctttaggactatgaaggtcattaaagacaaaaagagactgaggaattgtcatagactggaggagactaaggagacgtgagaccaaaaggcagtgtaagattctgaattggatctagacaaagacatgtgcgggacagttggcaagatttgaataaggtttgtagattaggtaatagtattgcacccatttcgattttcgggttttgatcattgtaggatgggtatgtaagagagtaatatctgggggaaactgaatgaagagttcacagaaatttgttgtaccattctgcaactttttataagcctaaaattatttcatattaaaaaataataaatgtcggccaggcgcagtggctcacgcctgtaatcccagcactttgggaggcctaggcgggtggatcatgaggtcaggagattgagaccatcctggctaacatggtgaaaccccgtctctactaaaaatacaaacaaattagccaggtgtggtggtggacgcctgtagtcccagctactcgggaggctgaggcaggagaatggcatgaacctgggaggcagagcttgcagtgagctgagattgcgccactgcactccagcctgggcgacagagtgagactctgtctcaaaaaaataaaaaaaaataaaaataaaataaaaataaataataacaataaatgtcactgcccttgagcatcgtgagtcctgctttgaaagctattggtgtagaaggaacttgggctttggaatcatacaaaccctagctggggccaggcgtggtggctcacacctgtaatcccagcactatgggaggctgaagtgggcggatcacttgaggccaggagtttgagaccagcctggccaacaggacgaaaccccatctctactaaaaatacaaaaattagccaggcatggcggtgcacgcctgtaatcccagccactcgggaggctgagacagagaatcgcttgaacctgggaggcagaggctgcagtgagctgagattgcgccactgcactccagcctgggcgacagagcgagactccatctcaaaaaaaaaaaaaaaaaaaaaaaaccctagctggactcccagctctgtcatgtaccagctaaatccagagcctctcagcctcgttttcatctgtgaaacggggatgaccatgtctatgtcctaggatcactggaagggtaaatgaaatgatgtatgtgagatgctaagtgcagtgcctgccttaccaggtgctcaggaaatgctggccctcccctgtggttcaagcacccagagatattttctccatgagtcagctcccagtctccctcttgccctggagcaaaagaaccaatcctgtccactaggctgtttcagcttggcaaggagccatcgaagccccctgtcctgttagctgagaaaaggtgtgtcctgggagagagaggattttgacccaggttgagatgggaggtggctctggcaggcagaggacaccctggggaccctcgggaaggcagcctggcctgggagctttctcacaggctctccttggcaggccacttaaagttacaccgacttcaaacaaaaagggtttgcagacacaaaagaaggctcaacctggccagtgccaggcctggcttggtatttgagttcagaaatccaactccttggagctcgcagacaggccccaccatcccggtaaacactccaggaatgccaagaacctgccttagagctcccctcccgggattgcttctgttgctgaccctgggtccggattcgttagaggtaaataagagccagtgctcccagagcggggactgtgcaacaggccaaggtggggctccttgtacctgtcttcaattccaacccctctccactttgcagtatgtgggtgtatgtgccgggctagttttcttaatggattatttttcctccagctttattgaggtataattgacaaaaattgtatgtatttacaatatgtaacatgaagttttgctatacatatgcattgtgaaatcatgaccacaatcaagctaattaatatagccatcacctcacgtaattatttttttttgagtgagaacatttaaggtctactcccagcaattttgaagtatacagtacattcttgttagttatagtcaccagactgtacaatagatctttctaacttgttcatcctgtctaactgagaggtgattttgtaccctttgaccagtgtctatccatcccccgcttaattgattattttaaagtaaagcaaaacgggtagttttttcatctatgtttttgtataggcccctccatgttctgccagttgagtctcccatgtgaccaaagacacgtttgggttttttttttttgtattttgtgttttgacgcggagtttcgctcttgctgcctaggctggtatgcaatgatgcgatctcagctcactgcaacctctgccttctgggttcaagcgattctcctgcctcagactctcaagttgctgggattacaggcacgcgccaccatgcctggctaattttgtatttttagtagagatggggttctccatgttggtcaggctggtcccgaacttctgacctcaggtgatctgcctgccccggcctcccaaagtgctgggattacaggcatgagccaccactcccggccccaaaggcacatttgtaagagggtgagcctgagttaagggcataatcattgaacattggaatgattgagggcatgttatatgtgctttccctatgaccccggcaggtccacctctcagtacccaccctagagaaacacatatgtgcacaaaaaggcatgtgcaagtgtgttggtctcagacttgttggtaataggtacatcaatcgaacatcaataagtctgggacaaacacacttgcacatatatatgagagagaaggagagaaaaaccttaacatctaccaataaggaaatggttatacaccaaatcaatgtattcatgctttagaatataaggctgcaggtaaaaatataagtctagagctgggtttagtggtgcatatcagtagtcccagctatgcaggagcctgaggtaggaagatagcttgagcccaggagttcaaggccagcctgggcaacatagcaagaccctgtctccaagacaaataaacataaatccatctgtatgctcatagacaggactgcatgatatacagagtgtggtaccacttgtgtatccaaacaaaatcctacctaatccatgactgacacagagcccccgggcagaggggccatatccttaccacctctctgtccctgtggcagctctggcctctcaatagctgcttctgaaatagcattggtttcagggaatttatgacttaactgactttgctgttattatgtggattaagaaccaggcccaaagttgattctttcccattgttgaacttggatgacgatgtaattggcaaactgtagcccgtgggccaaattctgtctgttgcctgtttttgtaaataaactcttattggaacacagccacgcccatttgtttatgtattgtctgtggccgctttccatacaacagcaggattgagttgttgcaacagagaccatgtggcctgcagaggctaaaatacttattatctggctctttacagaaaaatttgttgacccttctcctaagcctttcccctagacccgctctctttcttccaacactggcgaaaatggaaaggaattagcccttcctgttgctactgtgttactcagggggtttgggagagctgttgtaaaagctctggactaatgattactttattagaaattaatcaattaagaaaatcactgcattcccttgcctctccaacacacaaatttaagtcctgcagcagaagttctatctaaagcaggtcccctgtggacgttgctgtagaacttctgaaaatgagtacttctcccctccctcccacctccagcagattcggattccctggaggacaaggattccgactgttatctttctgtcctcagggtctagcaggatgctggcacattgcagatgcttagtacatatacagtggataaatacatcagtggaaaatatgaaaaaagagacagccaccttcggcttcttgcttttgggggcagcctatttagagaccatgaataagaaaagaaatgaaggaaatctgtgaacccaaatgaaatgaccagctgtatgaagggccagcaaatggctcatggagctagtggcttcacaggtgaaaagggagtgtctagcctcccttaagcagggctcatgaaggtgggccatgcttcagccacaccaggtcaggcacgtagtccccctcactcaaggacatgtgcttgagtgccttgggctaccaagttgcctttcccagggactgggtggtctcacgtttgccttggcagggatccccgttgggtgcctgacatctgattttttttagatactgtgatagtaaatgcgaggctgccatgaaaaaggagactccagcctgatgggaacgaagggcggacagtgaacacgattctctctcccagagaaagaacctagcaactgggttagcatttccagaaggctttttgtctgattcacaagctaatttcagcagcagagtgattatctagaacaatgtgccacacagagtggatccccgaagagccgagatgttaacttcaggaggaatcacttattcaggcctgcccgaggcatggaaacacgagagcccgccttgggagaagccgcctgcccaggtcggcccgacctgcctcacggggaaattggcttccactttctctttgaacaaggatggagggtgaatggaaggcggggcagcgagggaaggattaaagccccctgtttgttctataatggggatattcatcttgccttgtagaggggggtcttttactggaatgaaaaagtttcccccatacagtatccatcaaaaggtgcccttatgaggcagaaagaaaggaggagggagagaaatcattcagaacaagagtgggagaatgagaagacatgctaaatatctgaaatgagagagcaccgtgagtttggcgagctcgcagggagattacgccaagtggcaggggacgacgaggggctatgtttcagcctgagcctctcggtgggcccggagccggagtccgtccatcaggaacacaagtccccagccgggcagcacagcgaaagctttgggatgctaatggccctttaggaatgctaaatggagcatttctgtcgcaacaaaggggcaaaatgaggggagaaaggaattttagttttgaagtttccttaggggagggctaaacaatagcggttttaatggacagtgtaaaagttttatctgcgttatgaaaaagaggaatagggtacacatgccctcttggcagctccttggttgggttaaatggcgaacagagcgcctcagtagaggctggactggaatttgctgggtttcagcctctctgagcgaagggcaacaatgttgatctgaggactgctgtgtgggtcccatctgatcagagacacttctgcacatcttgctgtattgattcatgcactcattcattcagtccattcattcacttattcattctctccttcattcatgactcatccattcactcactcaaacaacaactggttattgaacacccactgcatccaggcagaatgctaaccgctgcctgcaccactgcaccactggacaatgctgtccagagagggacaggccatctctgctctcaaaaagctgatgttctattggggttgagcagcagaagtaaaagaagtgatgagaactaacatcaggtagtgactggagggcagcatttagacaaggcaccaggtgaggcctatctgaggagggaccatttgacctgagacctgaatgaggagaaggagccaaccctgcggagactgggggtgagaccatttcaggtcaagagaagacgtgaggaggtcctggtgcaggaaggagcttgccacgtttgagcaacagagcaaaggccagtgtggaggaaggtgggaagaggagaggaaggcaggatggataccatcttgatgggcttgatgggaaggcagacatcttttttttaatttttatttttttgagacagggtctcactctgttgcccacactagagtgcggtggggcagtcatggctcactgcagcctcaacctcccaggctcgggtgatcctcctgcctcagtctccagagtagctgggactacaggtgcatgccattatgcctggctaatttttattttttgtttttttgtttttgagaccgagtttcgctcttgttgcccaggctggagtgcaatggcgcaatctgtgctcactgcagcctcaacctcccagactcaggtgatcctcctgcctcagcctctagagaagctgggactacaggtgcacaccattatgcctggctaatttttttttttgacagagtttccctcttgttgcccaggctggagtacaacggcgtgacctctgctcactgcaacctccgcctcccgggttcaagcaattctcctgcctcagcctcccgagtagctgggattacaggcatgtgccaccacacctggctaatttttgtatttttagtagggacgaggtttcaccatgttggtcagactggtctcaaactcctgacctcaagtgatctgcctgccttggcctcccaaagtgttgggattactggtgtgagccactgtgcctggctgagtgctgccatcttgatggttttgatggggagccgccatcttgtgggcacggtgaggagttagatttaattttgaggtctatgggaagccatgagagaattttagataggatggtggtctgtctttctgtttgttggtggctaatgggtacaaagcagaagcagggaaggaccctgggctggagagtcctgagttagagaccaccaagtaggtctggctcaacagctctggtcagaccaacagtagctggtcagcctcaggtagagtgtgtggggtgctgagtgatggcctggggtagtttggggccgaggaacggcactcgtgttctatgagcaccgtccagaatgaggccacagcccagctcactggaaacgtgccctggagtgtgatggcctgggttgtgatgtgagcacttaacccaggctctgctcagagtccagaagcaggggctccaccccgtgagatgtggcaatggctttttgaaggaagaactgatggggcgtgggactggtccagcatgaaggatgaaaagacgctggagagatgagatagtaaagacaacgcctttcgtgcctgcgtgcttgctgtgtgccccccgtctcgtcccttcaacagaggcccccctgtgatgttatcagggcaagcgcttttcatccttaggattctttctccatgcaaaatcttatttggaaactcagtgtggaaaacaggcaaaactcgggctgctttggctgaagaaggtgttgttgaggtgggggctggagtgtacccccttctccccctcaccccgcagagccctgtcctcttctttttgccccccacccccacttcaccctcagcatgaccaaaggacccctgtggtccccagggacacagtttctcaagagaggcctgggaccaacatgtacagcattatttttgctcccactgaatttgctgtacaaacaactggcaattggggtatgttggctgaaataatttcatcacttaatcctcaattttacgtgtgactggttgattgcacacagatcctgtgacccctgagtctgtttcctagtgattgcccgggcttatcactatattgtttgctttctgctcttccccggggtttgctttccaggggcagttgtgtgacctgcctgcctcttggtgacctccttttcactctggtgaacactccttcatctccccgttttcattgatttctcgggtattttccattctgtaatactttggctgctgtttcttccttgtttttataaaattcatctgctggttgctgtttacaaaacatctcctttaaaccatcaggcacgaaggcaggattgctgccccactgggaagccggccccacaatcaggttccacgtaaggacgttttccagaaaatgacacgtggctcctttaagtgcaacacttttaatttcatgagaatcgtatttttacaggtccaatattatagacttgtttggccagggaaaaacattgccagttcatttttaaaatttttaaatgtttctcccatcatctatttatttgtttatttttggagacagagtctcgctgtgttgtccaggctggagtgcagtggcacgatctcagctcactgcaacctccgcctcctggattctagcgattctcctgcctcagcctcccgagtagctgggactacaggcacatgccaccatgcctggctaattttttgtatttttagtagagacggggatttgccatgttgcccaggctgatcagaaactcctgagctcaggaaaatatgcctgcctcggcctcccaaggtgctgggattacaggcatgagccactatgttcgtcctatttatttattttttatttcaatagctgttggggtacaagtggtttttggttacatggatgaattctgttgtggtgaattctgagattttagtgcatcatctgaatcatttttgaataacaatctttctgaaatgcatttttgtacttacctgcctttttaaacagagctcaaacatcatctaggcctttcttattgtctcaggtcattcatatgaacattagttagtgcatcctattgaatgccgtgtagggaattatgtacgtttctgtgttctggccctaagtggccccacatggccaagtcttaagacttagcattgtgtgttaaaagcctcacttttcttatccataaagtggggattattataccgaccttgtaggataccttataggatttttgcaaggcttagggtccatgtaagatccttggcccatggtaggcactcaaaaaaaaaaaaaaaaaaaaaaaaaaagaaaagaaaaaagaaaaaaatagcttagagaaaagaatggaaaacagcagtagattcttagaagctagatattttccatcatgaattcttttcctgggtttgaccatttatattttttgagccccaggtaacgggaagcttgcccccgcctagaatttgtctttaaggagttgaagggagccaaacatgagagaggcagacagtagagtggtttaagagcccacaatctggagttagactacctgggttcaaatccagactcggccacttcctggctgtggctctgagcaagttctttaatgtctgtgcatttcagagtcctcctttcaacaatggagataatgatagtacctgtctcagagggctgttaggagcattaaataatttcatacacgtaaagtgcatagaatagcacctggtacacagtaagccctctatattatcattcatggtgatgcctacctgctacgtggccggcacatgctgaatcctgggtttaatatgacggtgactgaggtgtggttcctgcccacaaataaccctggggaaaatgcagcaggtacagatggaggaacttacgcaaatcctcaaaaatctgaacctagaattgcagtgtgacccagcaatgcctctcctaggtatttacactgaaaacaggtatttagaactgaaaacaggtattcagacaactacttgtatatgaatgctcatggcaacattattcacaatagccaaaaggtggaaacaacccacatgtccgtgaacaaatgaatggataaacaaaatatggtctatccaccctacgtaatatcactcagccagaaaagggaatgaagtacaacttatatatgctacagtgtgaaggaaccacagaaacagtatgccaagtgaaagaagccagacacaaaagggcacatatgatatggttacatttatgtgaaatgtccagaagaggcaaagcagattagtgattgccaggggcgggaggaaggggaaatggggagtgactgcctagtaagttatggaatctcctttagggaagatgaaaacattttgaaactagacagaggtgatggttgtacagctttgggaatgtactaaatgccaccggattgtctattttaaatgactcattttatgttttgtgaatttcacctcaattacaaaaaaaaaaaaaaagacccttgcagatgggaagactcaagagggcaagtctaaaccaccagggccacgtatggctaagtgagcatgtttcggagcactggggcccagggaggggagggtcacagtggcaaaaatggcacctgtcggaagaaactgcacttactgcatacggggtgtatgtatgcaaatgggagtgtacatatctatgcaaaatactagccattatcattagagtaggatacataatgataagcgtacagttggccctcgaacaacacaggcttgaacgttgaggatccatttatacatggattttcttcctcctctgctaccccagagtcagcaagacccacccctcctctcctcctcagcctactccgtgtgaagatgacaaggatgaagacctttatgatgatccacttccacttaatgaacagtaaatatattttctcttccttatggttttcttcataacagtttcttttttctaacatgttttattgtaagaatacagtatctaatacataaaacatatacaatatgtattattaactgtttatgttatccataaggcttccagtcaacagtaggctactatcagttcagtttttgaggagttaaaagttatacgcgggttttttactgtgtggggcattggtgtccctaactcctgtgttgttcagaggtcaactgtgaattttataacagaagataaccagcagttgaggacggccatggtaactgtcaaatgaatggttttaacattgggcttcaggaggtgtgtagcaaacagcacggggactcataatatctgttttgccattagccagctagctctcaagtgggataaaaaggagtaggcagcccgggtgcagtggctcatgcctgtaatcccagcactttgggaggccaaggcaggcagatcacgaggttaagagatcgagaccatcctggccaacatggtgaaacgccatctctactaaaaatacaaaaattaactgggcatggtggcgcgtgcctgtagtccaagctactcgggaggctgaggcaggagaatcacttgaacctgggaggcggaggttgcagtgagccgagattgtaccattgcattccagcctggtgacagagcaagactctgtctcaaaaaaaaaaaaaaaaaaaaagtaggcaacaaaggtttaggatgaaggtataatttaaaaagcatgaagttgaaaaaattactcaaccacagtgaccttggttgaatcaccttaggttgtttgctttgcacaggggaaagatcatcatgttcttttgtagtgatagagcattctgatccaaccaacagagccccatggtttctagggaggtggagaaggcctggtggaggaggaaggggagggctcagttcctttctagaacttgagtgtcagttgaaaatagagtgaggaaggtggcagttgaaaatagagtgaggaaggtggctgattctaggcaggtgagtggaatgagtgacagtggcccaaagggtaagggggggtctggcctttctagagaacatgtgtcaatgagacagttggctggaaccttggctcccagtaggagcataggaggagatggagcagagaccgggtatgggcaaggtggtggccaggctaaggaaggtggggtttatctagacaagtggttgtcacattttggcctgcttcagagtcacagattgctgggcccttcctcaaagataggtttggagtggggccctaggatttgatatctaacaagtgcccaggtggtgttgatattgctagtctgtccacatttggagaaccactggtaagcgatgggcatccaggagcagtttttttgttgttgttgttgtttttgttttattttgttttgttttgtttttttgagacggattctcgctctgtcgcccagaccagagtccagtggcgtggtcttggctcactgaaacctccacctcccgggttcaagcaattctcctgcctcagcctcccaagtggctgggattacaggtgcctgccaccacgctgagctaattttttgtatttttagtaaagacggtgtttcaccatgttggccaggctggtcttgaactcctgacctcgtgatgcgcctgcctcggtctcccaaagtgctgggattacaggtgtgagccaccacagccagccaggagcagtttttagcaggggacaagcctgatgaaatggcgtaaacgatggccactggatatggctgtgagagcaatcactcattaaatcaggtggttttgttcctgaatcaatcttgcatctcagtagatttttagtccccgaggctcagactgccaacaaaaaatctttcagggcattgtaatattttgatgaccacagacttccttggaatgaagttgtcccaattccgaatgaggggccacggcctcataaaaggtttttattcccctttctgggctggagaagccatctaggaaaatgctgtttctgtacctaaagtgttgggattttcagattgttttcatgagttacagacacacggagcagcatgcttgaacttagaccctttctgcaaatgtcaggctgtatgataattgagccagaatgttactcgagctttctgacacattttttgagacctcccatccagtattctcatacagaaatatggctcctccaggtgtgcacttaacactcgcttctttgcagccaggggaacctttagctaaggaaaaaaaagccctcctacccttggtttcaaaaggttttgaaatgctaattcacaaccatgaagtattctgacagcctggaatgttattcagggcaatcaggcaccttgattattacagaagtgtgaaaggtaaattgctgctacccaagaagtcacccagcttttcaagagaaagctcagaaaaatagcacataaaattatgttcggggattacacttcatgtatcgtgtgatggggtgctctgacacccagcgtgtctgtaggtgtcacaacgtcagctcgtagtagaaatgtaacagcatttgccagcgtcgcccttaagtaaaaaaaaataataataatacaggattgtgggaaacattttcagaatgtgttgtatgcctatctaaaatctgaaagtacatcttttttgagcttctgcttttcctattttccactgagaaatcctgtcccagagatgagactatcttttctttttcttttttccaaagggaaagactattttttatttatcctatagtcttttataggtattatcattaatgactttttttttttttgacggagttttgctcttgttgcctaggctggagtgcagtggcacaatcttggctcactgcaacctccacctcccgggttcaagtgattatcctgcctcagcctcctgagtagctgggattacaggtactggccaccatgctcagctaattttttgtatttttagtagagacagggtttcatcatgttggccaggctggtctcgaactcctggcctcagggaatccacccacctcggcctcccaaagtgcagggattacaggcgtgagccaccgctcccagcccattaatgacttttaaagctttgttgtattttgccacaataagcacaaaatggtgtttctccatggtccaaactcaaagtcaggattcagtccataatccaaaagttccacattgagctatgaaagaggtaagtgcaggtggttagcagagcaaagtttttttttttttggtgacagagtcttgctgtctcccaggccggagtgcagtggcgcaatctcagctcactgcaagctctgcctcccgggttcatgccattctcctgcctcagcctcccgagtagctgggactgcaggtgcccgccaccacgcctggctaatttttttgtatttttagtagagacggggtttcaccgtgttagccaggatggtctcgatctcctgacctcgtgatccgcccgcctcggcctcccaaaatgctaggattacaggcgtgagccccaaagatttttttttttagccaaggcagatgcattccttgaggaaggagctgttgtcactaccaactgctcatgagaatgagggaaacccatctcattcgcttttccttactgggttttccagtgtgatttatttattttttcaattactaagtaagaaatacaagcatcctaactgtaatggtcccttttttttactatagcttcttcaaggtctggtgggtagttgtagtttattgctctccttggaggaacaggaaaggggttatattgtttgtaggtaagtggaaaccaaacattccatggggaggaaagtgagtagttgtttagggtcgtttgtatgtaaatccttgcatccattcattcatcggtccatgctctatccatgcttccatccatccacccacttcctggccagccttctcctctaactgacttccacatccaggagctcgccccagggttctcccttccctgtacacattctctctgtaaatgaccgctgccattttcatggctttccataaagtgatgccaagcctctctgttttacctctctggccctgacttctcttttgagcttcagaccccacagctccccatttctcacttctgcgtcgatgcctcatgggcacctcaagctgctcaggccagatacctaggagggttgttccaaatccctctttttctttcactcccccatccccaatcagttcctccctgagtctgatgagtaccatcccctactcggtgtatttcatgtcatcctgcacactgtcatcattcacacatcgttcatagtgtatttcatgacatcattcacatcattcacactgccgagtcaccatccccctggatggctctggtagttccttccttggtttcctgcttccactagctcctcagtttgatccatttccacacaacagcagtgtgatctctttttttttgagacagggtcttgctttgttactcaggcaggagtgctgatcacagctcactgcagccttgacctcgcaggctcaagcaatcctcccacctcagctgcccaagtagctggcactacaggtgtgcaccaccatgccccattcattttatttttattaattaatttatttattgagatggcgcctctctctgtcgcccaggctggagtgcagtggtgcaatctcggctcactgcaacctccacttcccgggttcaaacaattctcctgcctcagcctcctgagtatttgggattacaggtgtgcaccaccacaaccggctaatttttgtatttttagtagagacagtgttttactatgttgaccaggctggtctcgaactcctgacctcaggtgatctgcctgcctccacctcctgaagtgctgggattacaggtgtgagccactgtgcccagccttatgtgatcttgttaaaaagcaatacccttgctataaacccagagtggctccgtcggacggtggcacagattccttccctgccagtctgaccccagcctgcctctcctggtttcctgcccacactgtggccacattgcccacctgttcttcccactcttctgtctgctcttggctggttctttctcatccctcaggtttgggctcaaattgccttgctgagacaggcttttcctgacacccggtctgaagcactgaccccacacacccatatggccacagtctcttgctttcacaatctgaaatgatctcgtacttgtccactcactgaatgcctgtctcctgacattgaactgtgaacgccaccagggcaagcaccaagtctgctttgcgatgccgtgccccagcctccagaccaggcctgggtatagcccgtgagctcagtaaaacggcagtggatgaaggaaggcatgaatgaccccaagcaggatcctgtgctgggctctgtggcctctcagattgtggactatgctcaagtgttagggaagtatgtagaaacttaatcactttaccatctactgatccaagaaaagaaggaaagcttaatttaaataaattattatcattaacagagttgaccataaaatgaacaaaaccctcatttatcattttgctaatcctggcttccccactagaatatctacctttagccagagattaaatccattcatatgtgtccggagaaaatataaaacatatatacaataaatatgtgtagaggaaagcagtaggatggacactgcaatgtaattgtattaataagacattaaaaatatagttaaatgcaattatgtatattattgtccggtcaagaagatcactagttgtattaaagatgtcataagcctgggcatgatggtgtgcacctgtaatcccagctactcaggaagctgaggcaggaggatcacttgagctgaggagtttgagtccagcctgagcaacatagcaggacttcgtctccaaaaaataaaaataaaaaagatatcataaagacatcataagcttccattggttacttttagtatggatcaagtagaaaattcaatagcagagccgggcgtggtggctcacacctgtaatcccagcactttgggaggctgaggtgggcggatcacaaggtcaggagtctgagaccagcctggccaatatggtgaaaccctgtctctactaaaaatacaaaaaattagccaggtgtggtggtgggtacctgtaatcccagctactcaggaggctgaggcaggagaatcgcttgaatcttgggggcagaggttgcagtgagctgagattgtgccactgcactccagcctgggcgacagagtgagtctccgtctcaaagaaaaaaaaattcaatagcagatatacagaatggtagaacttaaccatggatcatgttagtaagcaatattacaaatggcacgttgtggccagttgcagtggttcacgcctttaatcccagcactttgggaggccaaggcaggcagatcacctgaggtcaggagttccagaccagcctggccaaaatggtgaaaccccgtctcaactaaaaataacaaaaattaactgggcatgttggcacatgcctgcaatcccagctacttgggaggctgaggcaggaggatcacttgaacccaggaggtggaggttgcagtgagccgagactgcaccattgcactccagcctgggcgacagagtgactccatctcaaaaaaaaaaaaaaaaaggcacattgagccggagtcggcactttgggaggccgaggtgggcggatcacatgaggctgggccaacatggcaagaccccgtctctgtaaaaaatacaaaaattagccaggcatggtggtgcacacctgtagtctcagctacctgggaggctgaggcatgagaattgcttgaacccaggaggcggaggttgcagtgagccaagattgtgccactgtactccagcctgggcgacagagcaagaccctgtctcaaaaaaaaaaaaaaaatggcatgttgttagggatgtggacatgataatgtctcctaaggctattaaatacagcttcaagtgtggaagttgagtatgaagcaggggtatgtgttctgggtgagccatagaagataataaatgttttggatctctgtttctttgagcctcctgttacaataagataacagttttcactgtattaaatacatttgtcagtggaataaggtccatttgacttaaatgcacccgggatacattaatttacacagccattcacacagccaccagagctgccttcctttatgactccattctccactcctgtctcttacagaattaagtccaaactcctttacgtggaatttgaggcccttcttggtctgtcccaacccactcatcttcctcacttcttcagtcgcctcccatgccccatcgtgtttatgctgtgcaagcatcttcaggcctggatcgggagttagttcttccaggcatctctgcccatctagcccctcaacaggtgactcagggtgagggctctgggcttgggggatgggagctaggtccatccctcggcagccaggaggccctgggctcaggtgctagaagcctctggtgcaaactcacacattagcctctgcctccatagagttcagattgtattgaagatatcataaaccgggcatgctggtgtgcgcctgtaaacccagccgaggtgggaggattgcttgagctgaggagtttgagtccagcctgagcaacatagagcagtctccaagcacggtgccttagggcctcccagaatgtctaactcagggcagacaatcaataaatgttcattggatgaatgaataaactaccaggctagaagggattgatgagtttagggaaacgtctgtttggtgtgactggaatcagattatgttcttttttttctgagacagagtcttgctttgtcacccaggttggagtacagtggtgcgatcacagctcactgcagccttgacctcccaggcttaagtgatcctccctcctcagcctcctgaggagctagaaccaaaggcatgtgcaccacagctggctaatttttaaaacaaatttttgtagagacgaggtcctactatgttgcccagactggtctcgaactcctaggctcaagggatcctcctgcattggccccccaaagcgctgggattacaggtgtgagctgctgcacctggccagattatgtgtgtgtgtgtatgtgtgaatttttttttttttttgagatggagtttctctcgttgcccaggctggagtgcaatggtgcgatctcggctcaccacaacctctgccctctgggttcaagcgattctcttacctcagcctcccgagtagctgggattacaggcatgtgccaccacacccagctaattttgtatttttagtagagacgaggtttctccatgttggtcaggctggtctcgaactcctgaccttagatgatccgcctacctcggcctcccaaagtgctgggattacaggcataagccaccgcgcctggcccgattttttaaaaaataggccttttcttaagttagacccttgggagggaacagtgtgtcatcctcgaatttccaaaaggggctctaagatgcaggaaagagagtggctggtggctggtgtccacaccatatggcggcagtacagactgacccacggctctcttcccagctggtgccttgcactcagcatgcatccacccctccatgagtacaggaatcagctcatctgctcttcaaagtatggagctgaattttcctatccttgcaaatagcctcttgcctcctagcctggcttcctccaccgttcatcaagacttcagtaccaggagcactgtattgatgaatttcacaatcccgtggggataaaagctgctaaaacacttttcccaactgctaaattggaaccttttagacaccgagatctcacttcccctcctaggaattttcctattaaaacattttaaaggtctattcaactagtttatagctatgggaattaaaaaaaaaagaatggaaattaagttctagggacatgtctttttggtcttctttaagaatcagtctaatttccacttcattggctttttgttatttcaaagcagaagaatgaacattttctcatttcgtatttcgtaatgaggaaaccttagcagaacctgtatataaactattttggtttgactatggattaatcactttcactgcgttaaaaacaaaataatgaagccaaggaggttatttccttttcaagaggaggttgaattttctgagcagctttctccctcaaacttctcagagtcttcaccttggaggcctcgccctgcctgcttcttgggactctgcttcttgtcaccaactgggatttggggacagaaggaccagtaggtgggagcacctcaaagtaaggagtgtgaagtgcctgaggacaaggtggcaggggcttccagttcctccttaggataaggctagtgaggttgaccccgcattaacaacacatttaaaggtttcatctcctatttgtgatcttgatgtattctacctttgcccacttggtgagggtaccaagaccccgtgtcacagcacaggccaaatgaaccacctgtggctcatcctcctgggaagagtttggtgggtaacccagataccagtgggtagccttcgggagaaaagggtgagctagtctggtaatgttccccagcacgtggctggggatggtcctggctggagcacatacccgccttcttcttcgtaggttgtgtagactagtggactaagaggttggaccctgtaccacactgagtgggttcaaactctagttctaccacatatcaactctgtgaccttgggcaaatgtcttaggtgcactgtgactcagtttctctttctgtctattattattgccctcttcgtgtgattgttgttaaatgagttaattcaggggcttagaacagtgtttggttcaaagcaagtgctcagtaaatgtcagccatgagccttccgggtggatctcacttcagccactggttaggacaactcagaaaatgtcatgcgtgcttctttctcccgagaaaggaaattgttttactcttgtccaaactgtcttcactatttagaggtcatagaggaacaagaagtgactgagagcagtcatggctctttgagcctaaacccccgagactttggaaaagtgaagtgtgatgaaaagatggaattaggaccttagtctcctgccctacttgtcgggtgctgttgccactcatctaagctgccactggtttggagctcacatttttattttttttgagacaaagtctcattcttgtctgccaggctggagtgcaatgttgcgatctctgctcactgcaacctccgcctcccgggttcaaatgattctcctgcctcagcctcctgagtagctgggattacaggcacctgccaccatgccaggctaatttttgtatttttagtagagatggggtttcaccatgttggccaggctggtctcgaattcctgacctcaggtgatctgcccgcctccgcctcccaaagtgctgggattacaggcatgagccaccgcacccggtcctggagctcacttttaagctacatgtgctttgtggagcaaagtcatcatttggtaggggctggacccatagttcggtcttcccaagacttttggggactgtttcagaccattcccatgctgcgtgtccgccacgttgcttccacagagcctctctgtggtccatggctcttcccattgcccgcagacctcacttcctccaacttcttggaactttccagattgagagaataaccacaaaccactgaggccggagcactgaagagtccagctctttttcacctctgtcagcggtcatgagggagcctgctctctgtggggacagatctatttttggtgtaacacggatcgtgtgaacactgataacctcagacagagtgattttcttccatgtttctcaagcatttaaagggaagcctctggaaccaccgtgttaagctcctgacacggtccacagcttgctctaagcctgttttgatcacttttctaatacaatgatatcgtttcacattctcagtaattagactctgtaatccctccattctactctgtgtgacctttatcttaaatgacatttttaaaatatgaagtttaaaaattaaaaaaaaaaaccataaaacaatgtttgcaaaaaatgtactaaaatgaattatagtttctaagccctaggctgtcatgcctggtggaagccaaaggacttggctcagacccacccctggggccagtcctacagctgcaggtaagttatgcccacctgcctgcccatgggcgggagaccctgcccgcatgccctttcgccagcagcatcaaatggaggctgggggtgatgagcttgtcaagtggtggccgatgacacttgtattgttttccctacaccttggaaagtgactcaaatggcaaacatatgtctccaaagtcatgcccagggtttctttccctccagaattcctaaagacactctgagtcccagcttgcagtatgaatggaggctggggtctgaccaggtgatgggggtgtgagaagttgccttatatggtggcccctacatttcacagcccctggcagatgctgcagtttccacatccctggggaggggtgagagatgctgtagatgcctttgtgggatctgagcacacacgcagccccgagagtcgggagggaagccggggctgggagtaggatctctgccctttgcacagctgaggtctggcaagatgcttctcgggcaggaaccccaaggggagcactttctccacgtgatccatcatttcctgggggtcttcatgagtccttagccccagctttccagcttcacaccagccccctcccgggtggccctggagcctgggttatttgctgtttttttttttttttttcaagcgggcaccacacccgtggactgtctgccaagaaggaccattgttcgtgagaattcctccctggctccagctaacccttagatgcactattctgattttgtgggcttgaattcttattttcttaagcctcacttctacccctaccccccaacttattcttgccttctctcaacccggccttctcatcaaacctcattttgttgcccaaaaagctttgagaggtgggcggggatgtggaggtgaagcccttcaggaaaattgaaggtggctgtttgacctggtctccggagtagctttgcgtgcccgcctcggagaggaggcagggaggccccctgcattctgggagaggaggctgtcgggtaacctaagttggggaatgcagcggtgatgggaagtgagtgggaggcaggggtgggaataagcgggaggagaagataggctaaagaatgaaaagcaatatctctccccccagaattgagttgattaacctgtagaaagggaggccctgccaagcccaacttccttgtttccagaaaccttggcacggaggccccgtttctggcagaggcctctcctagtcggggaaccagcaaagcagctgctgtgattttctttttcctctcatttctggcaatccggaatgggactgtttacttttttcttcctctttccttccccaccctcctgtagcagggagttggttctggttaatgttgaagatcataacatgattaccccaaagtctcctgaaattaaatcacttttcttcaaagagaaaggggtggggggaccgtctggctggtaggccagcgaggacgagcggatattgaaagcagcctggcagctgtgattcactttgcacagcggaggcccggcaaggcccaagcagccatgcacaggggccgcatttgcaaacagtggctgggaggagtcgcgtatcccacctgggccccagacacctgtctcctgagcgccgagacttgggggtggaaggtgggaatcaaagccgcgggtgaaggtgggtgcaaggtgattcagagagttgaacctgaacatgagtcatctgggaagaaactgaacttatcaaacaagtccccacgagagttctccatcacctcccaccctgggagttcattgagtcagggcacaaatttcagggcaactttgccaccagaatagcctgggatggaaatccgtcttcaaagcctaacttcagtggtagctggagggatgtttgtttgtgtctttccttgtgctgggtcttcctgaactcatttgattttagaggttgagaggaccatagagatcctccagcatctgccctcccgccgagtgcaggagtctcctgtatacttgaccccagcaaataatgctcagcctctgcttccttccctccagggcaaacatttgccctcttacaaggtcagtttttgaagagagaatatgggaattgcacctgttgatccaggttgtgcgttccagagacttggagatccatggtcccacttggtgggtgcctggctcggaaaatgacacaaagtgaatgtggtattctcttcgtcatgggcagcctgttggggattcttggccctctttcgcgcagtgagttcagcactccctctttgtggctgttttcctgggctgtttcctaccgtttttcattcaagggaatcagaggagtgggaaaccatgtggaagcaggatctggaagatgctcgattcttgttgctggtgtcccggtaccttgagctctttgtttggggccagtgaccagcctgggaggcccaggaatcagtggctatgttgagtgaagactttaggggattggtcttttggcgccaagagggcaccagttaggcagcagagggaccatttgagagaaggcagtggtgccggctctcgcgaaccagtgcgggagggaagcctgacaggggcgaggtggcttcctgcaagacggcgtgtaagctcagcaactgcatttttctgaggaattagggatgggacgcggccagcccgctctggttggagcttggtgctgtgactcattctcatcaagggtcactgagcgtctctctgcgcgtggccttgggctgaactcctcacctggccagccttctcgaaaatgtgtgtcattccttgtgaggcagagccatggagcgggtgagtgagtgtgcaaatcagtggaaattcatctgcaccactggaaaaacaactccaagttcatgacttgttggcttcagaggcgtgactgtgaagaatggagctgacatttttgtttttcactcaacacgcccaagtagacagatccagatgactctcctgtccactttaggagccacctggggaggtgaaacacttcttccactggcctggagggcccttttaccagccccgtggggaagtcagtcttgttactttacggcctcagtttttatccaaagacaacatcacctaggcatgatcactgagcctgttcaccagatttgacacccaagggttgaggctggatgcaaaagtcctatgcaggtccaggggctgaggagctgccactatctgggaaattcaggagtccccaagggcaattctcaaaggcaagtctcaggaatgtgttgggcccattggaatactgttggaataagtgagccgtcctcactctgcgtttcccaacacacacgggtcttacccaacgggatgtgtgcatgtgagtgtggatgtggaatatgctagcttgttagaaagtcagcctcaacatgttgtggtcgggcctagttggtttgtttaccaagtctctttgagaggcacagtgagtaacagcagggtctctggagccaggctaccagagttcaaatcccaggcccaccacttagagatgggatagtcttggtcaaatgacctcctctcccggttcttccatctataaaatggggttcagctgggcacggtggctcacgcctgtaatcccagcactttgggaggccgaggcgggtggaatacttgagcccaggagttcgagactagcctggccaacatggtgaaaccctgtctctagtaaaaatacaaaaaattagctgggcatggcggtgggcacctgtaatcccagctactcaggaggctgaggcaggagaatcgcttgaacctggaaggtggaggttgtagtgagccaagatcacgccactgcactccagctgggtgacagagggagactccatctcaaacaaaaacaaaaacaaaacaaacaaacaaaaaataaataaaaaaaacttaaataaaacggggctctatgagagtcccatctggttggtattaggatgagttggccttggtgtgtcacaggaatgaaaggggacggcctgtcagcctctccaagctcatcgtcattgcccctcctagcttctttgggagggggaagctttgagaccctcagggacttcagtcctatggcctcagactagggatgtgtgtgtggctctgcagcccccggaggtgtggccttgtgccagtcccagcgctgcagggaagaggcaggacagaagtgaggggaagacatgtttccccaggggggaaaataccccgcctggaatgggtcagtggttggcaaactttcatttagctgacagaatcctccatggaatctaatgagatagagcagaagaaagcagagttgcctgggttgacgttagggaggccccatgggctggcccacccctcaaccccaggttcacccttgaggtgaggccactgaatcctggggctccttgaggtcatttttaaaaactgctggtcagagagaggaggtgattccccatggtccctcagctgactgtgctcatgagagctgatttgagaacctgacccctgtggaagacgcacaaccctactgtgtgccctttaagcctcatgacagccactacctttgttaacatgagggaggcccaatgtccaagtgcagtggaatccacccaggtggggagggtctgcagagtcctccatcctccatccacaccagcctgcacactgaccacagctgggaatttcttaaaggcagagggatgggaatgcctggacatgtcccctttaggttctctatttgttttattttatttctatttttaagtttttttgttagagacggtctcaccctgtcatccaggctggagtgcagtggtgcaatcatagctcactacagctgtgagctcctggggtcaagcaatcctcccacctcagcatcccgagtagctgggaccacaggcacacaccagcatgctcagtgaatttttcaaatttttttgtggagataggggtctctctatgttgctcaggctggacttgaactcctgggctcaagtgatcttctcacctcagtctcccaaagtgctgggattataggcatgagccattgcgcccggcctaggttccctactttagattagctcacagtttctcagccttcagcatgtctaacaattagaattcaacatgaatacataaaaccacacactttgcataattattgatttaagtgactttccagggtattttgacagtcagttatttttaactcctgtgtgactttatcaaccacatgcctccacccaggatggggtgtccctgaggactcagcccctgcctcctggctccacactgtcagaggtgtcttcttgctagacgggttcccctgcagttattctaggaagcccagtgtagacccagctgctgcctggccctctccttcctggaaatgtttcccaccccgttctgtagcaggtaatcatcagacaggtgggtgagcagaagattggctgtggtctcatgtcttctgtttggggcatcttggaattaacaaagcaggagacagaggaaagaactgataacagttggaggtacaatgtctctaaaacatggatgtccagccccaattctccagttgggaatggaaaggttcaaaagaaaaaaaaaggaagaaaggaacaaaaagaaatggaagtagtgatgtagattttggccaggaagaggaacagggtttggggctacatgttgtttgaggaacggccccaggagaacagaagttcagataaatcagaggtgagagggaaggcatccagaggcaacaggatattggaggtggggcagtggctgagaatcaaaagccttggctaccaatccaggccatataccatcagctcattttagcactctgaaccattcatgtcgcttttctgagcctcagtatcctcacctataaaatggagataatagtccccaattcccttacaaggtagttgtgaagaccaaatcagctaaggcaaagaggacatgctttaagtgctatatgaataataataacaacaaataaagtacacttctgttagaaacaaagtgggaaaagttgataaagatgaactttactgctaataaaatatccaggaaaattggaaaggtgatggagaggtcattggaagaaacttcagacaaaagaaatgtataaaccacccatttctctagtcttaaacgggtctccacaacttcagccatgcaggagagttaagaatccctctaagcggatgaggcaggaccggtgttcaatgaatgtctgttggtcatcagtatttgtggaggcttatgggggtcctgggctctgtgtggggattgtggaggtcatcccaaggaagatgtttgccttaacaggtttaattatcattactccactcctgtgttcccattcccagatggtggttaagcactccttgtcaccactcagtattgtttgttaatttgcctgcccatccatctatccatccatccatccatccatccatccatccatccatccacccagtgaactaagatttactgagccttgttctgcatcaggcagtgtgcttggtgatgggagagtggtgagcagaagaatggcgatcccttgctttcatgaggctctcacagtccagtctagagttagacaggtaagtatcataagctgtgattaagcaatggggaggcacaggttgctatccaataccaggcagcagttccctgggtgggggcagtgggatcgttaggaacaacttctggaaggaaggacagggaggagttagccagatgaaagggggccagagagaaaatggacatggcacaaaggctggtacatctgggagcaggtgagggatggagcgtgagcatcctgtcccccggaatctctggctcccgactgcattttaaagatgagtacctgagagtctgcatgaattctggcagaaatagcttcagccttaccacatttcagggtagcttctgttcttagatcttctttatggctgaggttttatgttccagaacatgacttgctcagtgtcttttctagaaggagtcaaccagggtacctgggcctaacctctgggcaacctgcaatggcaaataagatagaaaagtgagactctgtgggcttctgggatagagaaaccatccctggaatgtccccaaggaaaacttgatctctggagtcacccctctgaacttctcaaacaagtattagtgagtcaggcagacaaaaagtcttcctggagctgatattctggagaaatgatgcggtttgctccaggagacagagttcagccccctttctacgcttctcttttactttgaacccattctttgaagaacatagaagctgatttaggaactctggagtgcatacatctggaaagaaatagaacatccagggatgcccccatggcttctacaatcctaatggctcctcagcctctccctctactccacatccagccttgggttctgggggagaagacccatgggcaggaagagggcctgagatggcaaagaagcagaagcttgatagtacagggccccagatcttttgtgcagcccagagctgaggttgtgatggaaggaccccttctgtagaccccctgttgctgtgccaagggagtagaaccctgctccagggtggtggggtcaccattcttgcggggtaggagatacccagggggtgagctgcagcaacttgtgcataatctcttgtgcattctggaaggtttttcaatgtctgaaacacttcctcctcagctttggacttttttctagtccccttaaaaatgtgtctgtacaatgggataggctggggagcttatcttctcctccccatctgtattgatggctttgattgtgagcagtgtctcttttttccttaacactattctttcctctagcaccccttctagctggtccccacccctgaggaagtgtttccccagcggacctattttctggcccttgaggaagtggttccccagaggaagtggtagcccagtgggtctagttcctggcctcccaggaagtggttccccagcaggcctgtttcctggccttggaggaagtggttccccagtggacctgtttcctggttccccctgggaagtggttcctcagcgggcctgtttcctggccctggaggaagtggttccccagtggacctgtttcctggttccccctggtaagtggttcctcagcaggcctgtttcctggccctggaggaagtggttccccaatgggcctgtttcctggcccccaaggaggtggttccccctgggaagtggttcctcagcaggcttgtttactggcccctaaggaagtggttccccagtggcctgtttcctgaccaccaaggaagtggttccccagcaggcctgtttcctggcccccgaggaagtggttcccatgaggacgtgtttccccagcaggcctgtttcctggccctggaggaactggttcccctgaggaagtggttccccagtgggcctgtttcctggctccctgaggaagtgattctctagcaggcctgtttccaggctccttgcagtctccccagtgtcttcagcacatcgttgaaatttgtaactgaggtgaccaatgaccttcgtagctaaatgcagccccctgcgtgacctctgaagcactgcacacatggacctctctatcccctctggaattctctcctcattgctgctcaggcctcgtctgtctccctccttgactggtcctccttgctgccttccctggagccctctacacttcaggtctcaccgatcccattcactgttagagttaagaggtggatggttccagttatccatctctgttccagtctctctagaagcatccagtagtgttatctctaacttagaacatttgaaatctcattgtaatattgcgaaatgtatatttggtcttggtccctgtttcttggcatacaactcctaaaatccttggaatcttcaaagggatcagatgtcttttgtgtgctaaggattggttggtggctggcagcctccaggtagcttcaggatggaggatggttaccagaaagaccatggcagggtgagagggcttggactttccctctccctgccccacctccggtgaagcaagaggggttgaaggttgaaggttgggctgatcacccgtggccaatgatttaatcagtcatgcctgtgtaatgaagcctccataaaaactcagaaggacagcgtttggagagcttctgatagctgatcatgtggaggttcctagagggtgatggtcccagggagggcatggaagctcctcgcccttcccacatgtctcaccctatgtatctcttcacctgtattctctgtaatatcctttataattaaccggcaaatgtgtttccctgagccactctagcaaattaactgaacctgaggaggggctctagggaaccttgacttatagctggttggtcagaagcacaagtaaaacaacgtggggcttgtgattggcatcagaagtgctgggggcagtcttatgggactgagccctcaacagatgggatttgacactatatccagatacatagtgtcagaattaaattggaggacacccagctggtgtccgttgcacaattgtttgcttggttgttggagaaaaaaattccctcacacttcttggtgaccagaggtattgattgttgtggggtgagtgtgaggagaagctgttttttgtacagactcatcttaatgactgaaacgtacttcctctgtggttatctctgtgccaatgaagatcacccaggagcccatcttaatctttgacgtctcaaccagtcacctaatcttgttgattttccccatgtgatgttccatttgcacctgtttcattccatttatcaccaacacccaagctctgttcacatggagaccttcatacccacccagatagtctcctcacctctcgtcctccacccccaaacccacctgccccacccgtccacacatcctgccgtgaagtactacctttcatcacaacaggttaacgaggaagccgactgctgtcgcagagagagctctggcctcaggtgggcctttctcaatatcttcactcccgggaagaggagattgatgacagtcccttgcagatatgaatggcaggaggctgggggtcaggggtgggatagccatagaggaagcactttcatgccttaaggttgccttcaaccttaagttaatagttggctgcacattgaagaaagtcagataaatatttaaaaattcacttttaaccttacataaggcctggaagagcacttccatttgccaacttgctgcagggccaagacgttttctccgagtttgggtctgctgggtgggttctgtgttgtctcttgcacaaaccttgtctccagtctgcagttggtttcatgaaagtggtgtgattcctcagacaagcctgaagttatctgggttcaaaatcttgtttttttgtttgtttgtttttgagactgagtcttgctgtgtcccccaggctggagtacagtggtgtgatcttggctcactgcaacctctgcctcctgggttcaagagattctcctgtctcagcctcctgagtaactgggattagaggcacccaccaccacatccggctaattttttgtatttttaatagagacggggttttgccacgttggctaggctggtctcaaactcctgacctcaggtgatcctcccgcctcagcctcccaaagtgctgggattacaggcatgagcctccacgcctggccagcatcttgtatttttaaaaataattttgcctcaatcttttctggatatctcctctacacctcatttgacagctgcattttgtaaatgtagtgactggttttgttgagtctttgcagttgagttttcatagaaacaaccacacttttcacactgttttaaatgggctgagaacatacacaactggctggtgagggcagctgcgctcaggcatgaggcagagtgtggggccgtgagcagcgcacacacactgcctgctgcagacgccgggccgggggcttcacagagaggataggaggtctgcgttactctacgagtgcatagagtagagattggccatgagagtttctcgccttttttttttttttaattttggatgacagaatcagtttatgaaatgatcttgattggctaagatgatggaaccaaccaaatcagatgaaacatcgggaggataaatctgaagtcttccttaggtctaaagaatgaattgcaccattaccatgtcatagatacttatattatcagtgagactcaagggttttagctgaggggaggatttatttgagtcaaccatggatgtggttgccaaaggaagctaacgtaagcttcgatcatcatagctctctagtgtctagagacaggaggttgtaggggacactgaccatctcctcaatacccttcccacccctcattctccgtgttctgccattggccttggggggattgtccgtgggttttttttttcttcttcttctgagatcaagtcttgctctgttgcccaggctagagtgcagtggcttgagctcagctcactgcaagctccgcctcccaggtttaagtgattctcctgcctcagcctcctgagtagctgggattacaggcatgcgccaccacacctggctaatttttgaatttttagaggaagggtttcaccatgttggccaggctggtctcgaactcctgacctcaggtgattggcctgcctcagcctcccacagtgctggggttatgggcgtgagccactacacccagctgattgtctgtggttttgtaatccagtcaggatgattccatgctccttgccacgtgattgatcaatacacagcattttcctggctacaggaattggttcaggaatggtcatgtgacctggtttggtctaatgaagcatgaagggacattggctgaaggcttttgtaaataaggtacctagctcttctgtgggggattctggaaactagccttcttgctcaccttggatgctgtggtgtgtggatacgaagcctggaactgctgcatcccctttgctatcacagggaacacccaccaaaggatgatattgagaccacgaaggcatagaggacatagaaggacaggtagaagacactaagtcctggatcacatccctgaatgaacccggttctacctccggaccttcagttacacaaacccatgtaattcaagccattttgggtcgagttttctgttagttagcacagagatgagtcttcgcttccttggggagagacagatatgcttagaatattgcatttgcttctgggctctggcctttgagaggcacattgaggaggtgcagagtggctaatgagagccaccgggctggggaaggggattgaaaaagcgtctatcatgggggtgatgatccacttttgggtgtagatcatgttagcattcttttagatggaaagcttccgaaatatatttccaaaaggatacagtttgtagaaatgcagaattgttaacttttcagaagcacgtgtagttgcccaggctggagtgcagtggcttgatctaagctcactgcaagctccgcctcccgggtttaagtgattctcctgcctcagcctcctgagtagctgggattacaggcatgtgccaccacgcctgcatgagataagatattcctgtggctttcactaacatgctggggatagccagagaaaaattccatgaacgtgcaggatgatttaaataaaaagaggctgctttgtctagtcattgtgtgggagggaaacccaaaccccaaagtgtcctcattccagtgtagaaacagccactagagtgttgttttcacaggacgctgtcaccgggtggccctttgggaagtgtgggtgactcgttgcagagatttccatctggggggcaacaccgtaagccctggttccttttccctgctccactccagagcattggtggaaggagacctctggacattccacagccttcctgtgggcctcttcagctttggctttgttctttgcagttttttttttttttttttttttttgagatggagtctcactctgttgcccaggctggagtgcagtggcgtgatctcggctcactgcaacctccgcctcctgggttcaagtgattctcctgcctcaccctcccaaggagctgggactataggcacccgccaccatgcctggctatttttttgtatttttagtagagatggggtttcactgtgttagccaggatggtctcgatctcctgacctcgtgatctgcctgcctcggcctcccaaagtgctggattacaggcgtgagccaccgtgcctgaccccgttctttgcagtttctaacacttttttctgatacttgcagcaatgagagtagagccagcagcttcatgcacttgtaccaggatgctacagaaatgagcaaaagaagtgagctgtgtgacttgggcaaggacctcctggttagctgtaggctcatttacagagacctcagaacacactggctcaagcgaggtggatacctctttccctcacttcgtggctgggtggtggggatgcgtggggtaagtaggcagtgctgtcccatgattgtcatccagagcaggacccagccccctgtccagctgctctgccaccctctggggggctatcctcagcttcccgatggaagctggtcctccagcaccctgtcttcattccagcctgctggaagagggaaagaggaaggggagggagagcaatttcctttaaggaagtgaagtggaagttacgcgtgtcatttccactcatattccatcgcctcagacttcatcatgtggccacacctggctgcaaggtatcctgggaagtatggtctctcgctgggtgaccatgcgtcccttaactaaaaggaagtggaggatggatattggcaacagttagcttctctgctactgtgcctcagttcttgcatctacagatcaacgtccacaggatcaccaaccatcccgggagctctagcctcagtgacttcgtctgtgaagtggaaataacaaaaataccaacctcagtgacacacaagagaggactttgcatggggcccacacacagttgggtactcaaatgacagctgctcttatggccgttttcattcagccaatcagcgaataggttttgagcacctgctatgtgccaggagcattcaaggcgctggggattcagcagagatcaaaccagaccaaagctccagttctcggagctcagcttctcgtggggtgacagaggggcgcacgtggggagaactgtctcctctcctcttgcctggctctcactgctactacacatgggatttccaagtcagggctctttgcaggaattgcccagatggtctcttgcaggaagccagagagcctaagtgagattcgtttctgccccaattgataatttatgaaagcaacttcataaacaccaggtagtgtcccatttgttactcatttaagattattatttcctccattctttttatgaggggttttcttgttgattgtagcaagtggaagtaggtgtagggagataagttgttatggtgtcttcaaaaataaaaactaacaaataagccgagtgcagtggtccttgcctgttgtcccagctgctggggagcctgaggcaggaggattacttgagcccaggagttcgagtccagcagtttgggtaacatagtgagaccctcatctctaaaaataaaaataaaacaaacaaacattgagatcattcggtgggtatttctgaagcctctgtctcatgctagtttgaatgctaaatgattgaaatacagtggagagaaccatagggttcctgacctcaaggcactcactctagaggggaatgtacaccagcaattacaatacagggctgtgagaggttagaacgggtgctatggaagcaggaggaagaggtaccagagccacttgcggggcaggatcagggaacgcttcctggaggaaatgaaattatcaccaaacagatcatcactgtgaccacctaccttcatgatcaccatcatcaccattgatgtcatcatcatcatgctcactgtcatcaatatcactatctcctttaccatcattgccatcatcatgctgtcatcatgactgtcctgtcatcttcactgtcctcattaccatcaccacctgcaccatcaccatcatcaccatcatcgttgctgtcatcatcaccattattgtcaccatcatcatcacttcccacctccttctcaatatcaccatcagcttcaccatcaccatcagcatcagcaccgttgtcatcagtaccaccactagcatcatggcagctagcatgcttgaccaccttctgtgtgcctggcaccatgcaaagctctttgcacacattgtctcatttaatttccaccgtgaccctatgaagccaagttgttattctcactttagaggtgaagaaaatgaggatcctaaaggttacacagtttgaccaaggtcacagagtgagtttctcagtgttagactcaggattcaagttcaggctacctgttgtggaaccttagtttgccaaccaccctagaaggatgagtgggaggtggctaggtggggtggggtctgacaaggagccaggagcattctggggagagggagatgcaggcacagggccacagagagacagagagctgggggcattcgagacccaaagaggctgtgtggccagagtgctgagtgtaagaggtgagagatgaagcttgagtgtagggcagggtctgatcctgcaagccctgattggcgttttctagttttggacttcgtcttgatgacaacaggaagaccgtattgaaaggttttaagtgggaggggaccgtgattggcttgtgctgtaggaagatcactctggtcacccagtgggcagtggagctgagaagggggagactgaggcagggagacatcatttggtggaggagtttgaagcattcattgctcccacataccagagtcctgggatccttagacatcctcagagctccctccaggtgctcttctccacaattacccagaggattgaatcaagctgagagttctcagctctcttttctcgagacagctgctcatcctttgtttggaaccctgggcctgtgccgatttgcccagtagctttcacgaacggctttcacataaagccagacttgtgctttctaaacagttgaccctgtgtgagggccgtgaccttgcagaatacaaaacaggagaggttagatctaagtcctccactgagtgctcctggggcatcctgcccccagggaggctgtggtctacccaagagcagatgtagaaaccccaattcgaccaggaggctgaatggagccactttgtcccatgctccccactgctgtccttcctccccagaggcaggaacgaggctgcctcatccagagctgagacgcatactgctgtgctggaaggagaaggccagaaccccagctcaccaagctggcattgctggtgcacgagccacccagtggggacaggcagggggcaggaggcgggagacaggggaccagctcccgacggccgtgccgagggacttctgtgggtgcccagtgggtgtccatctgcaagttggcttcaagggtcttttggccacctcttccatgacttggaatttcttattgtcctgctcttaaagattttgaggatccctagtaagtggggatcaggagttctgggttctgggtgtggctttattaccagctcactgggtagggttgggccagtcctttcccctctctgggcttcagactccttcttatgaaacaagggattggccttaggtgtcctctgaggtccctccaaagcgagccgctctatgttctctggagctcctagcaccccaatgacacacaccaaatagttgccacagacggatgggtggatgggctctgagtcccacctccacccgctcctgggtgggttgttcatttgaggactgagaccccagggcagacccggaagcctggaacacgttcacatgccacagatggaggatttttccgcttcaattatcttctttgcaggttttgggttttcagacagggctggcagcttgactgagccacagtaaccatttccgagctggctggaagcatgcatggaggacctcagggttcaatctgttgttctccttccagtatcaagagtctgaacgattccaaatacggagaaacaacctctctccgggttccttgtggccagccatcacgaaaccctcgcacctgttcaccctgcaaagcgtgatatgtctgaactatttaaacggttgggtttactgattaatttctcctcagcctcatgcctggatcctgggtgtccgccatcggagtgctggtgactgttgtggaggcaggacccccagcttagggtacagagtctcctgtgttgtggagagctgagaagaccaggtatgaggagcctcatttgtgctctagctttattattaagttaagggtgccaggcgcggtggctcacgcctgtaatcccagcactttgggaggccgagactggtggatcacccgagttcaggagttcgagaccagactgaccaccatggtgaaaccccgtctctactaaaaatacaaaaaagttagccaggtgtggtggcgggcacttgtagtcccagctactcgggaggctgagacaggagaatcgcttgaacccgggaggcggaggttgcagtgagccgagattgtgccactgtactctagcctgggcggcagagcaagattccatctaaaaaaaaaaaaaaaattaaggacatatgttttggctattctccaatttctactttttataccttgataaacacattagagcaatgtcctaggtgacaatttcttgttgataacgcacaagttttgccagaagactgtctcagatgttccctgttctctacccctggtgggtttttcactgctgggtggaacctaaatgttcattgtcccttctgagaacacctgctgtgtgcttcccctgcctgcaaaaaccaccttgaacgtgatgggtgctttcggactctcagggcccttctacctctgctcatcccaaacaccacggcactggagacaaagcttttcgttcgcagctgcagccgcttgcctgtgatcatctttttccaattgggggtttcatctctcttttacaacctggctcctgctaccaacctcctgcagtttctggcggggacttgttagagtggccaaacaaacttttttttttaaacaccaacaagctatctggacacagtagggtagttactaagcaaaattatcactgctcccttctatgccccagaagtcctgaagcccacagcctgtctatccttttgaggccaaagggagagatgggcatttgaggacatggtgggaaaggctgaggctggaggacgggctgtgggtatgtgagtggggaatggtgttgacgcctgtctcctcccaacttatggcattgatcatcttttggtaggagccgggctaccaaactcatctttttttttttctttttctttttttttttgagatggagtctcactctgtcaccaggctggagtgcagtggcatgatctcagctcactgcaacctctgcctcctggattcaagcgattgtcttgcctcagcctcccaagtagctgggactacaggcatgcaccaccatgcctggctaatttttgtatttttagtagaaatggggtttcaccatgttggccagaacagtctcgatctcttgacctcatgatccgcctgcctcggcctcccagagtgctgggattacaggtgtgagccaccgcgcctggcctaactcctcatctttcttacttaccaaagcaggtaaggactctctgtgactcactaagcaagaaagtcatggatgtttctggtcatttaggagcagaaagagggggatacagatgccggtttataaaggctgagagtgcaggaggcagccactcaggagaccttgctaaggctggcttcccactgcttgtcttctctggccatttctctgcttgggtacagaaaccaggccaagtgcctggggaacatttagctttttgttgtgagaagggaagaattagaaagtcaaatgctcctatggactgggagccaagagaagggggcagggaggctggcagggccttgaggaggcttggccactctgagggtgggtgcccatctaaggcaagcctggagctgggtgggcaagagccgggcggccccgctcctcctttccatgtcctcccctccaccgggaccctcagcctgggcccagcagggaaacccagggcgtgtgaagccgaccaaagggagatggattgaaaaacagccagctgaggagggcactggctgccaggcggaggactcggcagtgccaagtgcaaggtttctggagagctgcttatgtctcactgcctacaataacacctcatttatttggcattatcagagaatgagctgtttcccttaagtgacttttcctcccccaaactttaaaaatggaaacattttatgtgtcaaactttttattattatttaattgtggtaaaatatacataacataaaatgtaccatctaaaccatttttctctatgttttagagacagggtctcgccctctcccccagactggagtgtagtggtaggatcatagctcactgcagcctcaaaactcctaggttcaagggatccttctgcttcagcctccccagtagctggaactacaggctcaagccacagtgcctgaccaaagttaaactggatcctacgtttaaccccccgccttttttttttttttttgagatggagtttctctcttattgcccaggctggagtgcaatggcacgatctcggctcactgcaacatttgcctcacgggttcgagtgattctcctgcctctgcctcctgagtagctgggattacaggcatgtgccaccacgcccggctgattttgtatttttagtagagacggggtttctccatgttggtcaggctggtctcgaactcccgacctcaggtgatctgcctgcctcggcctcccagagtgctgggattacaagcgtgagccaccgtgtccggcccgtttagccacttttatgtgtacagttcagtggcatgaagtacattcaccatcatcaccatccgtctccagaactttttcaacttcctaaattgaaactctatacccctgaaacaacttcttcctgccccagactctggaaacctctaatctactttgtctctaggaatctgactactctagctacctcatatcagtggaatcatacagtagttgtccttcggtgactcccgggttcaagcgattctcctgcctcagcctcctgagtacctggattacaggcatgcaccaccacgtccggctaatttttgtatttttagtagagacggggtttcaccatgttggccaggctggtctcaaactcccgacctcaagtgatcctcctgcctcggcctcccaaagtgctgagattacaggtgtgagccaccacacctggcgactggcttatttcatttagtatcatgtcaccatggttcacccaagttgtgtaaatgtgtcagaatctccttcctttttaagactgagtaatactccattgtatggagaggccacattttcttttcttctcttttttttttttttttttttttgagacggggtctcactccatctgcaacctctccctcccagattcaagcgattctcatgtctcagcctcccgagtagctggtattataggcgcaaaccaccatgcctgggtaatttttgtatttttttagtagagacagggtttcatgatgttggccaggctggtctcaagctcctggcatccagtgatccaccagctttggcctcccaaaatgttgggattacaggtgtgagccatggcgcccagcctggataggtcaaaattttttttgagacagggtatcactctgtggcccaggctggagtgcagtggtgcgatgtcagctcattgcaacctttgtgtcctgggttcaagtgattctcgtgcctcagccacccatagctgggattacaggcgcacaccactatgtttggctaatttttgtatttttttttttgagacagagtctcgctctgtcgcccaggctggagtgcaatggtgcaatctcagctcactgcaagctccgcctcccaggttcacgccattctcctgcctcagcctcctgagtagctgggactacgggtgcccaccaccacgcccggctaattttttgtatttttagtagagacggggtttcactgcgttagccaggatggtctcgatctcctgcccttgtgatccgcccgcctcggcctcccaaagtgctgagattacaggcgtgagccactgcgcccagccaatttttgtgtttttagtagagatggggttttgccatgttggccaggccggtcttgaactcctggcctcaagtgatctgcccgtctcggcctcccaaagtgttgcgattacaggcgtgagccaccataccggcctgataaaccgcattttctgtatccattcatccatccatggacatttggattgcttccagctatttgctattgtgaataatactgctatgaacataggtattacccaagctttgttgagtaagcttaagtaacaaataacttattagaaatatttttcttattctaaattttatttatttatttattttagagacaaggtctcactctgttgcccaggctggagtgcagtggcacgatcacagttcactgtagttttgacctaccagactcaagtgatccatccacctcagtctcctgagtagttgagaccacagacaagagcctccacacttggcgaattttcttaattttggtagagatggtatcttgctatgttgcctaggctgatgaactcctgggctcaagtggtcctcctgccgcagcctctcaaagtgtaggattacaggagtcagccattgtacctggtaaattttaaaacatttagaaaatgtggacaagttggctgggcgcggtggctcacgcctgtaatcccagcactttgggaagccgaggcaggtggatcacttgaggtcaggagtttgacaccagcctggccaacatggtgaaaccctgtctcttctaaaaatataaaaattagctgggcgtggtggcgggcgcctgtagtcccagctacttgggaggctgaggcaggagaatcacttgaacttgggaggcagaggttgcagtgagacgagattgtggcactgcactccagcctgggtgacagagcgagaccctgtctcaaaaaagaaaatgtggacaagttaaaagaaaaaaatcactcattatcccattgtccagagaaacttctagtatacatactatttacattttgttatatacacttctgttttaccttttaatgcatacaaacattcagtttctacaaacaggattttatattcaaacatatactattttataacctactttttaaaacttactgatatcttgactctcttgctgcaacctaattttcatgactgcttggcatcttagtacatgaatgtaccacagattctgatgagtttctcactgtagggtctgaaggttgtttccagtttttttctattactcatagcacagtgaggtacattcttggagctaaacctctgtgtgtctgtttagttctttttggaggatagagtcttagaatcacatttggtgagtcagagggtgtgtgtgtatacatatatatgtacacacacacatatatgtatgtacgaatataatatgtacatataaatgtgtatatacatattaaatgtagctatattaaaatgtgtgtatatatacacattttaaaatcctttaagtcttctatatgtattggcaaattgcttgtcagataagttttacttatttgtgtttccatcagcagcatcaaagagtggcagtttctctgtaacctcactgaggctgtgtattgtcctttatgaaatctttgctaaactgaatggtaagaaatagcatattgaagccaggtgcggtggctcacacctgtaatcccagcactttggaaggctgaggcaggcggatcacgaggtcaggagtttgagactggcctggccaacatggtgaaaccccgtctctactacaaatacaaaaattagccaggcatggtggcgcatgcctgtaatcccagctactcaggaggctgaggcaggagaatcgcttgaatgcaggaggcagaggttgcagtgagctgagatcatgccactgcacttcagcctgcgcaacagagcgagactccgtctcaaaaaaaaaaaaaaaaaaaaaaaagaaacagcatgttaagttttaaaagtatgcatttctttgaacatttaaaataacatgtctgttagccacttgtgttcctttttttggggaattgcttattcaggacctttgtgtattttttccattgagggatgaatattttgttacttatttgtgagcattctttgaatattgaggatgtaaattatttgttatttcaattgcaaacagtttccccaagtttgtcccttgcctctgttttgcttctggtgctcgttcatgtagaaaaatgctttttacttttatataagtattttatgtttaacttctgcctttggtgtcatttcaataagaggttataagatattcatctactttttagtgtattctagcactttcatagcttaattttttatacttaaatcttgaatccattcctaaaatgatctgatgtaaggtaaagaatccagcctttcactttgtccatgtggacctttccctaacgcattcgaaatgctcctttgccatgtgttaattctctttggtctgtttctggagttctttctgtccaatgatacacatctgtgttcttttgccagtgccacactgttttaatattttaatcattttagggcatgaatcccatgattacaaaatcccttggctggtcttttgcattttgtttccagatgaactttagactgatttgatcaacttaaaaaataattcctctgtgcttctgattgaaatggctttaactttatagataaatgtggagggaatgagaatctttataatttttttctttttctttttctttttttttgagatggagtctcactctgtcacccaggctggagtgcaatggcgtgatctcagtgcactgcaacctccgcctcccgggttcaagcgattctcctgcctcagcctcccgagtagctgggattacaggtgtgtgtcaccacacctgatttttgtattttttagtagagatggggttttaccatgttggccacgctggtcttgaacgcctgacctcaggtgatctgcccacctcggcctcccaaaatgctgggattacaggcgtgagcaactgcttccagccaaatctttataatattgaatcttctcgtatgaaactttgatatgtccatcaggtatccacatggtttcctcatctatgtccctgaatgtttcttaagtttatatgtgggcattttgaattgtttgtagcatggtgaatggtgtcattttccagtatattttccaattgtttgctattggtatatatgaaagaaactggcttttatgtatttattcagtgactggcctggtcactgaataggggctgtcttcctgggttttatgggtagaccctttttttttttttttttttttttttgagatggagtcttgctctgtcgcccaggctggagtgcagtggcacaatctcggctcactgcaaactctgcctcccgggttcacgccattctcctgcctcagcctcccgagtagctgggagtacaggtgcccgccaccacgcccaactaatttttttgtatttttagtagagacggggtttcaccgtgttagccaggatggtctccatctcctgaccttgtgatccacccgcctccacttcccaaagtgctgggattacaggcgtgagccaccgcacccagcccatcatagcatctttaataataataattctgcctttttcttttctgccattcattctcttttcttgtcttcttgcattggctacaccattcagaacaattctaactagtagggatgataatagcaggcgtctttgtcttaattctgacttaaatgggaatgtctttagtgtttcacatttctctgcttaaggagtgttaaatgcaactaaatcttattttgatgtttcagagtcattggtaatacataattgaaaaacattctgtcatacagtcataccatcagcaatcagtggagcttacttatctgttttacttgaaggttccaagttttatttttctcactcatgctctctcttttgcattgctgactcactgagactttccttgtttctcttctcttgctcccaagctgtctattgtcggtaatttctgttgtttttctcctttttcattttataaaccattgttttaattgaggccataatttgaggacgtggaaaacatttcaaatagtacaaaaataagtcaaaagtcagaaattcaaacgctgctgtaagatgtgtttccctcctatgccgacgcttgttcaccctggaaaatgtaacattttgtgtccttccagacctattaaatgcagtgtgcttctatttatgttaaaaaatatgaagatattctgggcgcggtggctcaagcctataatcccagcactttgggaggctgaggtgggcaaatcacgaggtcgggagttcaagaccagcctggccaacatggtgaaacctcatctctactaaaaatacaaaaaaattagctgggtatattggcatgtgcctgtaatcccagctatttaggaggctgaggcaggataatcgcttgaacctaggaggtggaggttgcattgagccaagatcatgccactgtactctagcctgggcaacagagcgagactgcctcaaaaaacaaaaaaagaaaaacaaaaaaaccccaaacagacaaacaacaaaaaaatgaaggtatatattcatatctgtcctgtaccagaacacaaatagaaagcacactattcatgcagttaagcgcttttatcacttaatatatcgtggcaatctttctaaatcagcagtgtggattccttagtatgccattgaatgcatgtaacataatttattgaaacagtcccctgtgtacctaggtttctccagatgttccagctgcagtgaacatccatgtaaatataagtctttgttctcctttgcgaattttctgctcctaattgacttactctgacctccccccgagaaagagaaatagatgaactattcaaaactgaatgtaaactaagaataaataggttctgaatgaagatcagatgattctattgagcagagtgaatgggttttagtcaaggacttcctaccgttatcgtgactgtagagtggacgtttcgctcagttctttattgtcacctggcatcgtttacttccaagtttgctggataaatgatccctcccatgcccgttcccagacataaggttgatgccacctgttcgtgtgaccctgatgcgccatatttgttacctatttattctcagtttccttatcagcatcccatacaggcttattggcctcacctggcagtgcagggtctccagcagtgcctgcagccaggtgtcctgggaggcacctgtgcagtctggagagcgctgttcacagtgagctggactgcagaccctgggagctaagaggggacaggtgaatgccttaaggagcctgcggagcaggtcttgcaggatggctgggaagggtcattgcagcatatctggcctgtctgatgcagcaggtggaaacagagactgctgaaaccatggcactggcgagaacctcatctgtgaggttcctgtggcgtcagacacagccagaagctgttttcatatgatctggactggagcaggctatgggaggatgctgggtgtttccagccacacctgcatatgaagaaaacaagcacccccagtagctggggtgtggagaagagagaggttagtgagatgctgctgggaatgtaaatcgtaggggagattatggtttttagggagagaagcgatttttctctcacttctccattggccaggacaacttttgtttttaacctctaatactcattttctttctgactccaaaaacaatgtgtattaattttagaaatttaagaaaatatagaaaaatagaaaaataataacctgaaatctttccttctagggaacacactggtaacattgagtatattcttctggtatatttccattttcgttttcctttgtacatgaatttttttaatgaaatggaagtatgctttgcatattgttttgtaacctgggcttttcatttgctatatgggaaacactttgtccatgttgttaaatattctgtaacattgttttaatagtctcattggccgggcgcagtggcgcacgcttgtaatcccagcactttgggaggctgaggcgggtggatcacctgaggtcaggatttcgagaccagcctgaccaacatgttgaaaccctgtctctactaaatacaaaaaaagttagctgggtgtggtggtgtatgcctgtaatcccagcaactccggaggctgaggcaggagaatcacttgaacccgggagacggaggttgcagtgagccgagtttgcgccattgcactccagcctaggcaacaagagcgaaactctgtctaaaacaaaaaaaaatctcattgactctcactttatgaatatagagtaatttatttgaccaaacatgttgttagaaacttcagctatttccagtttttttccttccttccctccctctcttccttcctacctacctatatacctacctaccttccttccttcctacctaaaaaattctacaatgaacatcatagatacgtgtttgtatagttttataatttcctcataataaattcctggaggtaaaatgtctgttcaaaagatgaacatattttaaatttaaatttgttctccaaaaagattaaagcatttatgtttctaccagaaatattatgagaatgtcttgaactctttcttacaatagccattattgttttaaaaaatctttacctatgtaataggcaaaatagttgctgcacatgttatttcaaaaaattaaatcacctttttctgaatttaaaataatatacattattttaaataaacaatgtgacaaaatatagaagaaaaatgtactgagtaatcctttccacctaggaacaatgataattaacattttaaaaaatgtttttattttattttatttttaaatagagacaaggtctcacttgtgttgcccaggctggtcttgaacttctgagctcaaatgatcctcccaccttggcctcccaaagtgctgggaatactgacatgagccaccacccccagcctcattaacattttgatggaagttattcgaaacatcttgcttgatgtcttgtatatgctatgtgtatatatatatatatttacatatatatgcataatttttgtataattttgcatgcattttactctgtgttatttggtaacctgctttttctgctcagcaatatgtcatgcatatctttatttatttatttttttgagacagagtctcacgctgttgcccaggctggagtgcagtggcacgatctcggctcactccaagccccacctcccaggttcaagtgattcttctgcctcagccttccgagtagctgggactacaagcatgtgccaccatgcccagccaaattttgtcttttttttttagtcgagacggggtttcaccatgttggccaggatggtctcgatcgcttgacctcgtgatgtgcctgcctcggcctcccaaagtgctgggattccaggcatgagccactgcgcctggccttatctgcatatgcatatcttatctggtcagtaagaactatatcatgtgtatagcactacctcatctttttgaggattgctagaattcatgtaaacaatctcctttgtctaccttttaatgcaaatcattttttccaatatgatgtttgccttttatttctatttatagagtttttttgttgttttaatcagatggttagtttttatgtcatcctgtcagttagtatctttcttcatggggtttgcttttgtggttctgctgccaaactgaaactttctccagccaatcttcactttcctgacctctttgttttagttcatgctgttcctcccttcctggagggccttccctaccagtttcctaccattgagatctcctgcctgtagttcagagtatctcaaactcctctttctccatgaagttgccttgattctgtatcacccgacattttctctttattaaattcattatgttctgcctggattatgttaataccttatttgtggtgtttatcacatttcatcttgtagttatgtttatgtagactgtaaactttctgagggctagacccatcttccatgtctgcgaccctaagattctctaattcaatgcttgtcatacagtagggcctcaataaacatttgctggattgaattaaattggatttgggtggaccaaagcatccagtctatttcagggagttgattcgtgagactcttaaacaagaccagacgtgggttactctttgttcctctactgactggaattccccgtgttgtttgagatgtgtgtcccaaagagaaacttgttgttctgaagaattgcacacttgtatttatggtattgttggctttttgtatctgccactgccaaccttgtgacatctggcacttttggcagaagtcctggcccttgggaccctgttatgagcaaacacagtgattgagaagcagaccagctgagactaatccagtccagggcccatgacagcaacctggccaggtgagtggggattttagccttgtcttatacaacacagcacaagccaggatttcttcctaatccctgccttgccttcttattgggggattgtgaactgcacctaaaacataaggggtggcccagtgtggtggctcacaccagcactttgggaggctgaggcaggaggattgcttgaggccaggagtttgagagcagcctgagtgatagagggagaccccatctctacaaaaaataagaaatgtagccaggtatggtgctgtgtacctgtagtcccagctgctgggaggctgaggcaggaagattgcttgagcccaggagttggaagctgcagtgagctatgattgcacccatcactgcacgccagcctgggcaacgagagagactgtatcaacaaaacaaaacataagaggaaataataaacatgatctggtgctccactccattaatcatcaggaaaatgcaaattagagccacaaggcactatcagagtgcctaaaatgggaaaagacaaagaatatcaggtgttgataaaatactctgctggcaggagtataaacatatcaaataacagttttgtggctgtattagtccattctcacattgctaataaagacatacccgagactgggtaatttatgaaggaaagaggcttaattgactcacagttcagcatggctggagaggcctcaggaaacttacaatcatggtagaagggggagcaaacatgtcttcttcacatggcggcaggaagaagaatgagtgcttagtgaaggggaagccccttaaaaaaccatcagatctcgtgagaactaactcactatcacaggaccaggactggggaaactgcccccatgattcaattatctctacctggtccttcccatatccccataacacatggggattatgggaacgacaattcaagatgagatttgagtgtagacacagccaaaccatatcagcggcatctactaaagctgacatgtgcccatcttataacgcagcagttccactcttgggtttatacccattggtaatgtgtccatatatttaccaagagacatgtgttaggatgttcattgtaacactcctataatggccccaaactggacactgtccatgaatgcccatcaacaatagaatagaaaagtagcttgtgatatgtcatacagtggaatgctatacaggaatgagtatgaatagcctataactacatgcaacaagtagtcaaaactcagaaacataatgttgactaaaagaagccagatgcatactctacgattccatttatgtcaagtgcaaagccaggcaaagctaatgtatgctgttggcagtcacgatattggctaccctggctggatggagggtagtgactgtggaggaggtggcaggaggtggcttctgatggtgagtgtggggggatagtgttctggttcttggcctgaggctgattcacatggatgtgttcagttcgtgaaaattccatgagcagtatgctttgtgagcaaaaaattttctgaccaatttgatatgtcaataaaaagctaaaaagtgattgacagggtatatactcagaagaattgaaagcacggactggaacagatatttgtaccacccatgttcatagcagcatgattcacaggagccgagaggtagaaacaacctaaatgtccatggattgatgaatgaatgaactaaatgtggtttatacatgtgatatggtttggctgtgtccccacccaagtttcatcttgaattgtagttcccataatccccatgtgtggtgggagggacccagtgggaggtaattgaatcatgggggagtttgcctccgtgctgttctcatgatagtgagtgagttctcatgagatctgatggttttataaggggcttttctctcccttcagtctatacttctgcttgctgccaccatgtgtttgcttccccttctgccatgattgtaagtttcctgaagcctcgccagccatggtgaactgtgagtcaattaagcgtctttcctttataaattacccagtttcgggtatgtctttattagcagcatgagaatggactaatacaacatacaatgggatattactcagccttaaaatggtaggaaattctcacacatgctacaacttggataaaccttgaagctgttatgcttggtgaaaaaagctagacacaaaagaacaagtactaggctgggtgctgtggctcaagcctgtaatcccagcactttgggaggtcgaggtgggtggatcacctgaggtcaggagttcaagaccagcctgaccaacttggcgaaactccatctctactaaaaaatacaaaaaaattagccaggtgtgatggtggatgcctgtagtcccagagactcgggaggctgaggcacgagaatcacttgaacccaggagtcagaggttgcagtgagctaagatggtgccactgtactccagcctgggcaacagagagagactccatctcaaaaaaaaaaaaaaaaaaaaaaagacaagtaccgtatgattccacttataggacgcacctagagtagtccagttcatacagacagaaagcagaatggtggttgcccgaggttaggggagtggcaatggggagttagtgtttaatgggtacagagtttcaatttgggaagatgaaaaagttctggagatggaggtggtgatgattgtgcaacaatgtgaatgtacttaatgccatagaactgtatacttaaaaatggttaaggtggtaaatttcttgtgcattttaccatagtacaaagataggtgattgcaatagatgattgcagataataacacaacatacatacagacaaagacacacgagcagaagcaatgggccgtacaaagcttcctgtgcttcggggcctgggaaggagcccggcaggggagctgtgagggcagagcagagggggtctggaaaactgggaaaggacccagcgtgaccttggaggtagcaatagggtcagccctgctgggcacaaggctgacctgcaggcccgacacatttgagggtgctcgggccagctggcatgaagccgctctctcttgctggcacgtcaaagctgaatgtccaacaccatgacaccctggtctggcctttttttgaacttgcacagctttcccgtcaggtcctggagacagggagactttaggcggggcgatttggcccacggaagggaaggatttcccacgtgggctttattctagggagtgcgaggttggccacagtcctgacctgacagccagggacctgctgctcacaggacatttcagagtcagagccagattcctcaacacttacgaggtgttcctgtaccaggccgaggcccctgtgatggtgagtgcctctgagtggggcaggggtggggtgacccatggctgggtctcaccgtgggagcaggctgctggccatgtggggcccgtgagagacccggcagtccaaggacaggtgttttgttttgagcgtccatttcagaatgaaaagacgtggtgttagcccctttaccagcagggacattcccaaagaatgctgccctctgacacctggcctttaggaagagcccccaggaagacaccacacctgggccggatttccagggccagcccccttgggtcagcttggtctgctccatctgcccagtcctaggaaatccagcttttcttccctttgcattgccccaccccaggcttattcattaggtgtcctgtcacctctccgggccttttctgaaggtatctggagcctggtgtgtgtgtgtgaatggtggccttaaaaggcttaggaacatttgggggctgagaaaagaatgctcccagctggcaggtggatgtaggaggcattaatccagaatcatttttcctgtggagacggctttgttataaatctgtcaaaacgtgggcgttcttcagtgttcatgatattatccctggctcctgtggggacaggggtgggagtaagggcgcctagctgagaaacaggattttctcctaaaagatgtttggttccttgagatctgttctgtctctctctctttctctctctctctctctctctgtctctgtctctctgtctctctctgtttctctcctccttgacctcacgcagttggtagagtacagccaatttgtcactggttctttagaactgtgggaatcctccccctcccccaagtcccccaaatgtgcaggtgagctggataagtaggcagcctaaagacagagggaggtgggttgaagggaaggaagaggaaatgaatggtgagcagacacaccctggtattccgatttaaaaaaaaaaagaaatgctagttgggtggggatggggagtggggaaaccaagagaccatctggaccagctactcccaaagcgtggccccccaaccagcagcgtcaacaatatcgcctgggaacttattagtgatgcaaactcctgggccccatcccagacctgctgaatcagaatctgcacatcaaagttggagaagcgctaaataaaccacacttcctggtccagagatgggaagtgacttgtctgtgatcacacaggtggttaattgcagagaaggacttccagcccactgcctcacctgccttgcgggtgagatggagcagtcgtacctgactcttggcactcagggtttgtgccttggcgaatctggttgtgttttgtatcttgggggcagaatttttgtgtgagttattatcaaccaaagatggttgaagtgtgaagctgtaggcctgcctcggagttagcacacggaacggaatatcctacatgtagttttggttctgaccactgatttgccatctggcaaaatggcatttccttccttccttcctcccttccttccttccttccttccttccttccttccttccttccttccttccttccttcctttcgacagagtctcgctctgtcacccaggctggaatgcagtggtgcacgctcggctcactgcaacctccgcttcctgggttcaagcaattctcctgcctcagcctcccaagtagctgggagtacaggtgcccaccaccatgcccggctaatttttgtatttttagtagagacgggggtttcaccatgttggccaggctggtctcgaactcctgacctcaggtgatccacccgccttggcctcccaaagtgctgggattacaggtattagccaccacactgggccccaaaatggcatttcagaaccttttgttgtatcttcgccgtcaccatcatcatcatcatcacagcacagatcctttattttgcacttactgggatccataccccgtgctaaacacttaggttatttcctttgtcacaccaaccacataccgatcgcatttaaagctgaggaagccgagcagcagaaagataatgtactcgtggtccctcatctagataaaagaaggggtggaatttgggtcaaagccccatgtgaccccagcagcacacttatttacacttggggtattaggtaaaactgtagtacatcttgtatttgtgacactctccaactctatgattctgaggcagaagttatcctttaagcgccaaatttgtttagctattattaccatatgtgaaactgtttggagacattttgtaatcccaacactaatgtctgtaccaatttaatttccatatgcattttgtgttttaactgtattttaattaaagactgaaatggaaattctgtgcacctcagtcagttgagagaaaagaatcttagatgctcagataaaatgtgatttatgctgttgcaaaaaatgtgaaagacatgtgggcacttactccccggttatgactgtttccagattatacattgttagaaagaaaaaaagtttgggggtgcgggaggaacgctgtgtgaacgtggaaccactgacttagacccctggctcattcagctggaaatgggatgtggaagcccaggttgtggctgacttctttgaacttctccacaggctggggacattctggtaattgttttattgtatttgtagcctacagtgggtggtggtcggcaaaccatggtccatgggcagaatctggctggccacctacttttgtaaataaagttttattggcacacagccacacccatttgtttaagtactgttatagctgctttcgcactgcaatgtcggtgttaagtcactgtgacaaaaactgcatgggccgaaaagcccaaaatatttactatctggtcctttgcagaaaagagtttgccaaaccctggcctgatacctttttggacaacatttcctaagttttctttctgctgtttgtcataaatgcttgaaacccatctattcactggctccctcattcatcaaacgtagtttgatcacagtggtaagaaatcttgcttagctcaggggctgtgggctcatgacaaaaaagaatgtaatcaaagattataggcttggcacaaagaaacattcagtgaacttgtgtaagttagggttctacaaataactgaatccactaattcaaggaggaagggattcatgcgaattgggataactctcagaattgttgggaaggctgaagaaaagactctaggctgagctttcaggaacaaactccccaacccgctccccaaacagatcaccaaggctgctacaatcaggaagttacagaagcaggcggtggggatgttatcatgcagccagccacagaaccatagctctggcacaatccaccccaggaaggggtgcctcgtaccctggccctctccctactgcttcacatcaaagtctaatcagcagagccggagtcacacgcagaggctactgtgaggaagtctggggagggttttcgactttccggcctttggatgctgatcaaataatccacagacaccccatggtacaggtcattgtatcctgaaagatagagtgttcaactcatttatggtttgtattaaaatttgagaacttaaaacattattcagtagacatagcaagtgagactggtccagaatgcccaggaaagcagatgtggggtggtatagaaggcatcctcaggtccatctccaaatcctgcccactcatccttcaaggctctggtgccacctccttcaggaaggtgtcccaaggctggctggtggtcctttctgtcctcagcattgttagaacactttgtcttatctgcccactctctaggaagttacagtattctccttcacaggatagttatatctttctcttcaatgtttttctttttctttttctttcttttcttttctttctttttttgagacagagtctccctctgttgcccaggctggagtgcagtggtgtgatctcggctcactgcaacctctgcctcctgggttcaagcgattctcctgcctcagcctaccgagtagctgggactacagctgtgcaccaccacccccggctaatttttgtatttttagtagagacggggtttcaccatgttgatcaggctggtctcgaactcctgacctcatgatcctcccaacttggcctcccaaagtgcaaggattacaggcgtgaggcacagtgcctggcctgaagtgtttttctttttgacctttttttaaaataataagagaacattgccaagtttgaaatacttctcattttcctttttagttccattcaatttctttcttcccagaaacaaatagtatagtcagtttatctttctctgtttttcactttaattacatgtatgcatctttgcacaatacagagtgttgtctgtgagttactttatctgagtgatattttagtggatgttccagtccctgacttactgtgctattagatagatccatgttactacatagaattccgtttcattcattataagcagtatatggttgccatgccattgtataaacaagctacaatgtatccattttctatcaatggccagtcagcttttccccagttttttcctattataaacattgttgcaataagcagcattgtccatatctcctggggttatgaatgagatttctcaagggtagataccaagaggcataaattggtcatttccagctttactagatattgtcaaattgctttccaaggtgattgcagcaattcccaccagctctatgtggaaattttcatctgcctatattctggctaacacttggtattgtcagacttgtgtatttttgccattccgatggtgtgtggtttaaatttgcatttgcattgttgatttaatttgcatatgtctgattattgtgaggttaagcatcttttcatatgtttattggctatttaggtttcctttgctgtgacatgcatattcatagctagtgtgtgtcttttctcttgggttgtctttttcttatttatttgttggagttctttgtatattctggatacaagtcctttgttgtacatggtgccattattttctcccagtctgttcctgtccttttcccctgctgtccttttgtatcctctgacctgatttttgcttcatcaaatgcttaaacgagtgcagaatgatgcttccccaccaggtgcaacctgactcaaaacccagggtgtgtatccgtgagaaaacttgacgacatcccttgaggtgctgcctggtgaggtggggtgagcagaatttcatctccttcccctacctcctgcctcttttttttttctttttgagacagagtctcactctgtcgtctaggctggagtgcagtgatgcgatcttggctcactgcaacctctgcctcccaggtttaaacaattctcctgcctcagcctcctgagtagctgggattacaggcacctgccaccatgcctggctactttttgtgtttttagtagaaacagggtttcaccatgttggccaggctggtcttgagctcctgatctcaggtgatccacctgccttcttggcctcccaaagtgctgggattacaggcctgagccaccgcacccagcccctcctgcctcttttctatctaggtgtgctagcttcctagggccgttctaacgagttaccacaaactgggtggcttaataatgcagaaaggtgttttctcctatttcaggaggccagaagtccacagtcagggtctcagcagagctggtttgctctggaggccctgagggagaatctgctacatgcctgtctcccagtttctggtggctgctggcaacccgtagcattctttacttgtagccgcatcattccggcctctgcctctctgcctctgtcttacacgatcttctcctctgcatgtgtctttcccttttctgccacccattattgggtttagggaccaccttaaattcaggatctttttttttttttttttttttgagatggagtcttactctgttgctcaggcaggagtgctgtggcgcgatctcggcttactgcaacctccaactccctggttcaagtgattctcctgcttcagcctcccgagtagctgggaggattaccggcacacgccaccacgcctggctaatttttgtatttttagtagagatggggtttcaccgtgttggccaggatggtctcgatctcctgatctcgtgatccgcctgcctcggcctcccaaagtgctgggattacaggcgtgagccactgcgccctgcccagcatgatcttttatcaagatccttgacttaattacatctgcaaagatcctatgtccaaataaggtcacgtttacaggcagttaggtcatggacatatctttttgggggtcattatttgacccactagactaggcaaatgctatgaatttcagagaatagctagcctaaaagtgaagtgtaggtgtgtgtggtggtggtggtaggagaggtgaagggggtgtcaaggaagaaaaatgcatctgggagaggcaggttcttctgggaggcacagttcccccagagaggagaggcaatgcagctgattcttaaacaacttagggggtttagaggcactgactgcccctctgcaataaaaaatctggatatttttgactcccccaaaacgtaactactaatagcctgttgacaggaaggcttactgataacatcgacagtcaattaacacatattttgcatgttatatgtattatatactgtattcttacaataaagtaaactagagaaaagaaaatgttattgggaaaatcgtaaagaaaatatatttactattcattaagtggaagtgggtcatcatgaaggtcttcatcctcattgccttcatgttgaataggctgagggggaggaggaagaagaggggttggtctcactgtctcaggggtggcagaggcacctgtaaatggacccacacaattcaaacccatgttgttcaatggttaactgaacattttagttgtctattgaactaaaattcagtggtcaacggccattgtggattttcacatttttcatctatttagagtccccagaaaacagataacgggtgttcaaggaagatgcctcttgggtgaacaggtacaagccaggcgaaacctagctgtgcccatcgatctgccccactgctatgaagctgcgcctgtggctgtatcccctgcaagggagccccagtggggccaaggacaggacactctgtgaacagctgctgtagatcctgcctttttgaagataagtaaagagaaaccaagtacatttctacaattatggaatccacaaataatgaggttcagcaatactattcctttccttcacctattcgttacaatttgtgtaaccccaaaataaatactcagggccctttcatggtcattcatgatgggcacagagaggtgaaaaatttgagttacctggtgtgcatgttcccagcgagattatttcagctctcatactgtaaacaagtgtcttttcgttgtctgctcggtgccacgattttcacattttgatgcttcttttttggtgattttgctgtttaaaatgcaccccacccctcatgcctgtaatcccagcactttgggaggccgaggcaggcggatcacgaggtcaggagatcgagaccatcctggctaacatggtgaaaccccgtctttactaaaaatacaaaaaattagccgggcgtggtggcaggcgcctgtagtcccagctactcgggaggctgaggcaggagaatggtgtgaacgctgcggggtggagcctgcagtgagccgagatcgcgccactgcactccagcctgggtgacagcgagactccgtctcaaaaaaaaaaaaaaaaaaatgcaccccacccccttccacagtactaaagtgctgtctagcatccccaagctcaagaagactgtgatttgctttatggagaaaatgtgttagatacgattcgttcaggtaagaagttgtattgcttttggctgtaagttcagtgctggtgaatcaatgatacgttttgtatacagaattttttttatttttttttttttgagacagagtctcactctgtcgcccaggctggagtgtagtggcacaatcttggttcactgcaacctctgcctctcaggttcaagtgattctcctgcctcagcctcccgagtagctgggattacaggtgcccgccaccacgcctggctaatttttgtatttttaatagagatggggtttcactatcttggccaggctggtcttgaactcctgacctcgtgatccacccacctcagcctcccaaaatgctgggattacaggcatgagccaccgcactgggcctgtatacggtatttttaaagcagaaatacatataaaaaaagggtacatactgaccagtttgcgaaaatgttgtgactaaaggctcacaggaacttaaccctgtattttccctgggagcaatggttcattatttgctgactattcatggcagcttgatagaatgtgaataccacagctaatgagcatcaactgtatctgaaggagcccgcttctgaaaatgattatacagcaagctccgggagaacatgtcaggagattggcaccctcttattgcaggaagacactttctttgtgcaatccaagcagactttgctcaggagaggacagtccgagactagaaggcagcagaatgagatggaaatagagatgtcatatagggagagagtataggaaaaagccaactgcagaatcaaaatccatatggtacagagtaagaggcagattttgttcaaggatgttcactgcaatgttgtttataacagcaaaaaaagatgtccaacgatgggagatgagctaaataaactctaatgtagacataaaattaaatatatatgattcaggccaggcgcggtggctcacgcctgtaatcccagcattttgggaggccgaggtgggcggatcacttgaggtcaggagtttgagaccagcctggccaacatagtgaaacccatctctactgaaaatacaaaaattagccgggcatggtggtgtgtgcctgtaatcccagctactcgggaggctgaggcaggagaattgcttgaacctgggaggcggaggttgcagtgagctgagatcacgccactgcactctagcctgggtgccaaaaaaaaaaaaaaatatatatatatatatatatatatatgattcagctattcagatattgtgtattatttattgacttaaaaggagtaagggaaaaaaaaggaagattcaagtgtaagtatgacgggtctgatacttttaaaaaatgtgcatatgcttacttagaaaaagctttgcatgattctattaacatatttagggtgtataaggtatataaaagttacttttaattacaaaatgcatctatttctgtagtgtttgaattttttgcaaaaaaatatattgatgttttacttgagttaaaaaaaaaaaagataaacatggaggccgggcactgtggctcacacctgtaatcccacactttgggaggccgaggcaggcagatctcctgaggtcaggagttcgagaccagcctggccaacatagtgaaaccctgtctctactaaaaatacaaacattagctgggtgtggtggcgggtgcctgtaatcccagctacttgggaggctaaggcacggagaatcgcttgaacccgggaagaggaggttgcagcgagccgagattgtgccgctgcactccagcctaggcaacagagcgagactgtgtctcaaaaaaataataaccataaataaataaataaaagtgggatgaaagatgttaccagtataaactgttgggcagcacttcttcctcttttctctcatagctcctggtttctactgacctgcagagtttatgaaactgctgttcccatctgtctgttcatgtctgtctttggattgtgaaccacccaagggcagtctgtatttctagaacctgacatggtgggaggcttctgtgagagaagatgctacctgcatttttcttgggtggatgagtggtaggcttggaagatggggcaggatgctggggcgccaggccgggggtgcagtagaaaattctgctctgtgcaaactcctgttcgtcagttctgtgacagctcccctctccttctgcctcagctccttgagagaaaggactgtgtaagtgggtgaatgaaaaactaatgaacttgagctcattcatttgggtgggccagacagcaccttaataccgattcagtaagttcaagcctttgagagagacttttgagttcaaggatgttcaactctttggggtgagcaaataggcaatggaggtggttttgaggtgttcaccaaagacccacaatgctggcgtcagccttgcatgtgttccccagggtctcccgggggtctcctgctcaccagttaaaggctttccttctcagagctcattgtcgggaagagaaagccgggctcctggctggaccagtgtcctcatccacgtgacgttcctggagctggacagatcccggctgaaatctggagagggatttgataaatgctctaaaccctcccactgtgtgcactggagttaatttaaaaaccagcttcacaaacacactcagaggcctcagaaggaaagcagagggcaggcaagagccgaggtctgtgccctgactcatccttcccccccggggcggggacaaacggctctgacatttcccggggccgcagcccccagagacaaacgaacggatgggccgtggcggagtctctggaggcgccggggcagccttggatggggcttgctggtcttggccggccgtgcgcggtggaggagggctggcgaggcggcagcagccgtgtactcgccgtctccgaggccgtggaggaagggatttcgtgtttctccctctatgaacagtcggagaattttcctcccataaacaaaacaaacatgagccgaaggggcggaggccccaggggcaggctgggtggccctttctttcaacctctctgcatttgtttctccgggggcagattgtggcagcttcttagagccccagaaagccgcctgtgggtgtcgtcatcttgcttggttaaccgaacacattgcctcttggtcctagccagggctctgctgttcctggaggagcggctgtgggccagctagacccttgtccacagaggcgagtggctctgcagaacattccacgggggtggcagaacaggtgcctcttggcatgggcaggcggcatggtggggtaggcagagcccccgggagggtcaggaagcagccacagagttttgagccacccacccacccacccaccagcttgctgtgtggccttcaccacgtctttctcatccctgggccttagcctccccatcttttgctccagaagtcgagctgggtgatttctagagtctctactcgctgtttgtttttgtgacccggggaggggcagctgcgatggtggagggcacccttctgaggccccctcctctccctgccctctttctctccccacatctctctgatttccccttatttcactgacaaagcttaaaatcccagggctttctgtagatagtggggctgcggaagacggtgcctgcctcggcttgaaaaccaggcccagaaaacactgccatccatcacgttctcattgtcacctaggaaggccccagaaggtcagcttccaattgcctctcagtacagagcgcgtttgtgttgcttggggactgactgtcctttcacagaacttgtgggaaaatacctcttctcttctccagaaaaggtgatgagaaaggtattatttagaaggtagacaggaaggagaaaggtggaggcatattccactctatgaaaggacgagtatgggattgaaatatttgtaagcatggggcacatcctattaacagttgatgtcggatatcttgtctgctttcaggaaggatttgtggccgaggtacaaggggtggcttttgatatgaaaatgtgcattgtggctccctgaatgaggggggtgggagagggctgggatggccccactgggcggggagaggagcctctgggagcgacacccggggaagctgtgaggcgtgaaagggtgcttttaggaaagtctggatcagacatgatgttataggaaaaaatgcagcgtctaaggaaacagcgcgtgaatagagagaaagccgagagacagggcagggaggcagagaggacataaagcagattggcattggcagccaggggaaggagctgcctggtggcaggggccacagactggagggaggatggcagaggacactctgcttcccagggaagggcccggcctggggcggaaacttgcagaatggctgatgacaccagtagttgggcttgcgctcctcagaagcatgaggacaggtggttcacagtgtcactggccctgggtctgcacctggaccaagtaaagcattacctcaagaagctttcatgtgggccgggtgcggtggctcacgcagtagtttgggaggccgaggagggtggatcacaaggtcaggagttcgagaccagcctggtcaatatggtgaaaccccgtctctactaaaaatacgaaaattagccaggtgtggtggtgcacacctgtagtcccagctacttgggaggctgaggcaggagaatcacttgaactcgggaggcggaggttgcagtgaggtgagattgtgccattgcactccagcctgggagacagggcaagactccatctcaaaaaacaaacaaacaaacaaaaaaaccaaaaaaaaaaaaaaaaacaagcttccatgtgcacggcgtgtcatcccctgcctccaccacccaactggtgggtggaggacagattccacagtaggaaaaagagtctctgcctgttggaaagggctgagaggtaccatctgccacctttttgtccccctcatgttggaagtgaaaagggacaggtgccctatctcagggctgcaagcaatttctagaaacgctcaagagcgtagctcatggggccatgccacgtggcctcaaatccaggctctcccattttccaggtatgtgtgaccttgggcatgctactgactccctctgtgcctcagtttcgtcacctgtaaaaggggtataatgtcagtgtctacctccaagcaatgtgaggattaagtgtgtgtgtttttaacagctttattgagatataatccacatgcctcataattcccccatttaaaatatacagttcaggccgggcgcggtggctcacgcctgtaatcccagcactctgtgaggccgaggtgggtggatcaactgaggtcaggagttcaagaccagcctggccatggtaaaaccctgtctctactaaaaatacaaaaaattaaccgggcgtggtggtgcgcacctgtagtcccagctatccgggaggctgaggcaggagaatcacttgaacccaggagtttgcagtgagctgagatggcgccattgcactccagcctggacaacaagggcaaaactctgtctaaaaaacaaaaacagaaacaaaaaccggttcagtggttttcagtatattcagagttgtacaaccatcaccataatagattttaggaccccaaaataaaacccatacccatcagcactcagtccccatttcctcccacccaccccctttccagtgctgaacaaccaccgctctactttcggtctgcctggatttgcctattttaggcatttcatagaaatgaaatcatataatatgtgaccttttatgtgtggcttctttcccgtgacataatactctctaggtctatccagtctcaaggttgtagcatgtatcagtactttattccttttcattgctgagtaatattccattgtagagatatattgcattttgtgtattcattcactggataagggacattttagttgtttccatttctttgccattgagaataatacttgctatgagtatttgtgtgtggacatgtgttttcatttctcttgggtatatgcctagaagtggaatagccaggtcctacataactttgtttaactttctgaggaactgctggactgtttttcaaagtggctgtaaccatcttatgttcccaccagcaatgtatgcgggttctggtttctccacatccttgccaacacttgttattatttgtctttttaaaaatgtattttttatttatttatttatttatttttcagacaaagcctcactcttgttcctcaggctggagtgcaatggtgcgatctcggctcactgcaacctctgcctcccgggttcaagcaattctcctgcctcagcctcctgagtagctgggattacaggcacacaccaccactcccagctaatttttgtattttaagtagagacagagtttcaccatgttggccaggctggtcttgaactcctgacctcaggtgatccacctgcctcggcctcccaaagtgctgggattacaggcgtgagccaccgtgcctggcttatttatttatttatttatttatttatttattagaaacaaggtctctgtcacccagactggagtgcagtggtgcagtcatggctcactgcagcctcaaactcctgggcgtaaatgatcctcctgcttcagcctctcaagtagttcagactataagcatgctacaccacacctggctaggttttaaatttttttgtagagacagtctcactatattgcccaggctggtctcgaactcctggcctcaagcaatctttctgctctggtctcctaaagtattgggattaaaggcatgagccgctgtgcctggcctggcctttttttattttagccgtcctactgagtgtgatgtggtgctcattgtggttttggtttgcatttccctgatggctaatgatgttgagcatcttttcacaggcttcctggctatttgtatacgttcttttgagatgtaactatacagatgttttgcccagttttaattgacaagttagttcttagaagtgcttatctggccgggcgtggtggctcacacctgtaatcccagcactttgggagaccgaggcgggtggatcacgaggtcaggagttcgagaccatcctagctaacatggtgaaaccccatctctattaaaaatatttttaaaaaaattagctgggcatggtggcgggcgcctgtagtcccagttactcaggaggctaaggcaggagaatggcatgaacccgggaggcagagcttgcagtgagccgagatcatgccactgcactccagcctgggtgacagagcgagactccgtctcaaaaaaaaaaaaaaaaaagtgcctggaaggagtgccttgcccatgggaaatgctgtgcaacttactattagggagagtacccaagacttggcacattgggcttctctcccccacgttaaggattttgggggccctgcataaatgtccaagcgtgagggaacatggtgacttcacattttctttagttttcttcaaatagtcccctacttggggagagactgcgatggtttctcccccacacaggtcatattcccacctgaccccttctgatttgatttcccccaagtccctatggtggggtgcacctgctgcctacatctggctgcctttggtgatgacttcagtgctgcttagtatctggattctgttcatctgcaagcgcccccaagaggctgctggtggtagtgtgggttgatgtgggcagagttggtgggggtcccagggagtccccccagccccttcccagcgtcatagcgacatggtctggggcttacattacccccatgttgtttttgtacagcaggaagctgcttgctacccaggtggccattcgacttcatattaaggtctcctttccattttctttttgcttaaaaatactcaggttttcacaagagtcacttcagttcttggtgattgaactcagctctgatttgacctcagcatttcaggtacatttttggctcttctggagacagaaaaccatcagggaccgcaaggattaagcctcagggtgaacattatcccaagtggtgggaccaggatggagggcttcccctgtctcaatacaggactgtgtggtgcgaggaaaaagaaggaagcggatggccctgtcggggggagagctggatgtcatcattaaaaatccctgcagccgcttgttcatgaaacccctcactggggatgaaactcccatttcctcccaaaggatagttttctccttcttttcctagaggccgtgtacattcaggttcaagttccttgtgactttcacttcttttccccatgaaccagcacgtccccggccgctccctctccttgatgtgcgggggtagctgatttttccttccacagtataatatctggcaattgcacctcatcctatttttgctctcctcccccatcttctctgttcatccgtgcctgcccaatgcgtgcttccccggtgatttttcccactcacccccggtgctccttttctctctgtgacctcttggcagttctgtgcatacgtaggattattgttattctggcactgtgatcactggcgctcactcacatgctctctgcagaggccccgctgcctctccccacattttttgtgcctgtgagccatgcagccatccgtaccctactccataggaatgtggcctggagggtaccccaccgggtcagctggtcagctgcactaaggccccagcccaggggtggcagctctggtcagtaacatgtttgtccctgagtggagttgaactgactccttggatgccacagctgccctcccacttacaaaaaagagcctccccacacacgtccttttcttccccaggcaatcccacacctacttcctcaaatcagtcctcctgtcaccttttcagacctcttgttatctcagccacctcccccaataccctccaatctgccagtgcccttcttgatacaggagagctggaatatgatctggtcagtgcagaggggatattatctttctctgtacgcatttggggttctagggagttcgtttctgagttacatttttttttttttttttgagacggagtctcgttctgtcgcccaggctggagtgcagtggcgcaatctcggctcactgcaagctccgcttcccgggttcacgccattctcctgcctcagcctcccaagtagctgggactacaggtgcccgccaccacacccagctaattttttgtatgtttaaagacggggtttcaccgtgttagccaggatggtctcgatctcctgacctcatgatccgcccgcctcggcctcccaaagtgctgggattacaggcgtgagccaccacacccagccctctgagttacattttttgaaagcagcaacactcccctaaactctagaatcctctacagtttggttcataactagcaaatggtgacttgaatgagaggctttgggattggggcaatgtctttatttcccagtgctcctcttaaccagattaaaggggtgctgtgaagtttgacctagtggaggggtgggtctcgggaagcattaaacaccaagcagtggttgggttgttaggcatcgcccagcccctcatcttgtgcttttgtttctgcttaaactatgttcttattgtatttttcatgtggcaaaggcaatatctatttggtgtagaaaaattataagatatagattaggacaaaaagaagaaaacgcaagtaacagtttatcccaccagccagagtgacgatgttaataccctgtggtgtgtctattgcctggtggacctttttctatttgcgtatgtttccactatatgcagtcatacttctttttacttaatacattgtttccatctttccactttattaaatagtcggctttgtagttttgcatggttgcatagtatttgtattgcattttgtgggtgtaccatgactccgttaatcaggcatttaaatttggacattttgctgtttttcaggttttttccactctaagctttgttgggctgagtgctcttttaagttgatctttgtgccattctcagtgtccccttcagataaattcctagatgtgcaactgtacatcttcaaggaataagcacatgtttaagacttttgacgcgtttgtatcttgctctcccccaagtcataccagtttatagagtgtgaattttttttctttgtttcctcaggtatattgcatattaattactctaaaaaaacctgttggccaacttggaagacaaaaagtgatatttgattgttttcattgatttgtctttgataattaacaagacaggttgaacatttttcacaagtttatattttgtgaatcacctatgggggcgttaataagttttccaaaaagatgaactccttacatatgaaagatagtaactttccgtccatcttttgtcctacaggtatttctcccaggttgtaattgactttttaaaatgtatggtgctttttgacatataaaagttaaagttgccgtctattagatacgtattttacagtttttactttcagtatcatacttcagaaaggccttcttgatcctaagattccataaatgttcacttacattttcttccagtaatctttacggtttcactttttacatgtacatatctcagtacatgctgtgaaagtcaagtgtaactattgttcttctcggatggttagccagttgctgcagcaccacttactacccagtgtgtcattttctctccatttcccaccccccattttgggggttctcattgtggactttctgtttgattaagttttctcttggttcctatcacagttctgattcttgtagtctcatgatacattttaggatgtctggaggctttgtaagtggtaaaacaccatgaaaaatgtgaagggttattcatgttgttgtaccagatctttgaaaacaccgggagcgcttactgtcctcgctggtgagagtaagtcacctgttttttttagagtttttcttcagggatcctgaagtgatgctgtcttctgaaccagcaaatgctcaggtcttcttagcaacctttggcctgtcccctgaccccaaccatcacgcagtgcctgccacctaggaaaggctgggtctgcgtcaccaggtccctctgttccatgaccacatctcataatcacatccatttttcttaaaaatcagcagcctcactcttctgactcatgttctctgacttctagacgcttttcttccataattgggtgtgccgggcacaatccttgttttttccttccagaggtggggaattcagggtggaaatgtggcagaggacgtggggcttcctcgctctgtccctgggctgttgccatgacagtcggttggacagacatgtcgtggtgtgccctcctccctccggcttctctccggattccacttcctgaactctgagcaggcctgtgggtgggaagccggctgggtggtctgcccagacttccaagagatgcttggccacaccttgtgcagggcctaatatgggcttgggccacactcagaccacactcagctgtgctttcctttccgacagtgatgacgatgatgacagtgacgaggatggggggctctgatggtgaactgggaatcctgcataggcctcctagtgagaagtcacagcttaatttaccgagcacctacctacctcatgccatgtcatagaggatgacagatgctgtggggaggtaaaaggaactcgttttgcagtgcttgtccttgcctggtcagccacggcggcagagtcaagggattgagctcccaaaaccctgggacatgacggcatcggtttacaccccgatctgcctctgctatgacacttggatggattgcttagcttctgtgtgcctcagtttcctcatctgtaatatgaggataatgcttcatagagttgatgtgaggattaaatgagtcggcatgtgtgtgcattttacagagcctggcacatgctacatgttagcagtcactctttgttgttgttagtgtgtatgtgtgtttcttttgtatacttctagcacgcggggagctccatgagggccttttatccaccttttatttttttaagacagagtctcactctgtcacccaggctggagtgcagtggcacaatcatggctcactgcagcctcaaccaggtgggctcaagcagtcctcccaccccagtctcctgagtagctgggactacagatgcatgccaccatgtttggctaatttttttttttttttgagacgtagtttcactcttgtcgcccaggcaggagtgcagtggcacaatctaggctgaccgtaacctccgcctcccgggttcaagcaactctcctgcctcagcctcccagataggtgggattacaggtgcttgccaccatgcccaggtaattttttgtattttcagtagagatggggtttcaccatgttgggcaggctggtcttgaactcctgacctcagatgatccgtcttcctaggcctcccaaagtgctgggattacaggtgtgagccactgcacctggctgattggctaatttttaaaaatctttttgtagagatgggatctcaccatgttgcccagtctggaacctatttgagggttatttatttatttatttaagagaggaggtctcactctgtcacccaggctgtagtgcagtggtgcaatcatagctcactgcagcttcaaactcctgggctgaagcaatccctccacctcagcctcccaaagtgctgagattacaggcgtgagccaccatgcccggctctttcatctttttttatattcatgatcacgtgaccttctgcagagtggatgctccataaatgtgtattaactgatgatactgatacgggttattaccatcacttactgtgctgggctctttatcacattatctgatttaatcttcgcagtctttacattaaatgttttgtctgttttacagatgagaaacctgaagctgagggagcctgagggacttgtcaaaggttgtctagctgacaaggggcagggccaggcatcgtccccagccagcctgattgcagaagcagagtcaggatggctgaatgaacgacgcatggggtggagacaagagaaatccttaagaaagaattagagaacaacatagcacttaatgaattgaataggatcatgagcagtgggtgacccagacctacctcattatcatttggtttgctaaggaaataaaaagagagatagggctgggcgtgatggctcacgcctgtaatcccagcactttgggaggccaaggcgggtagatcacctgaggtcaggagttcgagaccagcctgaccaacataaagaaaccctgtctctacaaaaaatacaaaaaattagccgggcgtggtggcgcatgcctgtaatcccagctactcgggaggctgaggcaggagaatcacttgaacctgggaggcggaggttgcggtgagccgagatcgtgccattgcactccagcctgggtgacaagagcgaaactccatctcaagaaaaaagagagagagagagagagataaagggtatggtaagttctgggcacatcaaaggagtttgaatgctgcatttggtctcctcaggctgatgctcctgtctggccccttctgctctggctcagtgtggctgttggggaaggttctggaaaaattagggcttcgcattcagctctgatgatgggtaggagggctgtggctaaagaggaacaggtgggaatcagcggagtcaagcacagatagagggaacaaaccaggtatactgggagtcgtggccttgagggcaccccactgtggaaagttgcagatatcagctcgagggggctgtatttggctgacttggcaatggggaaccaggatggtgtttgaatgaaggactcatgggctcattttcacttcgaggggagaagggaggctggtagcagggtaccacgtgtctcatgcatatcctggagaaggcctgagatagggcagccgtgcatggatcagggaggcggagggaggccctagggacatgggatcagagcagtgggcaggagtgagattgtggtagggccgggggggggcaggacagggagttaggattttattccaggtgtaaagggaagctaagggggtgtgtgttgagctgggtggtggcatgaacctgctatgttttaataagattgtcccggttgctctgcaggaggcaggggtagaagctgggaacagccaggaggccttggaagttttcaggtgggagatgacgggggcttggctggaggagaggtggtggtgagaagtggccccctgtgggatccgtgtggaaggcagtgtcaccagaactaggtgggttgtttgtgggagcgaaaagaaggaaagcaatgacccgtgagtccttctcaagggtttgtgtgactgaggagcttggtgccactcattagaggacacaggtcctgtgatgtaggctggcacgatggctgcctggtccctctttgtagcactggggagcgtggtgcaggctggagtgaaggacggttggagtggtggcaggtgcagagaagaggccaggctttgctgctgaggacccctggacacactcggtgtctactgggcacacttggtgttaaaagccacagtgggcacagggggctggagaggcaagtgaccaggtaccccaggcttcctgcagctcagacgggggaactagaaagtcctctgagaaaacatgtgccaccaccaatgattctactgatgggccagacatgagcggcttgggttggagctaattctaggatgcaggaagagagaactcaagttcctctaaaagtattctaggttggtcgggcacagtgatgcacgcctgtaatcccagcactttgggaggctgaggtgggtggatcacctgaggtcgggagttcgagaccagcctggccaacatggtgaaaccccgtctctactaaaaatagaaaaattagctgggcatggtggcacacgcctgtaatcccagctactcaggaagctgaggcaggagaatcccttgaacctgggaggcagaagttgcagtgagccgagattgcgccactgcactccagcctgggtgacagagcaagactccgtctcgaaaaataaataaataaataaataaataaataataataataaagtgagctgggtgtggtgatgcatgcctgtaatcccagctacttgggaggctgaggcaggagaatctcttgaacccaggaggcggaggttgcagtgagctgagatcatgccactgcattgcagcctaggcaacacagtgagactctgtctcaaaaaaaaaaaaaaaaaagtatcccaggctgccccgacctctgctcttcctgtgttccacctgtgaagcagggagaggtgttgagaggtgggtaatgatgatgatgcttctggcaaccagccctgggccaagggagccagctggagggacagaaatggggcttccctagcccacagctgtgcttggcccatgcacttctccttgtcccggtgcaaagcagtgagactggccctcatcttctccagcgtgccccattgtctcacactaccatttttggactcattttttctgtctaaactgaaggctgcacctggtcgttttccttggattcaaactgtgagaggaagacaactccaggatccttggtataccgggtccctgtggtgtaccgagggagaccctttgccaattctgaggggttcctctggaatgctccctcctggctccattctcagggccgcctggccagcgttcacccaacccgagtgcagagtgtggcaaaaatcagaatcttcataagatttccatgcactgagagaacaaaaagaaatggtccctggagtgaagcaaaaagcccattcgccatttatcccaagtgctgtggaacagaagaaagagcatttttaaaatgaaccaaggggcctgcagctctttccccaatgctgccctgtgtaacccaaggctgggcctgcgtttctttgcttgcagcactggggcttggctctgtgatccccgagtccctctccgcggtaacactatccaaggcagcgctcactttcgttgcctcggccagcaaaaagagagggcgagattaacaccctcaattacgtctttgcagaactcagacctgaggaaattgaaaaacactcaagccagcgtgggactgggtttagagggggtctgctggggacgccattcagggaattgctctttccaaggctcctgagtggctggggaggctgggcctcctccagcctcattaaaaggtactttacctggaaggccccagagcccaggtccaagcagagggaacagctgaggggaggtggtggagctggagcggctgagctgctgaattgtgagtcttcgtctggcttctggtctgagtgcctctgctcactggtccttcttgtttgcctgattgtttttcctcttggggaggagatggtccttttgagccccagcattctgagtgacagactgagtttcatcccatcaaaagttctgttcaggctaaagcttctgtgtatgtcataaggaaagtataaatgaaatcaggaatctcccccaaaagcatgtcaccctcggcgtctgcctcccctgaatctccgtttgcttctcagttaaggatgccgtgttttccatactgtcacctcccgtgccatttggaatgtggataactcagcatgcaagagagttccacgctctctctggacctcccggctgccgtctccccttctgcaggtgtgagcatgtgtgtgcagccattgactcctgagccatccttcctgtttggtggtcccagacctggcaaggtgtgggaacgtgtgcaactcgggattgatgaaatacagaaaatctcagcccaacagagtctgaaagctgcgagttcaccaggccagtgatggtgtgtaggcctctaccagcctcccaggcattggatctggaggaaggggccttatctgtgagtggcttcttgttggcatgttggtgataagggaccctgtgaagttatgtcttggtgcctgaaagccatcgagggcttgctgggacacgtgcaggggagtctggtgacacctgggtcagggtagtcagtggctgtctcgctgttttctacctgttgacagcagtcatctcataggtgtgggtttctcaccttcctgaggcagatggtgaagggagcagggcagattctttgcaggaggctggtatgggtttcactccagcaccatgggtcctcaggccagctctctgtgtccctgctcctccgctgtcaggtggaaatcatcctgaggactaagggaggcggcaggagtcccgtgccttgctcacaggtgataactgctcagggaatgatgcacctgttccctccctttcctgagtactgggggaggtgattaaagatcaggtgtgagaggccccgtgtctgtcctgcaggagttcacagtcttctttggagacctctttgttctccaaagccccacctggggtggccagctgcctcctgggcagccttcccctgggcaccccttaaactcatccactcagagccagatatgtctgttcttccagacctgccctcactcggggtttcttccttggtccttgacgtctcttggacaccctaaacaccccagggtcatcccagacaattccttcttcctcacgtgctggtgttcagccccaggtctgaacccctccagtggtttcttcctcctctgtcattaccctaccctgattcaggccctcagcccacatctaaatggtctcccaagctccacaccatctccccaccttgcaacgcctggtggcgtgatggttgtccttacctatcacatgcattctctcttgattctctgagtctcgagtgctttattctcaagttgctattgaggccagactctcctacaccagggagtttgctctgttccccctctgcctaagtctgggttgtgtacacccctcgtctgcactttccctaattctctgtgtgtgttccagtgatggcctccttgctctttctccgctctgccaggcacactcttaactcagggcctttgcactggctgtttcctctcctgacaagcatgctactcctccctgtgtctacatggctcacatcttaacttctttaagttctttaccttcatgtcattgactcaacaagggctccgtgatcaccctgtagaaaaccataacaccttttccaacactcagcataccctttcctccctcctgcctgatttttcttcatgacacttagcatcctcttatatactctatggtctcctaatgcgctgtgttcattgtttctcttcaatcacgagaaacagggatttttgtctgttttgttcattgccacatcccctgtgcctggcgcataggcttttgagaaatatttgctgaatgaatgaatgaatgaatgaagtgcatcctatgtatcctattcttaaatggtccattttggcctctcctccactagcctctgccctgcttgagggctgggctgtgctcggtttgtctgtgtttcggccatggtattcccttgatgctttttttttttttttttgaggtgaagtcttgctctgttgcccaggctactatgcaatggtgtgatattagctcactgcaacctctgctttctgggctcaagcgattcttctgcctcagcctcccaagtaactgggattacaggcatgcacctccacgcctggctaattttttgtatttttagtagagacagggtttcgccatgctggcccttgatgcttttttttattattatcatttttaagacggagtcttgctctgttgcccaggctggagtgcagtagcatgatctcgactcactgcaacctctgcctcctaggttcaagcaattctctgcctcaacctccctaatagccgggactacaggcgcccgcaaccacgcccggctaattttttgtatttttttttttttttggtagaaactgggtttcactgtgttagccaggccccttgatgcccatttgatgaatgactggtggtctcagcctctgtttcaatactctgtccgcgcaggagttagaccatgtcactttggcctctgaaaggctagattcctgggtggtttctccagagcactcatccagtccctcgtcacctggccgtggcctgagcaccttctcctctacccatcacactcacactctgggctcattctcctgtcactctgtccactaacaagccatgtactttcatgaacattacacgtttccacctccaaacctttgttcctgctgttccgcctgccaggaatgtcctcactcctgacatcctggaaaactcctatgcatctcacactagctttgaaccttctacccagcgcacaccttgtacatccgtcttctctagcagggacctactccctttctcatgcctactcctttgctagaatatgaacttttcacgtgcagctgccacaccctgttcatctttgtgccctttaatcctagcactgtgtctggcatgaggctgtcctggatgtttaataaatcagcaaggaaaagaatgacacgtccggccaggcgcagtggctcacgcctgtaaccccaccactttggggggctgaggcaggcggatcacctgaggttgggagttcaagaccagcctgaccaacatggagaaaccctgtctcaactaaaaacacaaaattagccaggtgcagtgacacatgcctgtaatcccagttactcaggaggctgaggcaggagattcacttgaacccaggaggtggagattgtggtgagcccagattgcaccattgcactctagcctgggcaacaagagagaaactctgtttcaaaaaagaaaaagaatgacacgtccacactgataataccaaattccctttaactgagggtcaaaatgagctgagtgtggcccagcctgactccaggaatatctgaaatgctgttggttaagcattctggccaaaaccttccacggactgtagacgctcacaacctgggatgaggtctcctcccctccaccttaacggctgaccacaccttcacccagtgcgagccaccgagagccctgccagcttctaagcctgggcaactatctagtccttctcctttccctgtcagggatctctgacactgcatgttgccagctgctcctgggggagtctgacggatgccaccaccgccttggtctgttaagaatctactggaggcctcagggaaagcagctccaggcttccggagaggtagtttggctgtggttctcactcacaggacctgttgtgccaagaccaggaggtcaggtgctcgcctaagggcttgccgaggaaggatctgggcagcccagcaggagcagggccatctctcctccttgctcccaggcgacttgctgtgtttgagctggggccttaggtttactcagcaggtggtgtctacacctgtaacgaccatgcagggctgggagccagggcgcatgcttaattcttgtcctggctggaaagcaagttggccgtggtcttccattctgtgcagggaccttctcattgaattttttttttttttttttttgagacagagtcttgctctgtcgccaggctggagtgtagtggcacaatctcggctcactgcaacctccacctcccgggttcaagcgattctcctgcctcagcctcttgagtagctgagattacaggtgcgcaccaccatgcccagctaattttttttttttttttttttgtattttagtagagacagggtttcaccatgttggccaggatggtcttgatttcctaaccttgtgatttgcctgccttggcctcccaaagtgctgagattacaggcatgagccactgggcctagcctttttttttttttttttttttttgagacagagtctcactctgtctcccgggctgaagtgcagtgatgtgatctcagctcactgcaacctctgcctcccgagttcaagcaattctcctgcctcagcctcccaagtagctgggattacaggcacctgccactatgcacagctaattttttgtatttttagtagagacgaggtttcaccatgttggccggctggtcttgaactcctgaccttgtgatctgcccgcctcagcctcccaaagtgctgggattacaggcatgagccaccacacctggccctcattgaatgtttaaaagccccactcatctcataaacaggattcccttagaatatgtttgccaggacccctttgttcctggggccaataacagctgtcctctttcccccagatgactgatttcttgccaacccctcttagtgataactgggtgctcaccctctctccccccagagcactccctccggtttctgtgcccggctggggttgcagctgcctctctctggacctcactggaaaatcagggattgactagattgggagcatggtccttgtatattagaatcacctggaactttaacagaactactcacgtcagggcctctctccacactaattaatcagagtctctggggtggggaccacactttttaaaaagctttccaagtaagtctaacatgcagccggggcagagaaccatgagaatagacagtctttctgctctgggcggccctgagctttcaggggttccaaatgttcagggcccagatgctggctgctcattgccctgtgggacccttctaggtgcgaagtgaacatgcagagacagtcagtgcatcacagagcccgctgagtttaagcctcaggcctggggtctttccatggctgttgttttctaggtatttgcagactggaaatgaacctaccaggacttctcaataaagcgtcttcctcctgccctgcttttggttctgggtcctgagaaaggtgagaaagcttattccagaactcaatagtcttgtttgggaggcctgtccctgagttccagacccagggggtgctgcctcctgaatggacacccccattgtcatgcagctgacacctccaacccccatacccagaccaaattctccgagtgctgtacctggacacgggtgtccccatccacaccgagggcccggtaaggcacattgtcccccagcccctgatgctcccggcccatcctcccttctctaccccattcctttgtctttgctcaccttgccagttcttcccatctcctgtctgggctgccctttactggctacaggagggtcactgttctgctggaaagtgtctgagagcagctgccacctgggtctgaatgtgtcccccagacccaacacctctttgcacagtcctgaacctgtgtctggctcttgcttcccctgcagccatcctgccaaccagaccacactaacgttgttctcatgcacggcttcctctggcctctgagcctttggacgtccttccccctattctcgggttgtctcctgttcccagcaatagttcattcgccactgtcggggtcaaccacttagtcctcttgaccatgagactctcctaagttctgaatgcagaggattggctgagatccatgcttcttggagcccattggcttccccttgaattgtcacgatggcccagcactgttgggttcagctggtgtgtggagcctctgctttttctgtagagactggactcttacttcttctaagctgttgtctcatctccaggttgaggttctagggctccctggagtaggcctggtggggcacttgtccttagagccctttcctggcaatctgttctggcttccagcattccagggcattggaaggggcatttaggagaccagggttctagccctgagtccaccattcactccctgagctcctcttcacacatgtcgactgagcacagcccatactcagagggcagcatgaacactgccaccccaaacgtgtctgtgtgcgcacgctcactcatacatgtgtgcacgtgcctactcaaactcgacacccatcctcctcactcccgcctgggaagctctaagcccatttcctcgtgtccccctggtgcgatgactcaggctgctttctggaatcttcctagagtcagtccccactcaggggaaactgagtcacagcttgacaagagtgggcaggaaatgctccagcaacagaccagcagctaggggcagcagagcaaatgctgccctgcacacctcagtctttacaaaaccaaaccaaacggagcctagctttactttattctgaagtggttcagagtggaggataataacactgttaagaaaagagtatagtgtggctgagtgtggtggctcacgcctgtaatcccagcattttgggaggccaaggcaggtggatcacctgaggtcaggagttctagaccagcctggccaacatggtgaaaccccgtctctactaaaacaaatacaaaaattagccaggcatagtggcatgcgcctgtaatcctagctactcaggaggctgagggaggagaattgcttgaacccgggaggcagaggctgcagtgagccaagattgcaccactgcactccagcctgggcaacagagcaagactctgtctcaaaaagaaacaaacaaaaaaagaaaaaaaagaaaaaagagcatagtgtaacaaacgcctgtgtgccagctcctagctttatcagattgtaacatgatactttctctgtgtgtgtgcgcttcatccttttattatttttttgaagaaattggtctttatgaattcctcctccctgccctagccttgcaagctgggaacacacactgtggagaggaccagaggtcaagccctcacctctcctcctgccacaatttcaggctcttcgcagtcggagcctgttcagacctttccttcctcactcctgcccagctccttcctcgtggcagaaagagggaaggccttgacagtcagcccccatcacttcagcgcacaaaaaggggtgtgtgtggattgttgagaaaaatacagaagttgactcctctctcaggattcctggtggtgttctcaatttttcctatgccattttcttggcctggaatttcattttctcccctcctccacacaccctgctcctatctatgctttaagacctggctcaaatgacccctcctccatgaagacctctctgatggctggcttagaaatagtctctgcatttcatcctatgttgtcagtgcctggaatttgagttttgttcatgcatcgtctcccactcctaccaggctgcaaactcccggggactagcgaccatgtctcctgtttgttctgtattcccacccccaccccatgccagtaatgatgcgaagctggtgggcagtgactgtctgctgagcgaatatttgattcctgaggtgtccccagtacctagaacagaactggcatggggtggacactcagtgaagattgtggcgtgaatgaatgaaccaatgaacagagcacagagtgccctatccgtggaggggggcatgtgtctctacctgtaagagttgaccggcggcctggcacaatggctcacgcctgtaatcccagcactttgggaggccaaggtgggtggatcacctgaggtcaggagttcgagaccagcctggccaacatggtgaaaccctgtctctactaaaaatacaaaaaattagctgagtgtgatggcaggcacctgtaatcccagctacttgggaggctgaggcaggagaatcgcttgaacctgggaggtggaggtttcagtgagccgagatcgcgccactgcactccagtctaggtgacagagcaagactccatctcaaaaaaaaaaaaataaaactgttgacgggcatcttgggtacttccggcatttccggccttcccggctggacttggtgttttccctgtgcctgatttcaggaatgaggtggatgtttcgggatggccaggccagggcccacgtgcctgcagtgagctcagggcgggctctatcaaaatcccgctggtccagtcctgaagtgcagtgggcaaccagatgtgctccacctccctccccagcccagccttccctgtcccaccatgaggtgagagcgggcctctgaagccacagggcctgctggtttgcaagaatccccggcgtgtcttttttccagtgagtgacttttaagttgtcttcagaatgattgctcaacttgaaaaccccctgggcgggtgtctggggtggtttggatcattgcgcagcatttcattcctttccccaaattgctcattatttcatttgcataaattttagtggtgagataccgccccaggcctaggaagctcaaatagacctcataatggggcatcagagacaagtggtgggggccccgtctggccagatcacgtgtctgcgatgttctcaggctgtgtcctggcaggagcgggcttggaaggaggacaacaatgtgctacttccagggggtaggtgtcctgcagggctcggtggctggaccccagacgctgcctctccctgacctcaacctgtccccccactctccgcacactgtcaccaagtgccctgcgtggatgggagatggaagccagacagagcctcattcccagctgggctctggcatctccttgtccatcaatccgtctgcacctacttattgggtgtgctgacagccgcgtgccgggtaccgcgatgaggcaggggtggggcagacaggggagtcaaagactggaggagataaggccaggcagctgtgttaggtaccagggaggggcagagctgtcagggctggggagtgggggattggtgaacctgggacctgtgggctgaaaatgggggcttgaagagagtcttggttggtcaggacccctctagggctgaccttcccacaaggtggctcagggtcaccagtccccttggtactctggctgctgggtggttggggcagtgagcagatgcatccagggctcaagtcccctccgatatccctgaatgtgcttttcacctaagaccattttccagtgtggcgtgtggtggaggctgggaaggccatcctggggcaagtctctggacaccatggaggaggggatttagctaaaaggtcttcgggggacagggactaagtaggcaaggcccaagcatagtctttcgtggaggggctcatgggggtgatgccagtcaggggattgggaaggttgtgggggccttgaatgctgagcttaggaatcgagacatgtcctttaggctctgtggagctagggcagctttctgatcagacaataaatgaggtgctttaggcctgttgacccgctgtggagcaggtaccggagggccaggcctgacgccatgggggtgtaaagtgggcagaatgagggcagagggagaccctaacaggaagtcatacctggcaccttccctcaccttcattggctccttctgaggcaatgcaccaagcaaaaccatatttcactgaatcctggcatggtccagggacagagcttgctgggacccacaggcttcagttccaagagaaggagtccacgctgccctctcaggctccagttttccaatgatttcctcatcatctccagaaactcagttaatataatgcctctcagtgtttactgagagcctcctgtgagccaagcttgcttttaagttcagtgagagaataggagagaaagaagacatcaccctcgtcctcagggactaaccataactatatgcagtgcaatttacattaaacatttttgggctgtgactcacagtaaaaatgtatttaccattatgaattattatctagtacatccatctacctacctacctactcacttatccatctacacctatccatccttccatcatctgttcatccatccattcattcagccatctatccatcgattcctccatcatttattcattcatccattcatccatcatccatccattcatccatcatccatccatccatctgtccatcatccattcattcatccatctatccaaaataaaagttcaatcaacccttactctgtggtccactcttatactttcagtttgcttctattttttttttaatgctgtccacgattcactaaactggtctcatgacctgctaatgagttgttagctgcagtttaataagtgatggccactctgaagagttgaagccagcatacatacactccttgttagattgtctaggagagctgtgttctcctgaaagaccgtcgggtggtgtgagctgtgtgtgctctgggccaccaggaaaggtggaggtcattgtgaggactgtggcgcagagcaggagctctgaagtaagaatggtgttacctgcagtgcagtctctgcaccccctgccctggtgctgtggcagaacgggtgctttgcctctgaaaacaacagaaggaaagcacaggctgaactcgttgaaaaataaaaacataaacttgaaataaaaaaatgcatctctgagctggcatttgttgagttccccagagtgaaagcagtgttcatggaggtgaacaagcaccagagccagatgtgtgtgtgcaggtgtgggtcagacccctatgacagtgagcccctgtttgacagcttgtgggactcaggaggccagaggtaaaggcagggcttcccccatccccagtgaaaagtccaacaggagttggccacgcaaaatgtaaaccctaaagcactgcactctcaatgtaagggccagtgagaaatgaacctgtcatgtaggaggggagagtgaagagaccagtgtgttctgacctttgtcctgcacaggagggaaaaggtcgtctctccctagaattcattaccaccggccagctctcaggcaggctgaaaacccacatttgtgacccctgtgccagtctaagatgatggtgacttggactagggaaagaagtagcaagatttgggagagaattaaaagtaagagcacttggtgatggattgattaggtaatggggtcaggggagtgggcggtgacagtggtgactggatttccagcttgcacgtgtgggtagatgaaagcatcatttcctggaagacaactggatttgggagggaatatcatggctttgatcttagacaccattaagtttgaagtgcttttgagcaatctgagatgtggggtgggcggttggatagacacgtcagaagctcaaagaagatgtggggactagagatatatatttgggagtcatttccccccgagaagacagatcattgaattgggggagattaccaagggagatagcgaagtaagaggagagaaggcccaagtgcagctggaagaacgccagctttaatgaggggggggagaagggcaagcatgaaagggaggcagccctggaggaggaaaaccaggcatatgtgctgccaggaaagtcaaaggaagagagggctgtggaagagatgcggtgaactccgtcaagcctgccgaggggcctagtgagagaggtggatccaacatgagttggattttgcaatatggcagacttaggtggccttagcgtgggcgtcctggtgggataacagggcaaagaagatgcagcagagtggacggaaaagtgagtgggaggcagcaccatggaagctggggagagacagtacctagggagatgtggggttggaggagggcttgcagagaggggagcagtctgagcatgttaactaggataggagttgggatgaaaggggacaagaggaagaggctgtgtgtgtgagagagaagggaaaggtgacggtttatgtttcctgaagaggcaagagggagtcggatccaaaacacagttggggctgggcacagtggctcatgcttgtaatcccagcactttgggaagctgaggcgggtggatcacttgaggtcaggagttggagatcagcctggccaacatggtgaaaccctgtctctactaaaactacaaaaattagctgggcgtactcaggagttcgagaccagcctggccaacttggtgaaaccctgtctctactaaaaatacaaaaaattagcaggcgcctgtaatcccagctactcaggaggctgaggcaggagaatcgcatgaacccgggaggcggagcttgcagtgagccgagatcgtgccactgcactccaggctgggcgacagagcgagactccatctcaaaaaaagtaaaattagctgggcatggtggcgggcccctgtaatcccagctactcgagaggctgaggtgggagaatcacttgaacctgggaggcggaggttgcagtgagttgagatcgtgccattgcactccagcctggacaatagaataagatttcatctcaaaaagaaaaaaaaaaaaagaaaaaaaccaaacagttgggggaatgggcctagatcggggaagaaaggtgaactgccagacaagatgtacaacctcctgcacatcttacacagcagaggtgtgcaacctgctgctggccatgccttcaccaggaggctcaggcttagccagcagcaggtagcagaggttcttctctgtcagcttccttttcttttgagaataggaggtaaggatacacctgtggagtgtgaacctggagaaggaagatgatgggaggggggtggaggtttgaagagggcggggaaggcttgaaatagggaggtgggtgaaagtgacacatctcaaggactgatttattcattcatggacttaatagatatcaccgtgtactatgtgccaggcatgtctctaggccctggggttaatctgtgaaccaaccaaccaaccaaaaagtctgtccttatggagcttacattctagatgagagaagcatagtagatgaattagtatatgaagtatgcatgtgctataatataaccaacaaaatcagtatgtaaagtatgtagatgctataagttgatgtaatgaaatcaatatgtaaagtccgtgtctgctgttagatgacgtaataaaatcaatatttaaagtacacatacactctaaaaggtaatgtgcagtgaagaaaagggaagcagaggagggtgtgggtttggtattttaagtggcatggtcagggcaggcctcgctgggaagtgacaaatgggctaagacctggaggtgatgagggatgaagggcagccgtctggggagactggtggtcatggttttctgaaagtatccatctgccctgtgtggctttgtccagaagggctgtctgtctggacgggagtagaggatgagaagaaggtagcgataaagggccacagactccagagcccggggccttggcctggatgctgtcggatggcagcagggggaggagtggagagaaagcagaagcatggccaggaagctgggaggcatgagcctgggaagagggggaccagcctgagccctgggtggggaaagggatcccctgggagctcacgggggtgcattttgctatctcagccgttttatttgcctgcaacaggggaatattgaggcaggccaggcagcctgccccttctccagcatcctcactttgctgtgcccttttggtttttacattgcctgctctgtcttctacctcatggtcaaactgtggctctctctcctgaattccatgtaaatggagagtaaagacgatctagggatgggactctcctggtgacaactgttttggctgctcagagaggtgtctttctttctatgttgttcttgactgtgttctagatggtctccgttctggaaaggagaggttgtcacaatgagaatctcttaaaatggtgggtatgagcaaaaccatgtcacgccaatgctggaacagtctgtcttaactgggaggtccctttgcgatgagctagctttacttcctaagggactgaggtctgcagaggccaagggtctccctgggtcaccctgtttgtgatgttcccctgacatggaatcctaaatacacctttacctgctttttttttttttttgagatggaatttcgctcttgttgcccaggctggagtgcaatggcacaatctcggcccactgcaagtccacctcctgggttcaagcgattctcctgcctcagcctcctgagtagctagaattacaggcacgcaccaccatgtccggctaattattgtatttttagtagagacagggtttcaccatgttggccaggctgatctagaactcctgacctcaggtgatccacccatctcggcctcctaaagttctaggattacagacatgagccactgcgcccggccgttaccgtcttttatatcgatctccccataatgaactcatccagtgcacaaaccctcctgtagagccatgtgtccagcatctagtaggtctcccatagctgcctggacctgctgtcaggagtgatcatcgtaacatcaactactgttcccctgggtcagccactgttgacagctgggcaccattactgtcctcattcctagataaggaaactgaggcatagaggtgatcaaacacacccaaggtcaagtgcacagtgctagcctgagacacacaggatttgaactcctgcatcggctcttgactcccctttgtcacctccaagttgtactgaagttgaggcttaggctcccagagggtgtgggccctgggctgagtgttttatgggccttatctcatctgataagagggtgcttgtaattactcttctttcactgaatagcaaagtggacaaggagagatcaggtgactggcgcaggccgcataggtggatggaaggctggaacaggccccctcttagcacctcgctccccggcctcccagcctcagtggggtttgctgacgaaacaagcgagcacatggaggaaatgcggtccagcttctgcctaatgaatcccgctgtttcagcctgtttgcatttgtcaagttaatttgccttccagacagaaccacagaccagtgtccctgcctcctcgagggtgggagggaccccaggaccccctggagaggcacacttgaggaggcagacacaccggtctgtggtctgtaccccacagctatctccagctccaggtccagggagggccagaaggtggagcggcgggggccagtggcgaggacagtgcgccaccccccgaggctggccggctccccagctgaggcaggcgcatgaaatccgaactctggagggaaatttactgcacaataaaggaagaatggcctgctttggggacaattaaatccacattactgtggaattacagaggactcctggggaattagccacatccacagcagccaggagcaccagggccaagaaatgtggggcgttcacatgtgggttccctccaaccctgacttgtactaggaacctgtcttgttcccaagccccctaattttagggtaagaaaaaacattttcaaagactacctgaggggaactaatgtcataaaacaacgccaccgggcccagtgtgtatcttaaatagatctattctggtcacaaaaccaactgagtcacagggtggaggtctggggaggactaaccccctaccaccccatttgcagctgggggagaagaaagggccaggcttctgagcagagtgggccaggcgtccagtccctgtcactcctgtgagctgtgtgagtccagccagggtctcgacattattttctggcttcctttaattggatcaaagtaaagttgtaaagtatggggtgttggccaggcacggtggctcacacctgtaatcccagcactttgggaggccgaggtgggtggatcacctgaggccaggagtttgagaccagcgtggccaacatggcaaaaccctgtctctactgaaaatacaaaaaattagccgggcgtggtggcaggcacctgtagtcccagctacttgggaggctgagccagaagaatcacttgaacccaggaggcaggggttgcagtgagctgagatcggccactgcactccagcctgggcgacagagcaagactccatctcaaaaaaaaaaaaaaaaaaaaaaagtgtggggtatttagaagaacagatgtgtttgtattcattttccatccaagcctctgcgggctggaagaagataaggagactgtttctgaagtcacaagttgggcagcttgagctgtctagggtttgggagacccctgcgaggcccttgtgccctttcaagcacattcctcagttctcttcctgccgtaccttcagcagtggtgcaggcatgtatggacagagacaggaggcaaacagctgagtaaggtgcagggaggggacactaggatccagggctcatgaggaggcttgaagcataatgacccaggggtgcctggtgcacagagactgctccacgtgagtcatgtgtcactgttacggtggctgagtggaagtggcaggtgtgaactgccccagctttgaaggctgccctcagctcccacctcctgccctgagctcatctcattgttctctgcattttctttcttagagctcccagaggcccctcactccttctgggcacagacttcctgcccattttgggggtgagtcctcaaggaggggaccaccttgcttatgcataccttggtcctcagtcctgaaacaagcagccaatgcactcctacctcccatcgccttctgctggttagcagggctggaggggacctgtgggtctttagacacaccctgggggtctttagacacaccctggggctcctggcagccatgccctctgggtgctgagacagagtgaggcgggacaatgtctctgattgctagtgagctagggatttggcccgtgctattggctctcaaaacaatttggaggaggaaagtgaggggctaactcgccgcaggactctcctttcctggtcagtcccttgttggattcttgcctgggagtttcagagccagcgaggcactggggttgcttactgtccccatatgtggaggagatgtccaaaatactcagtagctggtgcttctgggtaataccccggcatcggtgttgagatgctggccatagacagctgccttgctacctctctgtggaagatcagtctgccctaaagcttttgaacccccaaaggcctgttcagaggatgttcagctatggagccaccatctctccatgaggaagagcttgtggctttccccaggctgttttccctggctgtactagataactcaggacatcattgcagaaggacaatttggattcttcccgcatttgcccacagggaagctctgctgcgcagtccctccccgtaaggactcagggtcatttgcagactggaaatcccttccattagctcacgtgtaagaatattagcaaggccatttgggaggccgaggtgggcagatcacgaggtcaggagatcgagaccatcctggctaacacggtgaaaccccgtctctactaaaaatacaaaataaatgaataaattagccgggcatagtggcgggcacctgtagtcccagctactagggaggctgaggtaggagaatggcatgaacctgtgggcagagcttgcagtgagctgagatcgagccactgcactccagcctgggcgacagagagagactccgtctcaaaaaagaatattagcaaggccaatgctaacctcaaacctgtaaggatctgacatcccagaggcaggaaatgtgtcttctaaggctctctgagttggaagggtctcgatcagtctagttccacctcctccccagagccggagtctcctgtaccgtatttttctacttgaaggtctccagggatggcaaagtcactgtcccccaggggtggcccattctagctcctttggccagctggaatctgccatcccctgtcttatcctctgtttgatggtaggccacctaaaatctttcattaaatctcatagacactttactgagctctaaatgaattgtacctagtggtttgattaaaataactggattcagaattggggttcagattttgatcattttcaccacaaagcatatcatgatgaaaatggctttgtttgggtacagatttggggccactctggccatacttgccttcctcccccttgtgtctcctggaactggagtgtgattggttccacatggggatctttgcatgtgaagtgggggcatgctaactagtgacagggcctcttgaggggctgggtaggggcagaggggcgtggtctgtctgtttggcattgacggccctgcagacagtgccctgcaactggaaagcagtttttgggtcatccaatgggcagggtcttttcccttctcacaaatctccacgtgctcctgggcacaggtatctattcttgttcagcagattgagagagggaaataagggaacgacaagctggtgctaagcaaataggaactgaagaagcagacaaccctttgagttaagaaaaacccaaacaggactcttctctcctagacctgttgagttgaggggcccttttaacctcttctgggacttgtggagactgaggaaattaaagtggctgttgataaaaaaaaccgttgcgtgaaatcgtacatcttaggcacagcccaagctgggtagggatctggtgtgtcctggaggtagcactgacatgccagtcttggggcatacttttactaaaaatgatttgtgccattcaaatttaactgggtgttctgtatttttatttgctaaacctggcaacccgagtctagtcggagagtgaattaggaaactgagaaggcgttttggtgttgtcctggagtggcccaatgggacactggtttctgttgggcacacgggggtccagcgtgcagattgggaccctggtttcaccctgtccctgtccacgagcaggaatcttgatctgttggtcacacgggggtctggtgtgcagtattgaaccctgcagtagttttggctgcagtctgggctggtctctggagtttacaacccaagtcaaagttaactaaagagatgaattaaataaaggtcaagcagggagggatacagcccatgggggtagaggggaacaaagggctggggaaggtgtcctgggaattgcatgttttcctgcctggtgtctggagaacagaatcaactgcaagtcattaagcctcccttgcaccagcctctcccactgccctggagtcccgccttgaatctccagcctggcaagtgcctggcttagtgacgggagccattacagatgggaaatgactccagggagccaggagccaggcttggccggcttggctggcaaatcagccctcatatgtccatttcataaagcacagggagtgtatgcaccacctctagggaaaagagattggaaggaaccccccccacacccccacacacaccctgctgccaccccccgagctgctaaccagacatctgggcagggcgggcaagtcacagagcaaagagaatttcatggcaacaaaagcttccgggagaactttgctcagacaatctcttccagtttgaaaattctctgccttcaggaatgaattccagcagccacagggttttatcaggcttctttctgcctgagaccatgtcaccctcaccatgctgctgggggtctggaaagagctctgaattagtttggtgaagtgttagtcaccattcactattgccaggtccctggcaacatctctttgcttcttgggaccttgttcttctcatctcttcttctacaagagggtaaactaggaaaccctggaaggctgcaccagccccaagaccctgggtttgtccttagaacaatgtcccccttccttcttttgctgatagatctggagcttggagaggactgggtgggatggggtgaggtttcatgcagggtcttattataaggaaggagcagggcaaggcactgtggtgagcacctgtaatcccagcactttgggaggctgaggagggtggatcacttgaggtaggagttcgagaccagcctgaccaacatggtgaaaccccatctctactaaaaatgcaaaaattagccaggcatggtggcgcacacctgcaatcccagcactttgggaggtcgaggagggtgcatcatttgaggtcaggagtttgagaccaccctggccaacatggcgaaactccatctctactaaaaatacaaaaattagctcagcatggtggcgggcgcctgtaatcctcagctacttgggaggctgaggcaggagaaccacttgaacccaggaggcagaggttgcagtgagccaagatcacgccactgccctccagcctgggtgacaagagtgaaaccccatctcaaaaaatacataataaataaataaggaaggaaggagcaagacctccagtctctggacccccactgtgaaactgtttttgtcctgaaaggcaagaaagtttgcatctcatagacagtgggcagccatggaaggttccagaacagggcagtgacaaatgagaggaatgtctgaagagggatttggggtggcgggctggttggaggtggagaaggcgtagagttgtgcatggcacatagagggccagggctaaagtccccgaaggaggtggcagagagagcactcaccctctgcctggggcagaggctccggactggaacgtggacggaggatctgaggaacgcagcagacaaagaactgatgactgctcagggcttaccaaagcctgctcggcatttcctccaagagaggggcccgcccgccgggcaggcggagagaaggatgtttgtgcagcaggaaccctgagtgattcttttgcagcaagggcctgggacatgttcgttaggaggggattgtttcaaagccttagggggaggcatagcagccaaaaaagggcagggaagagaaaaggctaagatgtttacagagaaaaaaaaaaagtcagtggaaaaaatgacggcgaggtcaagcagatttgggggatggcccccgctgtccactggggaggggccgggtgcccggcacagcgggagaaagaaccacagggcctgggctgtgctttttggagagccgagcccgtgaccccggtatccttaatcctgcccgtggtcctgatcccaaaccccacgaaatgccctctccggtctgtttgccgccagcctctttgcagggaccacgtccatcagttggtcccccctggacatttctgcttgaagaaggagacaggactcaccagacttaagacttatctgccccccacccctgtcccttcccccagaagcctaagagggtctggctgcggggtgggaggccaactcctagcagcccttttgtctgacatcttgacaaaggggctggggcctttcccaagccccacaggtgtgaagaacttgttactgtagtgtttattcagccctattagtggcctgaaggactgttgacagaaggcccctttgtgttcagacttggctaaagctccctaagccctcgacaaacacaggccacttatctccggggactttatcagaaaccatctaaagcctgtctttggcaagccgggaactccagcctcccgtcccactctgactgtgactccgggcactgaggttccaaaacacttcccactttctttcatttttcctaccaccttgatccacccctcttccacggcatttctggtatcagagataaagcacaggtggtggtggggagggggaagggagggtggacagaaattctgttttcaaattggaccctaaaaactaaatggagtggccctgcaggcctggttctgaaagagagacttaagagaggtgtatgggctcctctctgggagaacttggcttcaggggcctctaaggctgaccacggagggtccctgtggagaggtgaagccagctggacttcctgggtctgctggggaattgggaaaattgtctgtcttacaagaggattgtaaaacacaccaatcagcactctgtagctagcaagaggattgtaaaatgcaccaatcagcgctctgtaaaacacaccaatcagcactctgtaaaatgcaccaatcagcactctgtaaaacgcatcaatcagcccgagtctaaaagtagccaatcgcggggaggattgaaaaaagggcactctgataggacagaaatggaacatgggcagggacaaataagggaataaaagctggccccccgcgggccatgagtggcaatccactcgggtcaccttccacgctgtggaagttttgttcttttgcgcttcacaataaatcttgctgccgctcactctttgggtccgtgccacctttaagagctgtaacactcaccgccaaggtccacggcttcattcttgaagtgagcgagaccgggaacccactggcaggaaccaactctggacacactattgctcactgccctctgctaaatccccctgctgtgccaccgcatgcccaaaggtaaactccttttttctcccccaaaatagtttcctctgcccagttccccggagaggatcctgcacacccattctctctgaaagacccaggtggtcatcagtcctgttggccacgcccctctgatggttcccctgggaaggctcccatacctccactttcagcaagggggaagcctgcagggtcatcccgccaccaccccagggccatggcaattcccagctgtgatccacccgctgcctggaggtggtcttagagccctttccacagccctgtcactggcttccaccctgaggcttcttcacagcgtcattacctagcctggagcaccccacttctgaattccagggtcccctcccaaaggcctccatgctgatgtgagtctgctgatctgtcccctaccctgcaggagtttgggtatcatgagttagacttttagggccagaaaataacttagaaatcatcagacgcagatgtcttcatttttcagatgggagaatgggttcagaggggccaagtgggctttccaggtcacacacctgggggagtcgcggagccggagctagagtccaggcttcccacatcaggccccagctctctttcctcttgcttgcttgtgaggttgtagccattgtgtttgatcttggttagtaatagtgacactccagggggcggccaggtgcggtgcttcatgcctgtaatccaagcactttgggaggcctaggagggtggatcatctgagatcaggagttcgagaccagcctggcccacatggtgaaaccctgtctttactaaaaatacaaaaatgagccaggtgtggtggcacgcacctgtaatcccagctactcgggaggctgaggcaggagaattgcttgaacccgggaggcagaggttgcagttaggtgggcacatcacctaaggtcaggagtttgagatcattctgggcaacatggtgaaaccccgtctctattaaaaatacaaaaacattagcagggcgtggtggcgggtgcctgtaatcccagctacttgggagcctgaggcaggagaatcgcttgaacctgggaggcagagcttgcggtgagctgagatcctgccactgcactccagcctgggcaacagaacaagactctgtctcaaaataaaaagaaactctgggggttgactcagctctgtgtgtcttaggagggaatgctggtgaatctgtgcacccaagctggagcatcatcacaggttggggctttgagaggggtttgtttggtagctgcttgaattaaaaaccacagctcaagagaaggaagagggggccacggtctgttgagagagcagaatgcagcaacgtcagccctatggcaggcgtgcttcccactcagagctgggcacttccaaggtctccgttcatgtttgttgaatgaagcaacgaacgggcagtcaggtagaagcgggtcctgttttggtgtccttgtggcatctcgaagtgccacatcttccctcacatggtctctggaactccagagagtcccatgggacatccttacctcgcctggctctcatgccctgcgtggactgactctacctgttgactcttttctttcagacaagtgagttgtccagttctcctggccatatctaggagactgtttgtcaatggtttttaaaatggttgaaacgaggcatcctcaatgagtgcaaaccccagagccttgagtggaaccaactactcctgtgtgatgtcctcacggtccccgtaggggtcatccagtctcgtgactccctctggctggtcactgctgcattttatctggctggctgatgtctccagtgacgagccttaagcctatgtttgggggatagtggtggacctgggagtgagaccacagcggcagcagcattaaccagaccttagcatgcccaggtatttccaccgaccctgccagggcagggaccatgattgtcctgctcactgtgacgtccccagcaccttgcatggtgcccagaatgcaccaggtaggggctcagtaaatacttgttgaatgctttgataaattcatgccctaccagatttgctaatagtgaagtaaaacctaagtctgggcttggattgttttataaatgtatgtatatgtatgatcgtttctcttatgcccagctcacctgtagacacaaaaggctgtgagtcccagaaattcttgggccagtcctgcctcggcccctttcccaaaaggagccctttgagaggttggctcagaatgatccccaggtgtgggcgggagttaggtgtgtgggcagctggagttgctccacccagccatttcaggagacgctgaaaagggggctcagaaaaacacactggaggcggaatacctaaaatttataaacaggagctgaacaatttctaaataaatagcataccaaatggagcagcaaagtaataaaggaaatacagactacctcaaactcttaaaaataactctcaagtatttttatgattctgaaccagtcatttaaggagaaatttctcttgaaaccaggcatctgcccactgccccatcacaggcccctgcggttgaacctccctttacctccttgcaaaggctctctgtccacacagtgggtcatgtcccaactgggttcttttccattgagttccagttccatccctccccatcagagcctgcatttgcacaggatccccaggtgaccatatgcacgttacagttggggcagcgctggcagaatatcccgtctgtgctccgactctcttctcaggccctgtcctctccccgttgttccagagaggtccagaagaacggcctccttgagtgttagtcttgacagctctggtcaccgttgaaaacagtgcaattactagaccactgtccatcttcccctgagccaggaaggaccctgggacaggactccatcttgcctgccgctgtcacaccagcacctggcccttttaaaggcgtcagttaaagctttgttgaaggagttaatgacagtcacctcctggagcagctttctttttcttttttgttttttttttttgagacgagttttgctcttgtcgcccaggctggagtgcaatggcgtgatctcagctcaccgcaacctttgcctcccgggttcaagcgattctcctgcctcatcctcccgagtagctgggattacaggcatgtgccaccatgcccactaattttgtattttttagtagagacggggtttctccatgttggtcaggctggtttcaaactcctgacttcaggtgatccgcccgtctcggcctcccaaagtgctgggattacaggcgtgagccactgcgcctggcgctcctggagcagctttctaagcctcagagtttgcacttagagaacagcattttaggcaaaggggattaaacatttacataccctggaggcggtgggcgtcatgatctccctaacccaggaattctcaaactcagcactatggacatttggcaggctctgtttgggggaactgtcctgtgcattgtaggaagtttagcgacctctctggtttctatccctggatgcaaacagcccctccctccccagtcatgataaccaaaaatgtctgtagacactgccagatgtccactgggggacaaaattgccaccggttgagaacactgccccctctccctcagggaatttgtgagttgtacatgctgagtaggtctcctggtccttacccaggagccatggacttacctagcagaggagctggtgagggaagaagcgccccccaccgacctgcaaatttttgccatgtcccaacctgcccatgtggcctggacatgtggaaatgtgtcaacaatcatgacagatctgagagcagtgcctgtcccagtgcgcaggcagccaatggctggggcctgcagcctgcgatggtgcctgcgtgagttggtttttttttttttttggagaattcagccgttatgctacagagataacatggtcagtcttctcaaaagaactgctctggaaggagaggacatggtgatcctgtgtgctggagggctgctgtggggtactgggccccagactagagcctctgaggagacccatcaccaaatggccttcctgctccagtgagaagcccctgggccatgtgaagtctgggggagccaggaccagagtccctgagagacatggtctggaaactgctcaccaatgtctgctggatgctttctggacctggggtagtcctgatgggattgagagtaagttcgccagggtcttttggggtgggccaacacttatggtttggtaaattcatcaaaaacaatggatgcagattcagtctctgtgtgcaagggcactacttagagttccaggaagagtccaggggacttagatgtgggtttttctctctaaagcacagcagtctacttgagcagacagaagttaaattgatgagttaaagcagttgaaagcaacaatcagatgtcgcaaggctatgccttgtcagggagtggttcaggcagtaaatcctctatctgccctacctgtctaactatctaactgtctctatacatacccgcttgcctgtctacctgcccacctacctatccatccatccatccatccatgcatgcgtccatccatccatccatgcatccctccctccctccctccctccacccacctatcaaccccatccatccgtccatccctctctccatctatccatccgtccatccatccaccttttcatccttccattcattcatccatccatctatcttctctcttgtttgctttctgtctctcatttgcacaacaaaaatgtatgaaggctttctgtgggctggaggatataagagcaaacgctgtccctatcctcagcaaaccaacacagttaatgagagattagtcccacttgatcagagaattttctgacatgagtttgttccctccattagatggggaacccatggatagttgagagtgcattgtccatctgtgtatctcacatagcctgtagcacagagctgggaacatagctagaacactgtgagtatgcactgaactgacctgacctggggagtgggaaggggttgagcagttccaggttggtgggagagggagaggggcagaaaggcaggaatgttgagaggtaaggagtggccacaggcatgtgttgaaataggacttagaggactttttgatgggggaagaaaataggaacccacctcttgggcctcttttcctactgggtttctggttggaaagtggggcctctcgccctcctatcttccttaccctcgttatgccctgggtctgaaatgcagccacatgtgatgcatccttggtgatcctcacatgatagccaaagaggggcacaaagcttggggtgtctgtgggtgtctggggtacccctggataagaggcagagcctcaatggcctaggcagtgcttctgtccttgcccctgctggtccctcaagagtgtctctgccacccccaacccccttttctctgggctgacctctctgttctcacaaagctgccctttcctccctgtcttgaaatctgataatgaaactaatacccaatatttttgcctccaagagatgcaggagataaacaggaaggcgcgaaggattaaggtgtctctctgaggaaggggctagggacaggccgggagttgggtgacgcctctgtgtggagccgagggatccagatgtgagctgctttgcccaacgcatttttccatctgtgcagagaaaataaaacaaagagaaaagaaaacaagctgtaaaatactttgcagaagtctgagcatgggcatttgccacttgatgtctcctgacagctccaagaagcaggggagggaagggagccctgccttttgatgtttgcctcagagttttcttttgtgtgaccagttgtttaggaagaaccttttgttggcgtaaggtgcatatggaagagagctaccagcccccagcttcctcctggggtgggaaaagtggaggctgagctcccagaaggggctcagaggttagggcaggcccctctggaaaatgcaggagaaggacatttgcctccaagaaggacaggatgatgctgttatcaggcctttcctggtacaagggaggcctgaggaagtgaggcctgggtgatccttccagatccctgtccccaggcaggtgttccagttcctgtgatttctgtgcttgtaagaaagatgtagattctgactgtagtctaggccagctgttacttccagtgataggggtcttttcctctgagccagtggaccaggagccagaagggtagggttcccatcctgggcccccccatttactggctctgtggtcctgggctggttggtcatttcacctctctgagcaggcccctgtcacccttgtctggcagagtgagtccaaagagagtgagtgtgtgcaggcgtgacagtcgtctgcaggagggcaaggtgcagctgcagcctctttctttgcacttggttgaactcagccctgggaacacttgccggaggacagttagcaaggttctgggactcatcccctggtctaatttggcttctggctgctttcagacttcagggcaggagctgtcttttctcctgcatcccacactgctttttctagggccctgtccacctctatttgtaaatgaaatgactaatgggtgagtgacttggcagtgactctaggaagagcacttaaagaagcttgtcataacatcagagagaaaaattaaagaggcacatgtttttctaaagatcacaaattaaagtaacatgtgaatgagaaacttaaaaatatttacagcttatatggcagaaaagacaaacaatgtttaatcctcctgatcactagacagcatgaaaaaagtccaccttatttgaaaactgggcaaatggcatgaacaggcaatgcacaaaaaagaaatataaatagaaaaacaatacatggggaaatgcccaaccttcctagtaatcaaagacatgcaaattaaaatcgtctgtgtgtgtgtgttttctctcagacagagtggccaatattttttaaaaagaatgccgataccaaatgcatattattattttcaagcacgtggtgaaataggagctctcatatcctgctggtaggtgtataagccagtacagcctttcttgagggcagtttggcaatttggtgccaatgttaaaaacatgtagaagggctgggcgcagtggctcatgtctgtaatcacagcactttgggagaccgaggtgggtggatcacgaggtcaggagtttgagaccagtctggccaacatagtgaaaccctgtctctactaaaaatacaaaaaattagccgggtgtggtggcaggcgcctgtaatagcagctactcgggaggctgaggcaggagaatcgcgtgaacctgggaggcggaggttgcagtgagccaagatcacgccactgcactccagcctgggctacagaacgagactccatctcaaataaataaataaataaatataaataaaaatataaaaacatgtaggttcaaaattcaacccagtaattccatctagagaaatttgcactacaacagtcattggagcagagcacaaatatatatgttcaaaggtggttcaaggtggttacctttatgttcaaaggtagttgacatttataatagtgaaaaatgggaaacgacctataggtgcccaaccctgggaggtccttcttttaaatgcctccacttccaactccaagaggcccactatgcatagccatgcaacacagtgccagaggaattttattttttagtttttaatttttgtgagatagggtctcgctctgtggctcaggctggagtacagtggtggctcatggcaacctccacctcccaggttcaagagattctcctgcctcagccttccgagttgttgggattacaggcgcaaaccaccatgcctgactaatttttgtattttttagtagagacggggtttcaccatattggccaggctggtctcaaactcctggctccaagagatctgcccaccttggcctctcaaagtgctgggattatagctgtgagccaccatgcccagcccggacatcttttaaacattgtgaagatcagtatttgacacaagaaaatgttcattattatgaaaaaaaacccccacaaaactagatgtataaaagtatgatccgtgtttgtaggaaagaattaaatagctccacaactgaacaaatgttaatgaaagcctgaaaggaaagatctctgtagcaactgtggttggtagaaataggagtgtgttcctttctcttcctgcttttgttttttgagtgcatgaattaaatatatatttcttaggttgggtgtggtggctcacgcctgtaatcccagcactttgggagaccaaaacaggcagatatcttgagcccaggagttcgagaccagcctgggcaacatggtgaaaccctgtttctacaaaaaaaaatacaaaaaattcgctgggcatggtggcacatgtctgtggtcccagctacttgggaggctgaggtgggaggatctgacaagcccaggagacagaggtctcagtgagccaagatctgtgccattgcactccagcctgggcaacagagtgagaccctgcctcgaacaaaacaaaacaaaacaaacccagcatgtatttctttagaaattccataaaacgtgatttagaacacactgagcgtgaaaccatgttgtggagtgaacgagaagaggccagacctgtgctggagtaaccctggggttggaagcctaaagaagaaggcaggtgacaggcaatcctgatgtggcacaaggaaagctgtgtgaggccatgctgggtgcccacgccaggctggtggggtggagcggggctgggaagtaacattggaaccaagacctgggggatgagaaggaggcagccagataaaacgggagtgtcctgggaggaagggaacagcatgtccagagccccagaggggcaggcgaggggtccttgcacgtggctctagaaacagaccaaagtttggaatcactggagcataaagagcgagaggctgaaggacgagacaggaccagcttatttggagccctgaaggccatgctgagtgctttcgacttgatcctgatgggcgccctcagattggtgcttagaaatcctgctctgggctgagtgcggtggctcacggctatcatcccagcactttgggaggctgaggtgggaaggtcacaaggtcaggagttcaagaccagcctgaccaacatggtgaaaccccatctctactaaaaagacaaaaattagcctggcgtggtggtgtgcacctgtaatcccagctacttaggagggtgaggcaggagaatcgcttgaacccgggaggcggaggttgcagtgagccgagatcaggccactgcactccagcctgggcgacagagaaagactcccgtctcaaaaacaacaaacaaacaaaaagaaattgtgcttctgctgatcatgctgaggggagcctgtgggactcagctcaagccacagggaacctgagggcaggatggtaaggagtgaatgatgtcgggcaggtgactctgggttcaagtggagaccccagacctgaagctggaaatactgatttgggagttgggagcacagagatgatgagtggtgaaggagacagatggggagggtgtggaggtgggcagggaaagggagctgagtcctgagcaatgctcatggggagggaacaggtggagcagagccatagctgacaatgtgggggtcctctccccagagcagggctgggcagcctccggaagctggacaggttgaggtgggaagaacgatggtgtgcaggccccagagtcctcggtggacgagggggagggggagaaggggaggccaggctggcagcaggggcctcagtagtttgctcagctgctacaacaaagtgccacgggctgggggctgaaacgctagacgtttacttctcacagttctgcagcctggaagtccaagatcaaggtgttggcagggttggttgctctggaggcccttctgcgtggcttgcagatggccgccctctggcaacgtcctcacgggatctctcctccgtgcacatgcgtccctgcgtctctctgtgtcctcatctcctcttcctacaacgacacagtcatactggcatagggcccactctgagggccttgttttaagactctgtctccaaatatggtcacattctgaggtactgggggtcacggcttcaacataagaattttgggagaaccttagccatgtactgttacgtgcccaataaatgcttacgggtacaaacaggaggagccgaggaggagctcctggagcacaagtctgcctgcctggctctgctagtggagaagggaggagttgaggggtggggtttcttttgacgctcttgggtgcctgtcctccccgcgcccctgcggctgacacctctctctgtctccccctgcagcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaaggtgggctacacgtggcggggcggggggctggggagacccggggaacatcagtcctcccgctccctcctcgcttccttttctattttcttccagtctgtacaaattggcgttgtctgaggtcatctctctctctttctctctctgtgacacacacacacacacacacacacacacgcctccctggtatttggaggtgtaagccaaaacaaaggggtgatggagacatggctcaaaggagaagaaaggagaaggtgggatcccctacaagggtgcagggctgcggccgccaacacctctccctcccctccccctcctgggcttctcctctgcacaggtgtgctgcataccagagggctgcgagtcatgttcgccaggcttaccgttgggacaaaggactctctttcaccaaatgcacgcagactcacttctttggatatgtgcgcaccgcccctcactcccccccgaaacacacacacacacacacacacacacgtacagtcacagcggagtcggcagtttcaggggcagggtctcagaaggaacatttaatccatctgcaaatagctttacttctcaggacaaaaaaaaaaattaaaaggagacgggagactattttcgtccactgaagcaagcactaatgttttaactttctgctgtttgtttttctcgtaccaacaaaaatgaagcaatggtcagatgattcagagaagttgatgaaatgccagagaattcagtgatgctggagggtgagaagcggggccccccccaccccacaaaatcttttgggaattccaggaaccagggctttcctgctgcaaaacttgtggcctaaggtcagggcctgccatgaacatggcttcccaagaagatatttacctctgagggctcatgggcaacacctcggcatgggtggggtcctgacctggacttgtgtagacccgaacacaccagggtcccaagccacggcagacaggcccaggtggcgtcctgcaggagagaaacccttctgtggccactgctcagcgtgtggatgaagcaaaagtatcatcttcttaacaggaagtccaccagatgttgggcacttgtgtgcaggactgactgcataatttgcagggcccagtgcaaaatgaaaatagggggcttccagcactttgggaggccaagacgggcggatcaccctaggtcaggacttcaagaccagcctgcctaacatggtgaaaccccatctccactaaaaatagcaaaattaactgggtgtggtggcggttgcctgtaatcccagctacttgggaggctgaggcaggagaatagcttgagcctgggaggcggaggttgcagtgagccaagatcgcgccaccgcactccagcctgggtgacagagcgaaacactgtctcgaaaaaaaaaaaagaaagaacatcttgggggaaaaaaaaaagaaagtaacaaagtagggggcttcttattccagagatattaagaattttgaaacaaggacagcagagtttcaaccaagctggtgcccttctgagcacggggcccatgaatccaacccagccctgcttatgtggaacacttttctcaaaataaacaggttcccaatctgtctcttccaggagaaatccctttgattccaaatgcacaggcataagtagaatggctccctcggtcaagcaaggtgtccttctgtgtctgcggacttacggctgcctctggtggttgccaagagaaacatgaacagaaaggtagctgggctgtttccacattttttaaaaaatcacggtttcaggtgagaatcccccagaagactgagcagagaatgaatgggaacgtggcccaggcaaagggacccgagaaacatctgcaatgccagaaaggtgtgaccaggacaagccccgggagagatggctttgggcttccagagaacatagttggaaggtatccagctcctttgcctgtgcccagagtgtttgttgtctctcttttacagaagaaatggaggccaggggtcttgtaaacagctggcttgcacatagatttcttgggagttcagccaagaaattttacccaacagcggccactcaggtgggcagtcctgtgcctgagagtgagaaggtctgggtgagaaagggcactggtcacttcctgtcatgccagtttctgctgtccaattagaaatgtatgtttcccagagaggcaagaaggggcagggccctggtcacctccacctacaccctgttgctgtggacagggacaagagccatttgcagcctctcaccactcagagtgagagacgtcaggaagccacagggtcccgggaacccgcaggccattctccaggggtctgccactctggctgaatggcatgatattgcccaccttcctttactggtttgtaggagggccagatgcaaataaatgaggatgtgttcttgttttacgagttacaacattgtggccagcctaggtggctgtgttttccttcccagccatggacagcagctgccccggccttggtgggaaccctgggagaataactcacaggacgggaaaacctaaggatggattctactcagaaagacacaggcaaattctactgaagaaatgtggcaggaaagggtgggactcttagtgcctgttgactggggaggaatgacagtgtttcaaggaaactgccatcagattggtgaagaaagacagtgcttcaaggaacttgtcacctgattggtgacagaagactacacttaaaaatatttgccacctgattggtgaggaaagacagggctttgaggtttctgctttctgattggtgagaaaaagcattgcccagagatctctgcttcatgattggcaagaaaatatctactctctgattggtgagcaaaaatttgacccaagaagtccagccatctgattggtgaagaaagacatctctggaaagtccagatctttcccctcagctctttcctttcctggtatcatgctcttatgggatataggacacttcccaccaaaaagagaccctgagatcttggtaggaaccatcgttaggagaagttcagatgctggcgggatgtgtacccttgagatcttcaaacaggggtctcctggtcaacccccttccaccaccaccaccaccaccaccaccaccaccaccaccaccaccaccaccaccagcacctcctgccttgtattcccagggccagatggttcaaggaaatggttccttgcgaggtttgatatttgacagtttgctctcagaggcttctgaaattttgtagatgtggtgctgcccccaggctctggctttttttttttttttttttgagatggagtctcactctgttgtccaggctggagtgcagtggtgcaatctcggctcactgcaacctctgcctcccaggttcaagcgattctcctgcctcagcctccagagtagctgggattataggtgcaagccaccacaaccagctaatttttgtatttttagtagatatggggtttcatcatgttggccaggctggtctcgaactcctgacttcaggtgatctgtccacctcagcctcccaaagtgctgggattacaggtatgagccaccgtgcttggccagttaggccccatcttttgagaatgacttctggaagccctatcataggccttcaggtgagagctgcacttctttgctttgtttcagatgaatttcacaggggaacagggacaaagggcaggggttcttgactcccaaattggcttgggaacggcctctggggcctctttaccccagactttacagggcctgggcagggggccgaggccacccatatgctgctggtgattggctgactctggaccttgtccagtgtagaggaggggtggacccagacaagaacagcctggagtaagggcatcagattccaaacattactatgtagttgccccatttgggaagtttcgtagcaacaaatttgttgggttctttctcccctcccctggtttagaagcaaaccagagctggcagggttggtgcgtacaaaggactgtaataaacatacccggggaacaggcggctgcactctccagctattcagtgcgatttcacagcactgggacggcctcgttatggtgcaagctgttgtcctatacaaaggcagatgagataaatttctcccttttctccgctgaatggtctgtgaatgatactcgtcttggagtctgtcaaaagacaggaggttttgtttaccatttgtcttctttgtggactttgggggctctttctctttagagcgggcaaagacgaccaaagacgacgttgctatttaaccatttcggccctgcccccattgataacaatattaatttatcattttcccaaaccatctgtgatggataaagacattccaggagtctcccgtgaaccgaattgtgatgagaattaagaaattaaccactgcatccagcatccccatacaaagggcttgcatttccatctcactgagctgcctgtttccttctctcattgtctttccccctttcaagcccacagttcgtgtggttgaatgaaggctaggaaggtgcttgagtcccaagcaagaagatgcaataattagccagggcaaaagcatgcaatcgtcctcacatctttgctaggacgttcttgctacttccgtccaccccttatttctttcagcagctcagccaagagttgctggatggggaggaaatgaacaccacagtcttgccccctctgtttccttgggtcactgtgtgcaggggactccccatgactttctcattcgtgattctccaccttcactgtatggcgtcatcagcattatttgtctgtaacttatgctgtgagtctcacccttggctgcacattggaaccacttggggagatttgaaaatactgccgcctggatcccacccccagaaattctggtttaattaatgggtccagatgcgatctgggcatttggaattggaaaagctcccctggagattctaatgtgtaaccaacactgagaaccacagagaataagaaatgaggatggtgagttgctcttggtggcattaagggaagacttgtaggcagcctagaccccaggtttattgttttgaggagatagattgatcatcaatgaatttaaatgttttttatgattatcttgatgataactgggaggttgggcatttaaattttttaaatttaaaaatcctggccgggcacggtggctcatgcctgtaatcccaacactttgggaggccacggcgggcggattacctgaggtcaggagtttgagactagcctgaccaacatggagaaaccctgtctctactaaaaatacaaaattagccgggcgcggtggcgcatgcctgtaatcccagctacttgggaggctgaggcaggagaattgcttgaacccaggaggcagaggttgcagtgagccgagattgcgccattgcactccagcctgggcaacgagagtgaaacgccgtctcaaaaaaaaaaaaaaatcttactgggcaaggctgggagcttagctagtgtagcctgattaaggcacaagatcagacagtcatcagtgccagatagatagtgcttgcacgtgtgtgtgtgaatatgtgtgtttagatctgatcatttgtggatttattcacagcacagcaaagttcctgggcccccacccttcttggtcttcctgactctaaggcattgtccacccaccctataaaagcctcgggcaccctttgaatatgtgggtcccctgtcacatttccattacctgtatttatactttcatgtttttttgtggggggtgcagggaaaagggttggtcatctgaggcaggaaggtacttagtggctggagcggctccagctttgaggacagagaccccaagtcaaggagtgggcttcattatggccaggtaaggttagtacctactgggagaaactgacaccttagatactgcatttgggagagagaattcccagtggaagagtttcactccaactgtgatctgtgtggatgcatcttttcccttgggagacatgagcatcacaaaccttacctacgtatttggctccatgttcagtctacagggtatcagataagtctggtgacctctctagacctcagtctcctcatctgtgggattatggtcaggctgctggcctctgaatcccttccagctttgacattccacattccacatgcttcttaagtagtcaacctcttaggagaacttgatacaataggacaattctttgtagcagtgaagtttgtgatctggtgactcagaaaagctggtagagccaggaaattaggtggaggtggtttgactgcagtctttacagatgaaaagagtccctgatcttgtgactcgacccatgtggcgcactgtgccaaacggggtctccctggcccagctgtgctcattccctggacccccttggcccatccatgttttcacctccctggatgtgagttctctgatctctcaggaccactcttgtccccaaatgccacatagaaattcctggaggattggctgggtgcggtggctcacgcctgtaatcccagcactttgggaggctgaggcgggtggatcacctgaggtcaggattttgagaccagcctgggcaacatggtgaaaccctgtctctactaaaaatacaagaattagccgggtgtggtggcgcatgcctgtaatcccagctactcgggaggctgaggcaggagaatcgcttgagcctgggaggcagaggttacagtgagccgagatcgcaccattgcactccagcctgggtgacagggcgagactccgtctcaaagaaaagaaaaagaaaaagaaattcctggaggatctccaggggttcctgtgcttgagcagaaaagactcctgatcattgagctccccaagttaacggaagttctgggtttggccagagcgttaagggcattttacttgaggaaatagtgtcttttgggctttttgttgccaggagagcacttatggggccgggggcaggtggcacggggatagtaaacaggtttgggatgcagagctttgaaaagcatggaacttggtgttattcagaccacagttcaggctccacctctggaggcaagacatttactctcagtagcctcagctttcttatctgcaaatgggaagaatagtccctcctccctcctagggctatggtgcagattaaatgagatgatgtggaggatgtccgggcatgtagcatgcgttccatgtatggcagctattatgattatttgtgcaagtcagagaaaacagaaacactagaaccctctgccattgtcagcacacacacaaagcagagacacttcctttgaccctctggttgctttggttctttcggtgagtggtggccctcaggagaaccggcccctcttgcttgaagggctcagctccagtgtggacttggcagccaattcccacaggactgggcagggccccaggggttggccctaatgctgttgcacactctcaataaaggatttccatgctttgggagcaaagatgacaagtcgaagggcagagatgtgcccagcagctgcttgtggagacccagcacagagaggtgggggcgggctgtgcacatccagatttggctctggaagtgccaaggaagaccaggcagcatctgagggactccttgactggactgggacttagggctgttgggaggcctgagctggcctgagctgcctcacctgtggcacagacacaggacccaggttcctgctcctgccccactgtgtcgtacagccctattcctgccccaagctcttgtgacacacacacacacacactcacacacacacactgggaatcatttgcaagacctgtgcttttctccttggctgtaaaacaggtgcaggaagactatagttaactagatcacggagtgtcaaataacccagtttgggattacggggctcccctccccccaacttcctgccgcctgcaccttgatccgaaagtggcagggaaaggataggttgtgcaacttgaaacatttattcttttgtgcctcgttagcaactgctggggcaaaggaaagcatagcttcagaggaggttgacacagacagctgaaatgacgtttggggattatcttcagatttcagtgatcctccctcccttgttaacacagagaatgtaagagtggagagtgcaggggcattggattgcggatgacctaggatgtgaggggactgtcatcccacctgccccctcattctttcctccagatgtgcaggggcagcaacatgcccccttctccccaccaggaaaggacggcagattggcctgagttacatccagattggtaacaagattgtttgttcatttgattcaccacatgtttgtgtaacgcttattgcatgctagacatgggcccttggagcttgctttttgatgggaggttgacaataaacaaagaagaaaaaggaagataatgatggattgtggtgagttacatggaggaaagcagcagggtggaaggagagagtaactgggcaagctgcgctacaaggtggccctggaggggcttctcgcggacaggacatctgagatgagacctggggtgtggggaggaaacagccacaaggaagctgagggaagaacattccaggaagaaccaaagtctggaagcaggaaagggcttggtgggcccttggtcagaagggaagagagggaggaaggggtgggaagagtcagctccttggtgtctggagaggagttgggtcccattctcagagcactggaaggctggaaggagaagagttaactgagtaatatatcaggctcacttttttttttttttttttttttgagacggagtttcgctcttgttgcccaggctggagtgcaatggcgtgaccttggctcgccacaacctctgcctcacgggttcaagtgattctcctgcctcaccctcccgagtagctgggattacaggcatgcgccaccacacctgcctaattttgtatttttagtagaaatgcagtttcaccatgttagtcaggctggtctcgaactcccaacctcaggtgatccgcccacctggtaatcccaaagtgccgggattacagatgtgagccactgcgcctggccaggctaaccttttaagaagccctttctaggcggggtgcggtggctcacgcctgtaatcccagcactttgggaggccgaggagggcagatcacgaggtcaggagatcgagaccatcctgggaaacatagtgaaaatacaaaaaattagctgggcgtggtggtgggtgcctgtagtcccagctactcgggaggctgaggtaggagaatggcgtgacccgggaggcggagcttgcagtgagccgagatcacaccactgcactccagcctgggcgacagagcgagactccgtctcaaaaaaagagaagctccttctgtaagacaagccacagatgaagagaagatacttgcacatcccacgtctgatggaggacttgaatatcaaagatgtaaatgactctcaaaattcaacaacaaggaaacaaacaacccaattaaacatgggcaaaacacttgaatggaaacatcatcaaagacgggcagatcacaaataaatacatggaacgtccttagtcattagagaactgcaggttaaaactaccatgaggccggaagcggtggctcatgcctgtaatcccagcactttgggaggccaaggcgggtagatcacctgaggtcaggaggctgaggcaggagaatcacttgaacctgggaggcggaggttgcagtgagccaagattgcaccattgcactccagcctgggcaacaagagtgaaactacatctcaaaaaaaaaaaaaaaaaaaaatgtatgcacatgatacaaacccataagactacaccaaaaaaagtgaattttactctatgcaaattaaatgataatagcaataagaagaaactccttccctagggctctctgacactgcgtctttgggcctccttgttccccatctcccatacctcaaagctctgaactcacttagagaccagtctccctgggtcagcactccctcccctcccctggtctctctgtctgccctgcccccaaaagccctgcctgcctggtgtcttcgccgccaccttacattaggtccgctccattccagaatgccctgctggttttcctgtgtttcttcttttggttgctgatccttcactcctgttttggggagtggggaagaaatgggtgcttggacacctctgtccctgacatcatcttctctccagtgtcacctctagtgagggtcccaccaggcttcctccaagaggcctgacacccaccagagatatggggacctggggagcctctggatcctgcttttctctgaagatgctggcccttgctgactctttggactgtcctcactgcaccaagcaagctgctgcagtcgacctccctgacctccacagcagccagggagcagcctggcccacgccgtggggcctgtccacagggcctcgtctacccctacgttctttgtggatggcgtccacctatgcagactgatactactcaaagcagagaagactgtctcccccagcccaggagggccacaggcagatgcagccctttggcatgagctgtaggacttggagtcacatggagcctcacaattggctccagggttcagccctccctggggaaacttggcaagatttccacattcactgctggggcaatgtcccgggattcagggcagggtgttttctctgtctgttgcattcctctgtcccttggaagtcttgtgaggactaggaagggagtttcccatcagactttgggagggatgccttcagcacttgctgtgtgagccctttcttcttctggactggaacagagggcaccccctgcattgctgtacaggtgaggagggggctgctgatggggccggcctcccttctctgacctcgtgccagccttctgagggctcttaggacctgcagcacttcctgctcaaggcctctgccagtgcccttttgagaacagccctcagatggtctgtgagctgtgagacctgttgggaatcagagccagcaggggctctaaagatcatggaagctgagagctgctctgctggcctgtgggggttttggggaccctcagagacatggcctgccatggagaaggttttcctcttccagcaaaggtggtgacttccacagggagccaggggatgaaagagctgattggtggagtggtggggcagtcttccttcccatgagtacaggacaggcctaggagggtcctggagaagaagatgcttacctgaggctccacacaggtgtgttagtcagtgcaggctgcaaagtgcctcagactgattggcttaaacaacagaagtttatgtctcatagttctggaggctggaagtccaagatcaaggtgtcagcagggctggttttgttccaagaaacatctgctccaggcctctttccttggcttgcagataaccgtcttctccctgtgtcttcacagggtctttccactgcactcatctgtatcccgatgccctcttctaataaggacaccggtcatgttggatcaggttccaccccagtgacctcactttaaattaatcagctctttaaagcccctatgtccaaatacatccaactttgaggtactggggattagagtttccgcatcagcattgtgtgtggcagggagtacacagtttagcccatagcacaaggtcaggccagaagcggaacttcaggactggccagaggcctgggtggtggctgtggtggtgtctgaagtgagggtggggctgtggctgttctgtctcccctgtcctacctgaagctgctccagaggagctcatgcccagctggctttcctgtcctctatgggcacgtggccttggatcactgccatttgaaggtcctgcctgacctcaagagcccctggagccagagtcctcaggaaaagtagccagacctctggataggagcccaggacagacttctggaaagccttagtatgtgcttcagtggaaagggtgccaggctcaggagtgtgtctcctccctggcagagcccaggagccttcagggatcccttcagagagtgtcagagggagtgggaaaaggcagctacttgggcacaagaaactgacgatgagaaccacctgccatccaggtcagctttgccagggctctcggaagtccctgggtactccctctcttcaccgacaaaccaaatctcaacaagattctggcaccatgcaggtgggtgctggtgcaggcagggccagcagtaagggtgtacggaaggcccggtgtgccctgcaacaggagccctttcccctgccctcttgccaagacactgaggaacggcagcagaaggggcgatggtcaaagggtgggggctgctgccctggttcctttggacccagcagggaggcaaaaaccttagcctgttaagttgtaagtcacttcagtgggactttagagggagacctctgtccttacaggtgagccaccggtggtccagagagagaaaggcactaacccagggtcactgggagggtggggcgccagacctggatcccctcttacctgtctgaaagcgcgtgggtcacctgagctgtctgtccctgtctcatgacccagagcaaggaccgcgtgggttctctgcttcactgggaggctctccagcctgcggtttcatgggaaacctgatcttgccgtgttctcagggacctgggcttccgtctggcctcacctttctctttatggaaaaaatccccgggttgattgtttcccatggccaggtgctgcctgctccttgcacacggggtgacctgccatggaagggattgacctccctctgaaaaaagtggctgacttccagggacatgggagccacccagcggcttcctatggcggaagatgttctgacccagaccacgttctcagaggaattagggaggctctctctttgtctccctcaccagacacccccaccacctcccctgcaaaggaaaagacctccactcacctaactgccaccttctccccagctcactccacacctcccctcccctgcccccccgtggccctgtgtgtctgtgtctgtgtgtgtggctttgtggatctgagtatatgtctgtgcgtgggtgagtttgtagataagaatccgtgtgtttgtgagtcaatgtatgtagatgagagcgagggagggagaattagtaggagtctgcttgtatctgtgtgtttctgggaatatgtgtgagtctctgtgtgttagtaggaactttgatgtgtctgtgtctgtgtatatttcagggtcaagggactacagcaggatgcttttgacttcctcttcctcaaggccagggcctgagtcttcccttgggctcagcctctcttcctttggcactgccagtcacattctccctttccaggccatagtatggcattgccatctgtcaactctccctacaccttgaaactcagactttgcacagggtataatgggggccatctcgatttgtgaatttttaggaaaagttctttgggtaatctcctttggctggagattgagaatgaattccaggcaagtctgttaggattgcactgggtacaggtaacagaaaacccacatcatattataagataggagcttatttctccttgcagaacaagaaatacaaagggggccatttagaaagggtagttccctcagagatccaggctctttccacctctccgcacagcccccagctttctcctgcagttgtcttttctggtccctggcctcctctgtgctgtcacgcgcatttcagagggctgtcgcaaggaccaagggattcgacacgtatgagagagtgtggatgtgctaaggagtttgcaggagttggcacggggcagctactgctgaagaatactctgccttgggcagcccctttgggaccctgattgcctcccttcctagaacaatgatctgctggtggggaaacacaagtcagcccgctgcctccataaaccagaggaataggtcagattcttgcagaatctcagaaagatttggaaacccaggagcaagcatcagctcatgttgaaccaaagagtgggcccttaggaagcgtctgccgcacccagcagacacagtggccctgccattaccggggacggccctcactccgccagacctcagctggtgccagcccaggcagctaagcgggtcaccggctgtgggggagaacaatgcaccatcctgactccacccagagtctgctctgggtcggccgctgccaagataaagacaacctgggccaatgagggtgtccacgtgtgacttggctctgaacgtgcagtgaccgagcaacctttggtgacctcccttcagccaaatccaaggatccagaagttactggtgcacagctgtgttccatcagctcggaggggagaatgtcttggcatgaatcttaggattaccagctggctaagggaggtcagccggcctgaggccctgatgctcacgcttgcatcaggggcttcgaagacagtaggagcctgtgctgtggccctttgcattcgcacggccgacttagaggcactgcccatgctccatctcccttcctaccatggacgaatttaagagaccacagggaaaggtcagagaccctctccagcctcccctcctcgccgccgcctcttctgcacgtctccatgggccgtcaaggctggatcttttcttactgtcgagagagacaaacaacagagaatgaacttgaatttagggtacatctaagaagacaatttcctaacaaaaggcattgcttctggctggtcgcggtggctcacgcctgtaatcccagcactttgggaggccaaggcgggcagatcacctgaggtcaggagttcgagaccagcctggctgacgtgttaaaaccccatctctactaaaaatacaacaaaattagctgggtgtgatggtgggcacctgtaatcccagctactcgggaagctgaggcaggagaatcgtttgaacccgggaggcggaggttgcagtgagccgagattacgccattgcactctagcctgggcaacaagagtgaaatccatctcaaaagaaaagaaaaacaacccagcattacttctatctataagaagcagcagcaagactggagcagttccatcagcctacaggcagggagccctgtaggctgcccccgtgccagggcctgtgcccccaccctcctcccacctgatgggggcacccccagccccgggaccctcactctgagtgattccaggaggttttgcatgtccagacacaacttcaacaaacaattcctcacattcttctcttctccaccttcctccctccctcctcttcctaattctcctcattggccactcctgggcccgaggccggctgggctgggagaggtcgtgttttgagccacagactcccgtgctcacgcccagcagtgcttgctgggaagttctaatctggctgcttcagagcctctgctctcacttgcattcttgggttttttggtccttttggaggaggaacagattagcagccacgaggggacacctggaattgctgccggacgccttactgcagacgactccccacttccagcctccaggatggggcatgggcaggacatttgccttcttccttcggtgttccccttccccaccacactctgaggccaccgcctagcttcagggaggcaggacttagcagggaacgctggtgtcctgtgcctacaggtatagctgttcttgccctgagcatctgtgttggtgggacatcctcctgaggtcctgtggctactctcttaccagaattggcttcttgggacacagcgacagagcctccgtgaagcatgacagggtgggcaaccccacctctccaccctttcaagcccaggaggagggtggggggcctgctctgtggagccgtagttgctggcttgagaatcccgggccttgcttcagctcccagcctggccgttcccttcctgtgaggctctgggagtttcctttacctctcccgtctttgtttgcacatttaatcagggctttaagctaaatgatcaccgtgaccctctctagtgctacagtttatgggttttgtgattcagaaggctgcctggctgcaaagtagggtcaggtgttggggggcagcagctgggggagccacccctccctgtgactccctctaacctggcaaaccccagagcttcaccaggcctcaaaccccactcctcccatgccctgggttggcaagaaaacttgggggcagggagctggttgaggacagagtgaaaacgcataagccgaccctgtcaagggaaggtgtatcccccgatcctgactcctccacccaggcgtgatgagggctacgggctctgccttcccgagaaggtatttgaaagccttcctcctgggcttccaaagggcttctgcatttcactttcctgctgccaaagcagtctcttcaggtcggtccattttggtttttattctccgtttccaggtaggtgggtggccagtgtcagagcttccggagtgcgtttgggcttggctgggcctgctccccatcgctgctcttcctccagggcagggtccatggaggcagccctgggtagggaaggctctgcggggatgcactggccgcttcccccttgtctgaccctcccattttgtgttctctgcagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataagtatgtgtggggcaccctgcttttcaagtctctggctttgtgggggacagtgagcttttgaggatgctagtcactgatgttcagtgggttccttttttggttggttgagtctcactctgtcgcccaggctggagtgcagtggcacgatctcagctcactgcaacctctgcctcccaggtttaagtgattctcctgcctcagtcttccaagtagctggaattacaggcgcaagccttcatgccccgctgatttttgtctttttaatagagatgggatttcgctgtgttggccaggctggtcttgaactcctgacctcaggtgatccacccaccttggcctcccaaagcgctgggattagaggcatgagccaccgcgcctggcccattcagtgggttctgtcttcaatgtgcattcctgcattcaaggcctcatgctcagtgagtccacgtgggagaccccccaagctcatagagttcttgcagaagccactgggggctcagcagagccagcctgtctgaggctgtctatcctgacaaacactgagtctcctgtttctggggaaaagcaagcccctctcctcagcactggccccattctcactgtccacctgaaccctggatctgggtgggcccattccaggagtgctgttgtcactattgccggaatgccggcattccccctgcccctggtgggttcagaacagaaaggacggacagcccagggccttcgagaggagctgggcagggcttccatgcacggcacctgtgtccctaatgaaggatgatagcaaccctgaggcgttccgtacagctgttcgcaggggctcgctaatagcaaatgaccagggtccaagccttggtagagggggctcagcacccatccagggcagagcaggttgaaatagcttcacaacaacctccaattgtcagcctcacagtttgtcaaaatccttctgtccatccagattctgcaaggtgaacatttttagacagctgggaggaaatctggggttcggaaaacatggggggaaagctgaggtctcccgtcagggaattaggagttctcaggttgctcagaaatggttggaaccaacatttcaaattcccaggtggaaaaatcaagcctagacacgagagctgatgtttctgaatcagaggctgaagccttgggaactctcatttcccagcctgtgccttctctcctcctctaacaaagggcgggctgatgcctggcgagagcattgtccctccttggacaacctggggctccatcctggaattttcgcttgctcttcccgagggaagagctacaggtgcccagacagtgcctgggggactcgtgccctgttttgtcccagcttgggcagccatgggccctgtgtgtgcatcccagagccaggctgacctcaggcactgaggttgggtggtcacaatgactctgtggccattggcttcggctccatttgtggacttgcaggattagactggaccattcagatgttgcctccaggatgttcctgctgggaccaggtggctttttagggccagcttcctaataacccattgtgacagggcacctatggtttgttgttgctaatacagttgcctgggagcaagatttgaccccaaattgagggctgtgtcccccacttgttcttcctaaaggagcagaggatgcctccggtgcctctcagatttgcccccggcctgagtagcccatgtccatccaccaagcctcaagtcctagctcatctagaatctagggagtcagagttttaccacaaagaatcagatggtggctagagtcagtggggttcatggtcactcaccaggggaagtgagtcccttcctcttagggactcctggtccatggtttggccttgttcagaaagaggaagcctgagcttcagtgccaggctgctgaaccgatgagcagtggggactggctgaaccgcctctcttttcttgagcacagggtggggtctgggaagtagtaggaaccaactgctttttaaatatttattattatatatactttttgagacaggatcttgctctgttgcccaggctggagtgcagtggtaccatcatagctcactgcaacctcaaactcctgggctcaaggaatccccctgcctcagcctcctgagtggctgggactacaggtgcgtgccaccacgcctggctgatttgttttatttcttgtagaggcaaggtcttgctttgttggccaggctggttgcaaactcctggcctcaagccatcctccccaaacgtgttgggccccaaacgtgttgggatgacagatgtgagcccctgcacctggccagagtgctatattagatagagaataatcaaaacgatcacatgcttttatgaggcccttggatctgcactctcagtcccattctgcccattaagaaaatgccttagcgcttgagatgtgaggctgtaggaacctgggccgtgctgccaacacttctctgcacgtgggagaaacctttccctttgggcaggttcccagccccttgcgtgctatcctgccatggatccttctccacctgtgagttgagcttagagatgagcagggcccaggtagccacatcacgatgagcagagtggcctggggaagcctctctccatacccgcaagggtggagctgagttgacgccaggcccagggggtgggggcaaggccaggctctgtgttgccgcctcactcctgccttctctccacacccccctgccaggtgaaaggagaaaaacgccacgtgcccaggatgccgctgccagcttctgctcttctgacttttctcctcttgagccaaggagtgggaaacggaggggagggtcccaggaagttgggaggagtctgtgctgggctcattctaaagtcaaaaaatcatgtcgtcttaccttgttttctctcctcccctcgcccccgtcttgaacctcacaaagagatccctgtagcgccgccgacgactgcagccagcagcgtggaggagcctgaaggtaaacggcccccttcgcttctcatttcccgcttttgctgggtggtggggtggtggggtgggttaatggggaaggggcattggaaagcccagactcctctaaccactgtccgggctctgctccgtatgagtggcatcctgggttgcattgaagaagctggagctataggacactattttgtggctttccctctgagaatcaaatggaggagattttaatgatgcctctctcccaagcctggaaccctaaaaactgagctccttctacttgtccaccagctgcccgccagcccaacaccttccaggctgaggggttgtcactccttcctggggctgcagagaaggaaggagccagatgctggggatacagaaggaggcttgggcacagggtcgcacaagcagaatgcagggggcccaggagctgggcgtgggggagaatcacatcttcattttcattcgcctctaactaaaaatttagcatttcctccatggcaaagagaggccgcagaccgcagcatgcggccaagcctgcaccgtggtcactggcggaagtcacagcggtttacacatcacattctagctggtgcagatatcataaatatcgttcatgctggttattgcttctcaaaacgacagaagttactagacctgctgctagatcctgatttataatcattaataaagaagcactcgcgtaacgtaaccataccatcaatctgggtctttaaagatatttgggcagcagcatttcagtattattaatttcctttgtagacctgtatattttattttagcatggggaaatgtttgtctgaggaagggtccacaggcttcaccagtccttggcacaagaaatgttgcatagctctggctgtcggcactcagagtgtaccgagccctgccagatgccctgctgagagcatctcaggcctgcacccagagtcctggtcctgggatcacacaggacttttgtgtactggtacttggggtagaagagggcagaaagtgacagtggggcaccccagcatggacattcatgctggtgctggggactctttgcctcccccagaaaggactgtagcgagggatgggggagcttgcaaacccatgtggccccctgaatattttaggatacggactggattttggagagtattggcagtgcgctggaaacttgagggaagacagattcggcacttgcacaggcatggtccacagccagcaaacaggaaaggacagaaatgcgtttcagggagtgccagaggcagctctgggaaagccaaagacagttgagtcttgcgttgtttgcagagcctttagggacttttggttgagccccatgcaggggaaatggcgaagagaagggattgaaggaagcagcatgacagggagactggatgacagagctaaggtgggagatgaggaagctctctctgtcacagcacaattcaaaggaacatcctaaattacttcagctctaggggagagcagttttgaaggtagaagacacttaaatgaaacttcgattcttgctctctttgatgtgacatttgtccttgcctaactgagactcacctggacaagattttaaggctgtgcacaccgcggggggctgaggcttccgagcaggggctgtgtgacagctcatgcaagggcaagacagacctcaatgatctatctctccatctccgtctttgtctctcactccccccatttctctagtccttgtagcttgactttgagtttctcacaaacccacaaacccttgattttgaatttttccccttccaagtcagaaatgggcaaatggggaaaaatgtggaggggagggatctcatgaggtttctacataggctacaagaagctggtataaaacttccgaggttcttggctccgccagacaaaagattccggagcagccgcttataaacactggcagcctccttttttgaaatgtcttctttgagttgtttaacttttcggactgcttttgattttgttactgtttatttcctttcctcattctgaacctttaaaagcatggtttaaaccgaagcgagcagtaaataaacacccttataaaatatcttcctcagagagaggctgagtgagcaggttggaagcctgtagcaatgtttgtagctttgaccagacctgcgctgccctactctgggggtcctcggatgcccagggtgtctgatgctctccccagagaaccggagccatctctgggacacaagtgctggaccgtggggcctcctaccacagggaggctgggtatgccttgtctcagcgtctgagacattgcaggcaggaggccaggagggccccctgggaagcggggcccgggagctcagcgctctcaaacctgtccactcttgccgtgtttgaataggggaggcctctgtgccaggctgcctgagaaaagcttgtttacttttgcctgcgtaccagaggagaattaataagctgagaatttgttctgaaagctgatggacataaccttcccctgaactcatccccttgaagggccagctcactcagggaatgttctttacctgctcacaaagctagctggtaagccgtcatggggcagggaggtgaggaacgtagtgtctgtgggggtctggggccgggtaggccaggagggaaacagggaggaaaggagagagggaccacccactcaaaaagggcatggtacccaaggctcccctggcactcacctacttgttggttgtagagacctcagcactcaaggaaaaaagacacctgccttctctccctgtaccaccccttccccacctatcaactcaaggggagttcttgatttgcaaattgtttgtttggttttgtggtggccatttggtttggtgggaggagtctggtatggagccaggagacctggggtttgccctgcactgactctgaggacttggacaatgcaatggcgtctcctttctgccttctggaagaatgaaggggtggacccagtgctccacaggcccttccctccctggctggctgtggcaggagtgagctcctcctgctggggtttcctcttcagaggcacctgcttgttctcggtccgcccctgaggatccacttctcccacatcccaggcagaggcctgtgggcggaggtgctggtaagtatttagcaactgcctggggcaggaggtggggccaatgtgtagcatctgccacttcccttggtgtcaatactccctccctggctggtttctggctacccaatgagatgtcattgaatgtgaagttgggagaggtgcatgactggccctcagagcccttggcagctgattccacctcaccactgcccatgggccttccagcagaaacagagcaaagaggtccagaggcaagaaaggctgcctttgatggcctccttggtttgagggatcacagctgcctttgcgtggaagctggacccagggctctggggttacaggagcatggagccagccaacttctgggctccctccacctcccaacagggatcccgggtcctctctcctaactctgtcttcacgaggcactcaccccatcggggccttacctggtacctttggctaactgccccagcagccccagcctggggtgggagtggctgccaagggcacccttgcacattaccttgatggtagtctgaaaggaaaactccacagagcccggcagctgaacctctccgagaagctccacactcaggtgctaccaggcctgtgtggtgggggtgggggttgaccttagagaagtcacttccggtggcctctcggcacctccactttttcacggaaggaagttgggtttatgtagacctgcagcctggataagcatggattattctcttgtttaggcttttgtttgccaagatagggaataggttgggtgaatacaggaaaatgagttgatgggacttgaatgtggcattagcgaggggttgtggggagggagaagagggagaaaagggcactaaaatgggcacctgagggctacttgatccctctctcggattcttcatttgtgaaatggggtaatcgcaaccctgccactagggctgttgtgaggattaaatgggatgatctcagtaaagcctgtgactcagtggagggactgttcaaagttcttgattaaaaaaacaatacattgacatgaaaaatacaaatgccatggtataatgagaggttgagccagcttctccatccagaaaggcgggattggggtgggagttgctggcgtgaggacaggcgtggagagtcagcttgattgggcttttgaagaccttgggaagtcacaagttggactgcccgaggcagggagcaactgaggcaactgcatggtgggcttgtcacagccttccagcagctcatggtagagcctgaaccaagcagagaggtaagaactagaaaccagttaaaggtcaagagcttcacttcatgatagccaaaaggtggaaacagctcacctgtctatcatcggatgaacagatacacagaatgtggcatatctatacagggactattatttagccataagaagaaatgaatggccaggtgcggtggctcacgcccataatccaaccacctcgggaggctgaggtggatggattgcttgagcccaggagtttgagtttgagaccagcctgtgcaaaatagtgaaacctcatctctccaaaaaaaaaaaaaaaaaaaaaaaaacattagccaggcatggtgatgcacacctgtagtcccagctactcaggaggctgaggtgggagggtaacctgagcccaggaggttgaggctgcagtgagccgtgattgcaccactgtactcaagcctgggtgacagattaagaccacgtctcaaaaaaaaaaagaaatgaagttctgacatgtgctacaacacagaagaaccttgaaaacatcatgctgattgaaagaagccagacccaaaggctgcatatcatatgattccatttatctgaaatgtccggcaaaagcaaatccagagacagaaagcagattagaggttgctaggggccgggcagcggctgtttaataggtacaggttttcctttttgggtgatgaaaacgtcctggaacttgatagtggtgatgagttgtacaatgttgtgaacggacttaatgccattgaattgtacacttaaaaatgctaaatctggctgggtgcagtggctcacgcctgtaatcccggcactatgggaggccaaggtggacagatcacctgaggtcaggaattcgagaccagccttaccaacatggtgaaaccccatctctactaaaagtacaaaattagctggatgtggtggtgcatgcctgtaatcccagctacttgggaggctgaggcaggagaattgcttgaacctgggaggtggaggttgcagtgagctgagatcacaccattggactccagcctgggcaataagagtaatactccgtctcaaaaaaaaaaaaaaaagtgctaaatcttatatatattttgccacaattaaaaaaaaaaaaaaaaagtcaagtgctttgggtcagagtccaagggtgaagtgagtctgatttgtctggggctggggtgagtgtcctggagacaaggcactggagcataggcagcaatgggggacatgcttgtcttcctgtcgcctcactgggaacctttgaaggggatggcggaagtcgtctgtcgtcttccagccctttagctgtgggtgtatggcttcgagttctggctgcacagcctgaccctctctccccttttggagtcatcttagaaggatctggttccttgagtcccaggtagggaggcttcagtgctcttggtataggagaaagggagctgtggggtccacagaggagaccactgacaggaggggggatcactggagaccgtgcagacagcccaggccactggtaaacaggcccagtaattgaccaaggcactggtttcaaagggtggtatgaagtgggatgttaggctgtcccaggttagccattagataaatgaccggtgaagtcattaacacaccatcagattactgttatcccgagagaagattagaccagacccagaataaaagataaatggattctggctcagggaaggaggagacaacatttatatacataagatgcttgctctgtgctaggcactgtttcaaatgctctacattattaaccatttaatcatctcttccacccatggagctaggtactgtcatctccccccgacccctgttttacagaggagtaaactgaggcacagagagatgggtgagccctagcaagcagcatcactgggatcccggctgtggttgcctgggcgcagagtctgtgagtgctgttggccaccatgccattcccacagaagttatgtttttgtttgtttgtttgagacgaagttttgctctttcgcccaggctgtagtgcagtggcacaatctcagctcactgcaacctccaccttcctgtttcaagcaattctcctgcctcagcttcctgagtagctgggattataggcacgtgccactacgcctggctaatttttgtatttttagtagagacggggtttcaccatgttggccaggctggtctcgaactcctgacctcatgatctgcccacctcagcctctcaaagtgctgggattacaggggtgagccaccatgcccagccaaagttatgttgtttggtcaattttagataattaaaaaaaaaaaatcctatgtagtaacatcctactaggaaagaagataaactcaaatatccactgagtggtgacctgaaaccaaagagacatggaggggcagccagtcaaaagccactgccttttacaggtgccagttaaaggggttctggtgagtgtggttgtttggctcatggagctggcatgaccagggccacaggtggtgagcactagagaacagttagcagagctcagacccttgggtcacaaggtagccagggtgagacagggcagacaaatcagctaatcccagaatgggtgagcataaagaaacccaaaacccccactggcaaagaatcagccgaagattgttagaactaataagagaattctataaggagccgttaaacaattaacgtacaaaggtcagcatggcctgtagtaagtactcagtgaatgcatatcagttttatgataatggaaacaaaatctcaactagaataccagtaaaaatatgaaacacagaaataaatgtagcaataaagtacagcacatatgtaaagaaaagaacaagacttttccaaggaacatgaagaacagaagaaaaggagggtcttgccacgttctgagaagacaagacccaaaattgtaaagctatcagttcgcccagaaataatctgtatattagcataattctagtcaaaatcccaattacatgaaacacgattcctaaattcagccagaaaaataaatgggtgaggattgccaataatttttttaaaagaagattaatggagggtgatttgccctaccagatatttaaagatattgtaaacaggattatttaaatgagtgtggtactggtgtaggaatagagagatcactaatgctgagtagaaagtctagaaacaggccaggtgcagtggctcacgcctataatcccagcactttgggaggccgaggtaggcagatcacttgaggccaggacttcgagaccagcctggccaaaatggtgaaaccccatctctactaaaaatacaaaaatgagctggacatggtagtgagcgcctgtagtcccagctacttgggaggctgaggcacgagaatcacttgaaccttggaagcggaggttgcagtgagccgagatcgtgccactgcactccagcctgggcaacagagcaggactgtgtctggaaaaaaaaaaaatctagaaacatactcaaatgtaaacataagaacttagcatatggtaaagttgtgactgtgagtcagtgcagaaaagaatgaatcaatcagtaaatggtcctgggaaaaccggctatttattttaaaataataacaaaatatgctgtatatcatcaatggattaaagatttatataccttcagcatatgtccttaaatgttctagaataaaatatatatgaatatcaatgtaatattgatgtgaggaaggccttttagacatgacacaaatgtcaaaaagcataaaaggaaagattttgaataaataataagcggagccgggcgtggtggctcacgcctttaatcccagcactttgggaggccgaggcaggcggatcatctgaggtcaggagttcaagaccagcctgaccaacatagtgaaaccccgtcactactaaaaatacaaaattagctgggcatggtggtgcatgcctgtaatcccagttactctggaggctgaggcaggagaatcgcttgaacctgggaggcggaggttgcggtgagccgagatggtgccattgcactgcagcctgggcaacaagagcaaaactccatctcaaaaaataagtggaaaacttctgtatctcagaaatctctataagcaaaataaaaggcaaactaaaagctgagaaaaatatatgtgacatggttgaccaaaaagattaatgtcctcaataataaagaacttttacagttcaataagagagatatcctaatatgaaatcaggctaaaaaagtgaactagaaatttagagaatttgtacaaatggcaatatgcataggaagcattaaacttactagtaataaaaaattaacaagaatactcttttaaaagcttattagggatggagcatgtggctcatgcctgtgatcccagcactttgggaggccaaggggggaggatctcttgagtccagaagttcaagaccagtctgggcaacataatgagaccttatcgctactaaaaaaaaaaaaaaaaaaaaaaaatccaggggtgttggcacatgcctgtagtcccagctatcacgccactgcacggcagcgtgggtgacagagcgagaccctgtctcaaaaaaaaaaaaaagtattagagattagagtgacactgtttggaaaataaaaagtaattattctctgtgttgaaaagggttggggaagcaggtacccacctactctggtggtgggagggtaacctggtgccacttttatgaagggtaatttggcattgtgtatcaaaaggtatccatgaccccatcagttcaattctaggaatttagccaaaggaaatagcaatgtgtgccaaaatttagctacagagatgaatattgcagcattgcttataataacaaaagagagacacaacctacgtgtctttgagtacagcttgagttactcagcaatgggatagccatataatgatgtggggagaatatctaaatggaaagataaaatatagtgccaggtgacaaaaacaagtgacacaacacattacacctgaagaattagccatatcggtggaaagactgctgtacaggagcatttcgcttagtttctttctgtttgtagatttcagtggttctcaatcaggggctattgtatgtctggagatattttgggttggggagggtgtcgctggcatctagtgggtagaggccagggatgcagccaagtatcttgtgttacgcaggacagctcacgcaacagagaagtacctggccccaaatggtgatggtgccaagggtgagaactcccgttatacagaataaaacccacacattctctccaaaagcattaaggagagctggggcagcaccgggagacaaacccggctcttttattagttatgcaccatgctgaactgaatgcagctgacggtttagaaagctgtttcctcggccgggcgcggtggctcacgcctgtaatcccagcgctttgggaggccgaggcaggcagatcacctgaggtcaggagttcaagaccagcctggccaacatggtgaaaccccgtctctactaaaaataaaaaattagctgggcatggtggcacgcgcctgtagtcccagctacgcaggaggctgaggcaggagaatcacttgaaccctggaggcggaggttgcagtgagccaggatcatgccactgcactccagcctgggcgacagagtgagactctgtctcaaaaaaaaaaaaaaaaagaaaaagaaaaaaaagccgtttcctcaagtcagccacatttcccatgtgaccatgttaaaaaaggactgagcttttatgtgcctggtcatttttccatggtaaaacttagcacaacctaaagtgaaatgtaccccaaattccaatttgtactatacattagtatattctgaattaatgtgattcaactcattataaactttttattttgaaaaatgttgagaagtagggagaaaagcatgggggacagttacattctcatcacccagacttaggaattcacattttgcggtatttgtttcaactaccttttctgttaaaatatttgtaaagaagtttagacgttatgacatttcagccctaaatattttggaatacacctccaaaaactgagaacatctcaatgtcattattatacctcacaaaattaacaatgcatttcttaatatcatttgatacatagtccatattcagcacttcttggttctcccccaaatgtctcctcacagctgttttgctcgctggtttaattattaaaacattatgcggctgggcacggtggctcacgcctgtaatcccagcactttgggaggctgaggcaggtggatcacctgaggtcgggagtttgagaccagcctgaccaacatggagaaaccccgtctctagtaaaaatacaaaattagctgggcatggtggcgcatgcctgtaaccccagctacttgggaggctgaggcaggagaatcacttgaacctggaggtagaggttgcagtgatccaagatggtgccattgtactccagcctgggcgacaagagtgaaactccgactaaaaaaaaaaaaaaaaaaaaaaaacattatgcaggttgggcgcagaggctcacgcctgtaatcccagcactttgggaggccaaggtgggcagatcactggaggtcaggagtttgagaccagcctggccaacatagtgaaaccccatctctactaaaaatacaaaaatcagctggacatggtggcaggcacctgtaatcctagctacttgggaggctgaggcaggagaatcgcttgaacccaggaggtggaggttgcagtgagccaagattgtgccactgcactccagcctgggcaatagagccagactctgtctcaaaaaaaaaaattatgcaatgttgtgatatatgaaggactctatttagaaatgcatctgggtgccattcctgggctgctttcgaggatgcaaagtggcaatgtaagatggaaagtgttccctgtgtggtacatgctgtcactgttaacttcacctacccttaaagaagaggcactgccacgtccagtcctgtggcttcgtggagtgagtggtggggtcagagggtgtggaaacggaaagacattcagcagttatttcaggtgtttaaaccgtgggattctcagtctcagcactgtcgacctgggggctggagatctctttgaggtggcagctgccctgtgcactgtaggatgtgaagcagcatccctggcctcttcctactggatgccagcacctaccctctggccagttgtgataattaagtgtcccttgggggacagaggagcctctggctaagaaccactggatcagacccagattttctgacatcagcccaggttgctagaactctggtccaggaaagaaagccagagcccaagccaaggggccgtgggactcttctagtggggggacctgctcattgcccctccgccttgagatcagacatcccgtgtgtattaggtcaaaccgtgcggaattgctgctgtatgtgaccatttcagacccacaaaaatggcaatttcctagagttcagcttaacatttacttccccttggccaggagaacctgcttctgagcagcctgcacaagtcagtttcccctctcttctttctcactctctgctgtctgtctccctctctctctcctacaccccctacccccaccttcctcattccctcattttccctggcctcttccccaccccctcgtccttttcccctctttctccttttcgggacctgcacaaagggctggggcagaggtcaggctgggggtgaacagggccaggcgagctctaccacccctccacccctccaccctgggcctccatcaccccaaggagcacagagaagccatttgcatggtgggtttcaggagccccattgttcccctgtctctgggcctttgcaggtggagctgccaccagcctcgaggaggataaagggatgagctgggaggccagaggagcaagtgggggcggaatatttagcccttcttgggagctcttcccactgggggatcaaggagcatggctgatgggaacgggacaagtgacaggtgtcagggagagagaggatgggagtccttggacccacctccatgtcacacagctgtcacagcgaccttgctggcagaggctggcaggggtggggcagtgcaggctgtggagctaggctgaggcaggggtggatgcagagaacccccaggtggcccaggctcagagctcggcctgaaaccccttgcagattcctgtacaggtcctgggctgtggtgggaggggacttgtagcaactgggtcacacctggcctgaggccctcagcgtacagactctcctgcccctattgcagcgggctcgcctggcagaatcttcacagccactgaactggggtgaggaaagcccccctccagccccagagcaggacccacagtggtccctctaattacttaaataccctgccagatctaaaactgctccagacttaaagaaataataacaaccatcactgcaatcctttactggagatcatgggttttgagtatttcaccccactctagctaaagcattctgcaagccatttgttagtcctggagccagtcttctcggtgaaatgaaggagctgggctaaaggatacatttggccccttctcagctcaaaatcgctggggcctgggaaggcctgctttggaggccactttggccaccagaccccatctgctgtcctcccctgtgctgccagcagctgggcagggcctggggtgcagagccagcctcgtgttctggggcacagcacccgggcaatggggggctgcctgggaggttctttcagggctgtgttgaagaaattgtggggaatttgcaccaaggagggtgctcaaccctagggtaggaaagaaaagaggagaatggattggtggggacattgtttaggcagtcgccaggcagccttgctcttgtggacatagaccctcagagttggaaggagcagcacagtggtggtgtggcagggaggctaccagctgccgcctcctgtggctgtcgtgattatgctcagactgtccccagccccacctcctgctgagcaggattttcctctcggcagctctctccctctgctcctaaagctgtttgtgcggccacacaatgcaagtctcctgcctctgccctggggcatggttcatggaccttgtctttgccatccagggcagggcttcaggcttcagtaagggcagtagattggtgtctaggagggaggcggccagtggggcattgcccctccccattcccccctccagagaggtcagtgccttcctagagaagagtgtgacgagtgtcatttgcacagttttgtggtctctgcttgagtacagtgtattgtgggattaaggaaaggagaaagccttctatttgtagagatcaggaatgaagcagagatctgaaattatttgcacagagaggcatgtgaaacttggtggtgttggagccggctcacacctgttcacacctgctcccactggctcacgagggccgactgtgcatctcttcccaattctgcattcagggtgtcctgctgggagtttgaaattggccatggtgggaatatttacacttcggaagttgacaaatggtaaaatcaaagcattttttttttttagttccccagagagccagttgtcagacattcctcagcacagcattgtccaaaaggcatcctgagagtgaaattcaggctctcaataccagaaggaacctagagataggtcatccgatcgggcctgcacatctgacagatggggagactgaggcccagaggaggacagtggcttgtcttaggtcatgcagtgagtcaatggcagaaccggtatttccactttaccacggtccttcaagtagaccatcctttcaagcaggaagctatggagtgacacagaggcttagcaaagcttcctcttcctgaagagggattagaaattcatgacgtgggccaggcgtggtggctcacacctgtaatcccagcactttgggaggccaaggtgggcagatcatctgaggtcaggagttcgagaccagcctggccaacatggcgaaacgctgtctctactaaaaatataaaaaattagccaggcgtggtggagggcacctgtagtcccagctacttgggaggctgaggcacgagaaacacttgaacagaggaggtggaggttgcagtgagctgagatcacagcactgcactccagcctgggtgacagagcaagactctgtccaaaaaaaaaaaaaaagaaggaagaaaaagaaaagaaattcatggaaggggaaatgggttttagagaagactgcttcaagattttcttcaggctgaagctgggctaggcatctaccagcctccctccctcttcccctgccctagtctcctggaccagccttccttctgtcctacgaggccacctccttcagcccaaggattaggaagttgcacttcagcatctaaaaatcttcccatggtccaagataccttcacagtagcttctatcttcaccagagaagcctccaagaaggtggtgaccttttgggattgtcctggacttacccttccctcttcttctttgaggctagttgatggctgtgggtgggatgccagccatccacccaggttatcggagccctgctgtctttggctttaattctccccagaacctcagggggcccgagacagggattcttgtgtgggtgatttattgagggggtgctttcaggagaaaccagtaagggcatgagggaagcacgagagtgcaggggaagaaactgggaaaacacaaggctgcagtggaagtctagcctcagcctgatcacgcgggagcttgggaatcatatccaagaagttgtcatatttacaggcaaaagggctgggcagtgatacctgcccaagtcagtcagccattggctatgttacatgggcaagggcacctataacctcccggatgtctccagggaaagcagtgtccatccgtcaagggcaaacattcagagaagggtgcaagtgtgagctgcgtgcagctgggtgcacaggtccagtcaaggggctctgggcggggctccagccacctctgctatacttggtaggtgatttggtgggaaaggaagttttactggaatctggggaccatctgtgggtttctgttttgtccactctccaagagccctacactgtagaaaatcctggtggttattctctgaggtcccatgtcctccctcctgtgtccagctggtctcagtaatgacagtcttactgatatctctcacatctcttctctagaagaccagagaccaaggggaactggagcgagagaatcacagcccaggagttcaggctcagctgtggatcctacagatccctaagtactgtatctgaccttttgctgggaagatcacatgtagacctcccagagagacttccaaaacagttctgacagacaaaggactaaccgctttcacctacgagggaggccatatgtgtgggaggcaccattgagctccattcctggtacccactaccagctcctgttagaagctggggaacagtgacttgggccccttgggacaagataacaggcataccaccacggctgcacccactattgtcctaattcaaactctttctctacttctcacaaccctgtattggtcagggaagattatgtgctgtaacaaacagctcagatagtatagtccagctatttctttttctttctttctttttgtttgtttgtttgagacagtgtttcgctcttgttgcccaggctggagtgcagtggcacaatctcggctcactgcaacctctgcttcctgggttcaagcaattctcctgcctcagcctcccaagtagctgggattacaggcacccaccaccacgcccagctaattttgtattttcagtagagatggagtttcaacatgttggccaggctggtcttgaagtcctgacctcaaatgatccacccacctcagcctcccaaagtgctgggattacaggcatgagccattgcacccggccctgctatttcttactttataccacagtccatcacagccctggatgggtggctcccttccaagcagtgagtcaggggcccaggcccctttcatcacatggctctgccatcttctagggcctgtcattgtgggtttctctgcatccagccacagtcagggaaagagaacattgggagctcttgggaaacctatggactgggcctgaaagtgttgaggatcacttgtacatgtgtcccattggccaagactcagtcacatgaccaccccaactacaagggggtcgctgggtaatgtagtctatctgcctggttgggcggggagtggagtagtgtttggtaacaacatatagtcttcactgtagatcttctttgatcactctgctgacttcagggacatctgcggccacctgtcatcatgatgttgccattttggcatcaggaagtggtggtgagctttgaggagctttgtgtgtgtttgtaggaagtagtttagcccagtcttagccccagggtgtgcattctgcccaacagctgcctagatttgggttgtaggcaagctaagcaaaggcaacattgggttccaaggcatgacctcattggcattggcttaaccagccaagctaaccggctagccaaccagccgggtggacgttacaggactacaagcatccttctttcatgaccttcccagggagccctgctcagctcagctgaatcacccttcagtgctgacagcagttctagtctgtgtccactgttggctctcgctggagaagcctatagagagccaactggttccctattgggacagctttgttttccctgctgaacacaaaatcccctgttcactgggagagctgacaaggagaccccatggggctggcccggtgggagcagataccaatgaatgcagcgcccgaatggcttcagcttattaaaggcgaatacacaggataactctgcccgccgagtgggagatagaatggagggcacagagctgttacagcggattagcagccgcagacggatggaggcaggtgcagccttttctgcaatttggaagggtttatgaaatactgatcctgtgctctataaatccttcccttgacctcatctgggctacaggctgaaagtgggggatttcttgttcagccaggcttgatagtagcttttagtattttccctgctccctgccaactcctagaattccctgggaattttgataagaggatttatgcatgtgtccatttattcattttctcttcattcattcatcactgacacatttaccaagagcctgggctaggtgctggggttacagagctgagtagaacatggagttttatcctcaagggactggtgtactgtgtgagaaagacacagaaatagaatattctaattcagattgttaattgttaactaaatccacacgtcagcagataccaacataacctttggtgggcctgagccagtggcaggcgtcactaagagactgctaagtcttctgcagcccaagtgaatgaagcctcaagtccaacaaggtgtcttgttgcctctctggatgggctgctgttttttttaatggcacagatggcagataatagaggacgatacttagaactagtggcatagctggaaacttgagttcctctagcaaaaactctagaaagttcatcttatgaggcagaatttgcatcttgaagaaggcgtaggaggctgctggcaggtgtttctctggctcgaatgcagatttggtctctatgtcttttcctcctagagatgggaactccctgggtcagacacccctcatccagggaggtagctcattttagcaggcagaaatctctgtgctctcctcctgggcttacagagctcatctctgctgtaagagttctgaacttactgtgtggctcaaggttttggtgagcatattaccatgaggaagagcatggagtgggtgatttggacctcagggctaccataaggcctgatttccaagggaagaggaacatgagaccagagggctctgaattaaccctgttaacttgtcccaaggggactcaggcgactgttccccagctctagcaggagctggtgcatgttggcttccaggaatagagctcaatggtgcctctcacacatatggcctcccttgtaggagaaagctggttagtcctttgtccaccagaattgttttggaagtctcttgggaggcctataggtaaacttcctagcaacggatcagatgcactacttggggatctgtgggatccacagccatgcctgagctcctgggctgtgattctctcacgccagttcccattggtctgtggatgacagggagtcagggaaacagactcagaggatgccctctaaaactgggaagcaaatatggagcagcagttagaaatcccgtgtctggggagttcttggagggagaagagatggttaagaaataaaagaccgggccgggcgtggtggctcacgcttgtaatcctagcactttgggaggccaaggcgggcgaatcacaaggccagaagttcaagagcagcctggtcaatatggtgaaaccccgtctctactaaaaatacacacacacacacacacacacacacaaaaaaaaaaaaaaaaaaaaaaaaaaaaaaaaaaacttagccaggtatggtggtacgcacctgtagtcccagctactcaggaggctgaggcgggagaatcgcttgaaccagggaagcagaggttgcagtgatctgagatcgcaccattgaactccagcctggatgacagagtgagactccatctcaaaaaaaaagatataaaagatgaacctggcaacttgttgaagcctgagacatgtcctgctgagatgggcagagcagggatgaagtccaggctatccactggcctcttgatgcccttcagcctctaggttccacaccctacagtgggctctttgtgagggcagctgtgtctctggctgtgtttctgctagcaccttccacacagggtcatttgagtctgtgggtacctggagtgtattgagaattcattactttcctaaagcaaacccgatacctttattctccatgtgagaaggtagcagaatttggtcttgccggtggggggacttcagtatctaccatggtgtgacattgttgtgggttgagtggttccccataaatagggttcccagaaacctgagacacattattcattgaaatgccacaaaactgtaaaaaaaaatttggagtggaaatctcttccaaatgtatcaccaacttttttgccttattaagcaatgcacaacaaacataattttacttttcaggatgattcagccacggcacaaggaatcgtgctgtctgaacagtcatagttacaaatcttattcaactgttgggactgtttgcctctgttcaaaatgatattgcgatattctgcgtctgtgtttcatggtttcataattttctttttttcttatttttttattttttatttttttgagatggagtctctctctgtcggccaggctagagtgcagtggcgcgatctccgctcactgcaagctccgccttccgggttcacaccattctcctgcctcagcctcccgagtagctgggactacaggcgctggccaccaagcctggctaattttttttatttttactagagatggggtttcaccatgttagccaggatgatctcgatctcctgacctcgtgatccgcctgccttggcctcccaaagtgctgggattacaggtgtgagccaccatgcccggctggtttcataattttctgcctcttctttgccctctgtttgccagctgttccctcctcctgccaatgtgttgattcctttgtgatagtagtttgactgtttgaacctcttactgcctagttctcacctgtattccagagaatgaagataaacagataagtggctccagtttacaacacttggaggtttctatcataccttccaaagaatctgaagcactttcaggctcaacatagatgtctgtaaagtagggaggaaatggctggtctcttcaattctcatatcaagaactgaggactggttgggcgcggtggctaacccctgtaatcccagcactttgggaggctggggcgggcagatcacttgaggtcaggagcttgagagcagcctggccaacatggtgaaaccctgtttctactaaaaaatacaaaaaaaattagccaggcgtggtggtgggcgcctgtaatcccagctacttgggaggatgaggcaggagaatcacttgaacccgggaggtggaggttgcagtgagctgagatcatgccaccgcactccagcctgggcatcagagtgagactctgtctcataaaaaaaggaaaagaaaaaaggaagaaaagaaaaagaactgaggaccagagagtctaggaagaggaagcagcataatggggtttctaaaaaccatgccctctaagtttgaaggaaccaggaagccttggaaggggaggggctccttcttcaaaagttttgaaggctgttctgagggtgaaacagatggaaggcttgtgctgggctgtgccagaaagtggagataaggccatctgtggggtgacagaagtcaggtgaggctcagctgatggcagtcctgtccagtcctaggatcggtgatgagggagattcagggagattaagagaatgggaatggcaacaggagtgcaaggatagaccacccttagtaaccgttccttccttccttccctccttccttccttccttccttccttccttttctttctcttctcttcctctgtttctctctctctctctctccttctctctctctttctctatctctttctctctctctctctctctttctttctgacagagtctctgttgcccaggctggagtgcagtggcgccatgtcagctcactgcagcctccacctcctgggttcaagtgattcttctgcctcagccttctgagtagctgggactacaggcgcccaccaccacaccctgctaagttttgtattttttagtagagacagggtttcgccacactggccaggctggtctcgaactcctggcctcatgtgatctgcctgcctcggcctcccaaagtgtcgggattacaggcgtgagccaagcaaccctttcagttccaagggggtggattctgtggcctgcgtccagtctatcagtcggtggcaaatggcagtgaatcggggatagcaaggatgcatcagcttccccactaagcaactccctacccttcacataccaggcagagacacagctaccctcccaaatagccactgtaggatgcagagcttggaagttgaaggacgtcaatgaggaataccttactgagttctgggccccattagggtgctgtggttgattagtgatgcctgccatgaggttgggtagagtaaccggtggtctgtgtgctgcctgttcacttgctttccatcagtgctgtcaaccctcatttttttttttttctgaagatatgttgctcattatcaggcctttcaaaataggaactccaggtttcacactttcttcttttctttctcttcttccctgcctgggctttcattaccattaagagccagaacttatctgccatttggatgaggaacttcagaaacaggtgcaggaagagaaacttgctctctcaagtgcagcaacttcttgaatgtggcccacttcccctggaaggctgtgaacaccactttatctcctaaaggcttggctggtgggaggaggggcaggaagcctcatggacatgagggcactatttggggaagggtatggtggcaagaatagatgggggtagaggaagctacacggaggttctgcctgagggctgggaagccaaaaggatggtcccttgaaaaggggcagccaggtgcagtggctcatgcctgtaatcctaacactttgggaggccagagcaggaggatcacttgagcctgagacttcgagaccagcctgggcaacatagtgagacctcatctctacaaaaaataataaattagctatgtttggttgtgtgcacctgtagtcctagctacgtgggaggctaagtaggatcattggagcccacgggttcgaggctgcagtgagctgtgattgcgcctctgcgctccagctggggtgacaaagggagaccctgtctcagagagagagagagaaggggcagctcctgcattgcgatggggggaggttaagggtcagtactcactagtcaacaggttgccatggctctgtgtatggaaagagacccctctgtcctgtgctggagtggaaggcagctgtgttagggaatgggcccccaccggccagtgactttggatgctgaacacttgtacctctgttttctcctgtgtgtaatggccatggccgtcctaataccacccgaactgcctcttcctatgtggctgtgcagcttactcgggacattgggtggaaagcactttggtgagagcttggcaggtgtagactcatcaccattccggttgctcctgccgcagacgggctgagctccaactggggcatgcctctgaggctgaggcagcatctgtaggctgggaacagggtgacccctaggtctgggactggtggcagagcagggtctggggtgacttcgcggtagaagcaatttcctcagcagagttgacactggctggggaggactgggactgagcagctgagggtcaagagaaaattctggatgtccaggagctggttcagccagctgaggtctcctgcctccagtcaggagggctttttgcagtcccaaatgctctgggcaagaggctttaatctaattacatgctttatttgagccaatttgttttccaatccatcttgttcagcaaaaagaaagagcctgctggggactcatttgcaccctcttgttccaagtggagaagaggggttgagctcccatctcacatggtcagtgcagcccccaacctctcccagcccggccaccccacccctgagccaggctgcagactgccctgccctcggggggagggggctggggcggctcaggtagaaaaagcctggcaggcttgccccctcccagaagtccaccccagcgtgcctctccgtgccttccctttgggggtcccggtgcactaggcaggaatgacacgggatgggcttccaggccaggcagcctgggaggggatttcatcctcaggaggtcacccagcctcggaaccttcctggctcctcctgtgagagctgccctcagaatccaatgccccatatttttaaatctgcaaatatattttcatcataaggcagtggatttaggatctgtgttattaaagtccaaacaaaacaccaaagcccttcaaacctccctggagagggaagatttatcggctcctgctctcctccccaggcacggagccacactctccaagcttcgctttttaagttttgcagcattttccaaaattgcctttttctgcccttccgattcctgcttggagcctttacttttcggctgtttacagagactcgagcctggtgacttccacctttggagtatgggagtgccggaattgctcggctgagggtcactttgtctgccgcacagtggtggcagctgcgcccgtttttattgaacttgctcaacaaatatttattgagggcttgttatgtgtcccgggccctggggatacagcagtgaagacttcactttggggaggaagagatacaataaacaaaccaaactgaaaaatgtatcactgcacagggtgacaagtgccgtgaaggaaccacatccgctacagatggagttgcttttcagaacagccagaggtcagccattattcagtgaatcaaggacatacttgagtgagaaatatctttgggtttaaaataattggatgtgccagtaatacaataaaattgcttttctgccatggctcctaaactagagtaaagataatgagagccaacattttttagtgcctgtcatgtcgggcttcatctcgctggaactttaaaagattgttacaaacgctcacccccgcttaataaatgaggaatcggaggttcagagaagtgcagcaatgtgtccaaggacacacagctttgtaagtcacagagccagcattttgagttccttggtcgcctgtctgccaccccctctgtcctgctagatcctttccacttcccagcatcctgcagccctgaagctcatcagtagtctgagaccattgccactggagccgcggattgtatcctggggtccaggaagagatgttcttgtccaactaacaccccacaccccatagacagcaggctgaggcctgcagaaaagccttctgattcagagctcaagggtcccatttttcagatattagctgtacatctgttaaaggtggcatggccttctgatttctggtgccactcaaaccctctccagcccaactcgtgccctctttgttgtcaaagagtttggcaggtttaaaagatgcctaaaccagctgggtgcagtggctcacgcctgtaatcccggcactttgggaggctgaggcaggtggatcatgaggtcaggagttcgagaccagcctggccaatatggtgaaaccccatctctaccaaaaatacaaaaattagccaggcgtagtggtgtgtgcctgtaatcccagctactcgggaggctgaggcagaagaatcgcttgaacctggaaggcggaggttgcagtgagctgagatcatgccattgcactccagcctaggccacagatcgacactccatctctaaataaataaataaataaagcctaagccctttacccaggctgtctcaggggtatcatcagaataattgcaaagggtgctggctgacgtcttttgtttggggagcctgtgtttgtgggttcgttggtccaggcagctttggtgtctcacagagacagccgcagtcagcttattgtccagagtgtatgtgccagtgggttcgctgagcagtcagcggtgacctgcactgtgctaggtgctgggacaccaaggtccgatttgccaggggaggaggcagacagaaaatcccagaccaggaaatgggcgctaagaacctggaggttttcttgtgcctggggctgagaggaaggctacacagggaagtggcacaggaacagattccaagcacaagtgccaaggggaaaggcattcatggcctccggcttctcctaatacccaagagcttaggtcctgttttttccagatattattttgcaaataataggattctaccaccgtgcactccaggggaggagtagacgcccccttgggcctgatgtactcttcatccccagccctgcctggctctaggcctgtggcacagccaagaaagggaccttgctcctgtccggagacagggctgcatcagccagatcccaccacaccaacccattttcctgtatctgctaaggactggacccaggacactgcatctcagatctcagctctcctcctggcctcaagaggccccaggatctggccctgcctttcccactggcctgccatcattcaccctccactctcagctgcagagtcggaggccacctggagcccatcacatgcagttggcagcaccttctcatccttcaggacacagctgagaccatctctgacctccccttacccatctcacggcaccatagtcatttcctcctaaatcctgtgaatgggtagcagttatgaccatcatcactaccacattttactgatgaagaacttggaatggtgaatgaccccagatcataggttggatgtgaaccctttccctgcagccctgctcagtagatttccacttacgtcctggggccagaagtagattcatggccacggtgagctgcaagggaatctttgaagaagagtattctagattggagacattagggtttgctcttgaggaagaaaggaaaatcgatattgcagggggccagagcggacctgtcagactcaggcctggtgtttgaggctgtcccagtgggtggctctctaggagacagtatacaggaaggcaggccttggccctgggtgtgcattgcacagctgtgtgcacctccaggagcctgcctctgcccctgttggtgcaccaaagggaaccatcagagaaggtggccacaactagggaggcagcagaaagaaagggcagggcttccctgggcagcacttggtgggggccagggcaccagggccccctctgaccagcgaagccccgaggaccccagcttggtgcaggaagaggacccagtgcttcagtttgccggtataaaaaactcacacccatgcttcctcacctgaatacatagttgcagtccctgagacagaatgtagctcaggcagcagaatgacagtctaggctcctgagagccagaccctggctctttgtaaccatggtacagagtggagagcacgttctggtaaccttgggcatgaggtggggcctgggcagtcagggcaccgtccctgagagggtgagagcaaaagccagcctctgccctatgtgatgaaacccagcagccctaggtgacctgggccaggccaggcccctggggtggctttgcatgacatttaaaaaagaagtcaaaccctatccagctcccatggcccctcaagctctgggactcatctctcagctgctgcccctgtccttccgtccgtgcaaggaactccaactttcatccagtccctgaaccatgccgagctgggtcctgcctcagggcctttgcacaggctgctcctcctgcttggaaccctcttccctcagaccttcctgccctgcctcctttgcaccgtttaggtcttgttcatgggctacccctcagggagctgtctacagccaccctggctatggcactgtcctcactcccagccaccttaccatgcacacagttggcattcagggagaggatgaaacctcacacacacaggcacatgtgcgtgcacacacacacacacccccacacccacacacacacacactcttctgctgtctcctggggagggggtagcacttctccacagcagaagctctatagattggaaatagaaatgtcactttgttgaatacagatgtcatttactataggattcccaccccttgtaagtaaatggtcctcatcctcgctaagaagagcctcacctcggccggtcgctcacatctgtaatcccaacactttgggaggccgaggcaagcggatcacctgagctcaggagttcaagaccaacttggccaacatggtgaaagcccatctctacaaaaatacaaaaattagctgtgcatgatggcaggtgcctgtaatcccagctacttgggaggttgaggcgggagaatcgcttgaacctgggaggtggaggttgcagtgagccaagatcacaccactgcactccagcttgggctacagagtgagactccatctgaaaaaaaaaaaaaaaaaaaaaaaaaaaaaaagcctcaccttagactatttttagtgtttctttctttctaacacaagaattgtatcctcattgcagtaaattttaaaatatacctaagacaataaagcaagagtataaaaaccagccacaggcccaccacccaacatttctggcacatgctattcttctagaataaaatccaaacccctgccattgttgaaaaggccctagggactccctgcaaactgtaagcctcatctctggctgtgcaaaccccagcttttgccagctccagtctcccttccttttggtttctcacactttcctgccctggggcctttgcaactgccgagtgctgggatgctcctccctgcacttcctggggctgatcccttgtcatctgagtgtcacctcctgggatgggtctaagtaggtctccacctgtgccccctgcccccacgcattccctcccagtgtgctcggctcactgtcatcatttcctgagtgtcaccgtcaggaatgggagtgatgacactcgtgctgttggcctctcccctcctgctgtgatgccacccactgctccattagccttggggatcacccagtgcctcccagagctgttcatgtgggaagtgcttcatcaaacgttcgaatgaatggatgataaattcctagaagtgcggttgctgcgttggagtatgcatgtgtatgttctcagggttttgacactcaatgccagccacgctcgggaaagttcatattttaatctgtgccccagccatatcgtgtgagtgtgtgtatgcttgccttcaccagtttgctaggcagaagcgctatattcttgttggtttatgttttgtttctttgataatttgagattgaacatgggtgcatctctttgttccctttttatttcctcttttgtgaatggcctgttccttccctttgaatttttggttgctgtctttttcttagtgattcagaagagttctttatatgtgaaagacaccagtccttggcttcctgtgttacaaacattttgggcttgcttctagacccttacttccataggttgctaagctccttggccagtccattgctagaagatgcttcatttggggcatcgttagcctttctgcccccaaggcccaaagtcaaatgagcattttgcttttgaggcaggtagggcttgagggtgatggattgggtcagcgagactagtacaggcttagagagatgggtgggggctagagatctgcctgtgggccccagctctccctgacaggtggctctacccctggatgaggtgctgttggtgagggtggtaagaaggtggtcttacctggggcagggtggggcaagtcacgaagtcacctgcagcctaggaccaagaggtgagagccagcttcctggggagtgtgtcctccattctcatcatgcctcgcgcatgatggcccttatgaaacccacggatgcctgcggcaccttgaaaaccgaacacatggaaatctggactctctggccgcggagattccatgcagctttctggttctagatcaggcagcaccaaacatactttctgggcagactggcctcatttgccttttgtcacctgctggtgggcagaatggcccagccgaaatggacagagctggctgggtgcccctgttagccccagcctttctccccttaaactctttcaccctgggccagggagaaccaggggctcctcccctacgcccagcccttggcgtctgcaacttacccaacccttccaggtttctctgcccggggaggacagaccatgttggctgggtgtccctcactcattacaccccctgccccaccttcccaagcccgacagcccagaagcagagcggcagaggtgttgcgagcgagtgggccagggctgctgagagcgagacctttgccagctccccgccctgctccaaggggaggtgccagatgcggtgcccctggcttcaaccgtggccgccgggctctgcctgccatatgctcagagatgagcctcgatccggcgagcaggccggctcagcaggattttggcacctggggcacaggaggcagaccagaggggccagctacccaaggtggaggaagaggcaggacggtctcggccgctgggattgggcctgcaggccacctcttggctcttggctgtgggtcggtcaggggagcaggtgggaggaataaaagggagggtaggctgctcccaggaggagccaggatgccagccagccaggatgggcctgctgcgagccaggcagatggtggcctccaggtctcagtggctctccctgggacagagcacgtccgagtagggggccaggcagtgcctgtgtccagccctggcagcttctgtctctttttgggcagtagagtgagatagaagggcagccctggtgcaggacctcctgcagagctgccagtatttacctgtgccctcaatcctagctccagaggctcccctgagagagcagggcagcagggcgttctgcctactctttacttgttactcctgcatggagcaagtatgtcctggcagggtggatggggtcccagcggctgggtggtggtaggatgggaaactgtggggcataaaacgttgggtctcctggtaaatgaggctgatcaattggcccatatagtctgtgtgtatatatggttatgccagcttttatattaaggctgaatcatataaaactgcttttttaaagttgcaaaatggtccatttttagcactgtcatctgtttcatcttaatagctttccatctttttctgtgtttctgaacagatcaaatagcgtgaaatcgatttgtcctttaaatgtttacatggacctacctctgaaaccatctctatccagacatctctcatgactatttttctgttcagattccatgtctcttactcagtttaatttgctcctttatgttttcctaacattttgcatttcattcagatttccaagatttttaggctaaagttgtatatactagccttgtaatttatttcttgttacttcttaaagttccgttttctttcttttatttgtagttaaacatgacagtgttttgtcttttttttttcttttagtttgtatttgggcttttcaaagaatcagttcttggatgtatttatgtattttttctgtattctactatatttctacttctgttgttattaattcattccttttgctttctttgggttttgttttgctcattttctagcttctagaattgaatgcatttcatttattttcattatttcttctttaataacaaataatatcattgtggtcaggaaatgtggcttgtatagtttgcgcttcttgggattaatttagcattctttcactaaggatttctgtctgtttcatttttgtattactattgatttttgcttaatatatttcaatgagatgttattctacgtcaaaaaatccttgtttaattactaggtgatgttctttttccactataaacatgcttgccttgaattctactttgctgatactaacatttccactcttggttcgtttcttgttttcatttgctgatacatctttgctactgcttaagttgtgagctcttaaaaaaaatcactttaggctgggtgcagtggctcacgcctgtaatcccagcactttgggaggccgaggcaggcggatcacgaggttaggagatcgagaccatcctggctaacacagtgaaaccccgtctctactaaaaatacaaaaaattagccaggcatggtggcaggcgcctgtagtcccagctactcaggaggctgaggcaggagaatcgcttgaacccaggaggtggaggctgcagtgagctgagatcacgccactgcactccagcctgggcaacacagtgagactccatctcaaaaagaaaatcattttatttggttatattccccttaaacagtactctgttttaaattcagtttttcagtagagcagttggatccatttaccttcattgttttgtctttagtggttgctcttctgtgatcttaatttatcataattgctttttatatttttcattttttctgttttatcttttggcatattacctataatttatatcgtttttctccagagttctgtgattatctttgggtttttcagaagcattagttgatctaatagctcttacttgtcagaatcgagcatgaaatagcattttttacattctctatacttaagacaaagggttttattccccacctcattctacttcatagtttttaatatgatctgaagtttcaaactaaatttaaatattttatatatacatagctagatagatacacacacacacacacacacacacacacacacacacacacatacacacatggggacagagaaggagacagagccactgatgttccctttcaaacagttaaaaataattttgatatttgcattatgtttaagaaccaaatttggcatctctatgtttactggtttcagttttcatcaccagtaagcacagagatatcaatcacatcaccttgtgtttatgccatcactttcccctgtaaactcttacttttgactcatttcatagttggttggaaaacattctcaagtatttatttcaaaaaggatacataattggaacattttgtgagcccttgcacatttgagaatgttttttctttattgtggcctatatagtataagacagtctagctaggtataaaaatcttaggtcacaaatttttccctttaagaccttatagacattgctccatgatcatctcactggcttgttgttgttgttgtttaatctgtatatattcttttcttgtcctggtatttcatatgttttgcaaagatgtgtctggatgttggtccccttttgttgatttttggaaaacttcagtgagctctttccttctaaatatgtaggttgtctttttcctctaaattctgtaagagtttctccaatttattctccatgtttctggatcagttttctacagtatcatgaatctttgctgctttcaaagtgggttacttatttatttttagagacagggttttactctgtcactcaggctaaagtgcagtggcgcagtcacagctcactacaatctcaaactcctgggctcaagcaatactcccacctcatcctcccaagtaaccatcacgcccggctatggtctttttgtttgttttatttcattcttttaagggacggaattttgcagcattgcccaggctggtcttgaactcctagcctcaagcgatcttcctgccttggcctcccaagtgctgggattacaggtgtgagagcacacccagcccttctgaaggggattttaattgtgctacaggggtttcatctttttccaactctttcttttatgcatcaccctttttgtttcagctcagtttaatctcccttactgcctttcttctcctagttcatagaggctttgtcattttagtctttttagtctgccatgcccatttggcatgtacacctattgtgtatggctgtttttaagctacagtgacaaagatgaatagttgtgacagcaactttatggtcccctatgcctaaagtattcaccgtttggtcctttgaagaagaaaaaaattgcagatccatgtactggtgcaatggctggattcccatctcagatttaaggaggatggccaggaaggcgcacagctctgtcttcagctcctggttcctaccagcctttccctggatttccttctgctctgtggaggtagtgctcttcctttctctgcattgcctgattttctgattctctgcaatgatttagatagaaatacaaggtgagactgggtgcggtggctcacgcctgtaatcccagcactttgggaggccaaggcgggtggatcatgaggtcaggagttcgagaccagcctggccaacttggtgaaaccctgtctccactaaagatacaaaaaattaggtggacgagctggtgtgtgcctatagtcctagctactcgggaggctggggcaggagaatcgcttgaacccaggaagcgaaggttgcagtgagccgagatcatgccattgcactccagtctggatgacagacagggcatgactccgtctcaaaaaaaaaaaaaagaaatataaggtgacatctttgctgtactgctgtccttctggtccctagtggtcctgaaacttcccctccctggaggagggatcgtccccactgcccccactcacttcctgcttatttgttctctggtctttgtcactgtgtcctcctcccttttttcaggacttttctgctcatcagacaaagagctgtgtcctgaggtaaaacctgaacaggttttgcttagtccaccaccatctgcctttaattactagagattgctcccagatcccagcgttgggtcatcatcagtttcgtttttggcactagtgtgaatgttcaggtttcctcattgtctttatggctgttttggaacaaaacaaggaggagctacatgagaggctgccaaatagatgccagtttgaagaaggagtcaaagctgcattttaaaggtgtggtttgtccatcttgaagcactctctgtagctttgtgtgtaccatagagagagaacatacggtaacattttccttattcgggggccattgtccagtgacctcagctatctggaatacaacctaaacaaagagtccacaagcagccaaatagctgtcacagtgtccatgttctgaaggttattcactttacctaagggagaacatttcagcctctccttccaagcctagttacctgtattttacatacaattctagcaagcttggtctttgttttcctagcaaatctgaagggcataggggacattttgcaacaagcacactgatctgacaagaatttccagctgacagaaaggaaagacaccaaaaaaaaaaaaaaaaaaaaagcaaacgcaactccaaatgctcagagggtgatgtcattttctgtaagggcaagcagcctgaggttctccctgtgagcactctccagtttgactcagcagccaccttctctggatctttcctctgccacactgggtgctctgtgcaaatcatgggtgtggagactgtccccatctctcacagttggttcagactgtggttctaaccctggctgtgctttagaaccatctggggaacattaaaacttcagacactccggccattccctaagacaaagaaatcagaaagttctgggagtgggacccaggcatcgtgatgccactgcatagccaggactgggagcaggaggttaagagcagggactgggctgccagactgcctcattgggcacacgaccttgagctggtgagtcaccaatgtctctgtgccttagattctcatctgtaaaatggggcctgattgaagggccaagacgagttcatcaaccgtgagaacagtgcccagcgcctcattagtttcgtgagagtagctgccattagtgaggtacagactggatattcatggtgatgactgtgatttgtcaagcagggcctgtgagtgcaatgtaattaggcagtgatggatgccacacattctagggcagtctctgtcccaggtagacacttggctctggagagaagagctgtagaggtttctaggctgggacagtgacgctgaagggacaggggcaggctgtcccaggactcatctgccttcctcctgccccgccccccacccccggggtggggcttaccttgggcgggctgctctggaacctttctgagctctcagttctaagctaggcaccgcagtccctccctcaaagcatcagatgaggctcggaagagctgacatgctcaaaggcaccccctctgccacagcctatgctatctacaaggctgagatggagaggtgcgccttggcccatggtgaggaggccggtgaaagggatttcctcctgattggaaatgaaagtgctggtgtgggatgatggcttttgtgaaaaaaaaaaaaaaaattgcgaggagagtggattgaaggccacccctgcaagaacgtcactcggcacaacttgcattccaattcgcttccctaagtggagaaagcaggaagggatttcagccagctcacgcagaatcgccaggacttacgcacaacctgggttcagccccagcagtggctttattgtgagcgtcatctatccctgagctggcaaagatgtggcccagagcggctgttcctcacagggaagtgcggccgcggtgctgatggtgctgatggcgccgttgacttgagtgtttgggctgccgtcactttcatcccaacctctcaggcttggccacagtagagtgagggccactctctctggacagcccagtccctgcaccccaagaaatccctactctagtaaccaagctgctatccagatggcaggagggatggggactgtggccaccagtgccatggagcaggggtgtcatgaaggggctccgagggctcagatcatagggagcaggaagcagggctgtttttctcccatttcctgagactggttcctaactgggggccccaagagtctggcacaggaagcggtgggaggctaccacacccatggcccccaaggtagtgggatagagctgcattgatcttcattgaggcaccagtcaatgtatctcaggacctcgatggaggcagtggccttcacaggccagaggccagccctggagaggtctccctgaacactccctgcagatctaagtcctgggttggggtgcaggtggcactgggaggcctctgctttcctgcttcggcttccccttgtgctcccacacaaatcactcctcccctaccttgacctttgttttcccctctgcgggataggacgctgccacctgcccctggagcagccgcccgtgtgtgtgcacgtgtgtgtgcacgtgtgtgttgaatctttcccctcctggtcctcttttcctaatccctcaccaggacacacacccagccaacttccatcaacccatgccaccactgcttctagaacaggctgggccccctgcagctccctgcagctccccgctcctccccgctggccagcctggctggtcttcccccaggcagtctgggaattgctaaaatacagggcattcctcatccctggctctgagctcacctctgctcacactgagggggaatctgtcagagtatcgcctaaccaagagtgcagggatcttggcatctcaggccagccttggcagtagctacccagagtgcactgggcaggtggcttaccctctttgagcctcagtcttcttgtctgtggaatgggaatgatacctacccatcaaagaagggttgggagaattgaatgagatcctgcctgctgagtgctgggggcagggcagactgggggagatttgctgaggctctggtgggctgtgccgtcacgtgaagctgtcacacacagacttggcgaaggaattgtgtctccttgttcaaagaacagcgatggctggcagggaaaagccatggttgggctgaagtgggaagctgcatttgggggttgacacaggcccaagggctggcaggccctggtgccctccacatcctgcttggctctcggttgggccctggaatcccccagtgatacccagtggacgcaggcctagcagccctgcctctcaccagtagggcccattagaactgaactcgtcttcgtggggcattttatttgcacactgcagtagagtgaacaccaaaggggttttttaatgcttcatgggctgctaatttcccctgtgacctcttttgttgaggcctgaccccagccagaggctccgcaccatgaaagccagcgcctgacacagacccagggcgcggggtgacaatgaggcctctatcggctttaatcaggctccagttgagtcttaagaatagggagaatctgtgtggtgctcagaagccctgggtggcaggagccccccgagactctcacggaggccagggtggttgcaggcggtggctgagggattcgtcaggccagggagggggtgggtgggtcggacgggggccctttgtccctcaggcctctttagaagcgcaggcctttcctgaatggccgcctgcccgcccggcctggcccatgggtatcacaggcctctggctatttagggaggcggcctcctactctgcccgccagcctattcatcgccagcctaattagtttttgtctgtgctccccccccacccccctgcagactgcgattcctactgcaaggcctccaaggggaagctgaagattaacatgaaaaagtactgcaagaaggactatggtgagtgagagtccccttgtctggggaggatgggagggggccacgtgaccagcgaggtgctggggctggggtgcagctggcccccgatgggtgttggtcgtgaagaccctgtgaccgatgggaactagccggacggatcccacgcctgggaatttctcatcttttcctccttggccctcagagacgggggcatgaggagcccagtggcctggtttctccccttcaccctcctgaggctgggacacccaggctggcctctggctttgactctgccgctgatgggctgtgtggccacagaccagtggctttacctctgtgttcttctgtgtctgcatcatactgcggggatttgacccgagtccacgtggctcaaagggaagctctctgggcatcagacaagggctgggagctccccggtgcatttccagtgttccgccaggctgtagcggggccgggagtctgcgctgtaaacggctcaccactcattcccatgcaccggaagttccgctgcccagacccatggagcagacagtcctgggggccacctgcagagattgcttgtcacctgtgacctcaggctcccttcccgggaagggtgtgtcctgtccccttgctctcatggtggtcgtggagagtggagatggtctgggagcctgcaggaggagggccccgcagtggccagcgggcaggtgtgtgtgaagagctggggctggtggcaggggctcttcagaatgggggacgcaaatagaaaccctgaaagcattgtccagctgaccactggcaaggcccccgcatacagccagggcatccatgtgggtggctgaggcccccaccataggccgggaaggagccccaggcccaggactcctgaatccaggcctggttctttctagcacggggcctctccttgacctggtgggccagggattgagcctggggctggccccccaattctgggcccacgaaagtccacatctgcccacctccctccgtcctcctcctcactccagctggacatagcccatctttcctgtcccatctttaactgaccccaggaggtgcagcccctatcccctcagtggccctgccagccccagcacctcctggccacctctgggaaggcagaacgacctctctgttctgctcagcttcccaaggctgtcctaatcatatgcttctcaggggatctgggatgagtcccattgcttacctgagcctcagtttccttatatgtaagatggagatgatgccacttgctgagtgtatacggggaggacagagcacgggtgcctaacaggctcccagcaaacagtgacctctgcgtccaaaggaagctggtgaggaaagaggaggagggaggaaacggcggtggaagaagaggggtgagaagcgaaggccacctgtggaggaggcctcactatccagaatctgagctccgtcccttccctgaccccgtgggggtccggcagccctaccctgggacccagacctcatggagatcctaactgggccagctgcttgaacaaggctttcttctttaataaggacagtggtcaggaccttttagcacagtgaaatgaatgacgaggcccaaaggtatctaaaggaatctggagaacttctaaaatgttctcgtttattgtgtgtgtgtgtgtatgtgagagagttcatacgcacactccctacgcacacactgaagccagggtaagaccccagtaattcagccccattccccacaggccttctggccttctacagggtgaagaagagcagctggcaggtattatgcatcaattcagaagctgccaggctatgggcatcaaagttcaaggcccttcaggggtctacagtcaattcctaaaagctgcgttaagctgtatacatcccagggcagtgcagaaacttccacctcccacgggaaaataaacctagatttagaaatgaaacttgcaattactttaagataaaggaagtgcgtctccaagccaggaaagtaggggccctgggttgttttgaaaggagctcagggctgggtgtggtggctcacgcctgtaatcccagcactttgggaggccgaggtgggcagatcacctgagggtgaatatttgagaccagcctggccaacatgatgaaacctggtctctactaaaaatacaaaaattagctgggcgtcgtggcgcacacctgtaatctcagctactcgggaggctgaggcaggagaatcccttgaatctgggaagcagaggttgcagtgagctgagatcacatgactgcactccagactggcctgggcgacagagtgagactctgtctcaaaaaaaagaaagaaaggagctcatatggccccggagctgcagggactgcatcctcccagccctgggtcttcagtgtcccctggggactgttaggtgggccatggggcaggcctctctccactcccctaggcagccctcttgtgagatgacgacttgagcaggacgcccaaggctcttgtagctttcctaggctttggacctgggcaccgcagcactgtcctcctagcaaagcggtgggcccagaggagttaatgggtcgcagagggaaagccctgtgcttctcctctccccatccttccctgcacaaggcctaggggtaacctcggcaaggaggtaggaggggaagggagaggaataggtgggcttgcttggggaatggattgttttgatcgcctatttggtttggttttagtctcgaagaactctttaagcagctacactgtggagaggcagctgggagcaaggaggaaggcactgacccacagcctctgctctgttctttaatcatgaaatcatgaaaatggggcttgtaaaagggcccaaaactgatcctgtgttccactggattctatttgactcaacctggttttcttgtcctctgactttgttccttccagtgaattctgcctccccaacaatattccagggggcaccttggcccctcagagctctcctggcccctcacctcttctcttcaggcagcccctctctgtctgccgaacctgacaccctcctttcgtagactcgaaggagccccttaggccttccctgcgccctgccctgttgtggccgccctgggcaatggggggcatctctcttggggcggggaagggtggggcagagcctcagggtgccatcggaccctctgttccctgactcagccttccctttgcccgacacccgactccctcatgggttatcagcaaagcaggtagcagggacagcgggcttcaggttgcttgggtcataggcagtgacacgggcctggctgggtgagatgacttgcccagttacccagccagggagtggcccagcctcccgccccttccacagcagccttccttgagtttttccttcccatcacaattcctccagagagctgcgggccagccctgtgtgctcacctttctagacctaatggtggttacccggctcctgcccccacacccatggcccaggcgcgtcacccagctgtccacatttctgctgcaagacaaggctggaggaacagcaggtggggatggggtgggggggcacagtgggatcccccctgggagctgatgggggctggggctctggcaccactagctttcatgtcctcctcaccacactccaagcctgtgactccacagccaggactgacactctccctgtgattcctcagtcctgggggtggtgtggtgtttctggttccaggactgttcctgggactcttgtggtcacttaaaagttgggggcacttcgggaggcagaggtgggcggatcacgaggtcaggagtttgaaaccagtctggccaacatagtgaaaccccgtctctattaaaaatacaaaaaattagctgggtgtggtggtgtgcacctgtaatcccagggaggctgaggcaggagaattgtttgaacctggaaggtggaggttgcagtgagctgagatcgtgccgttgcactccagcctgagcaacagagtgagactctgtctcaaaaaaaaaaataaataaaaagttggggagtcctccccaccctcagctcagcctgtgtgttcaggcaggaggcaggccaagaacaatgtctggaaagggatttcacgggcctctgcggagggctcagaggagccctgcggggtggggtggcagggcctcggggagtgtgtttggtcatagaggagtgagtgcccccacaggggctggcggggggccctgaggacaatgccaggcccacgggtttctctgaggctgaggcaaggcctccagtgggctctgctggcgtctgtggagaatctcccatgtgtcctgtgttgggcccctggcccccctgagaaggtgtgtaagggggtgtccctcccacacagacttgggccagcccagggagaaggtgaccagtagggggagggcaggagggatctggcctggggatgagagagcaggggaggccgccaaaccgggcgggccagggcgggccgggcaggggctccctcggaggctgcataatccccgctctctgactgacacccggcagggggccaattaggaaacacatttccttcacccagggcacttggatgttccagaagccgctaatgagaacctggggtttgctgcccctgctgggtgaagagcaggcccggctgccagcagccccggacccccttcctcctccaggcctcgcagaccttgccctcgtgtggctgaagagcgcgggtctggggctccgcggacctgggcggcggccagagggtggaaggctggggcggtgggggcccatgagaaggggcctgtgggctcggggcgccggccctgtcccgtgttctctcgggcacacgcttacagagagccagagcccagctcccgtaggcttaagggcacgaagcaaggcaaagggatttggggtcggggggggggcctcagtgccaaggccctgccatgccactcatatcggagggaccccaggaccgaagggagcgctggagacgcaggttcctaatttgctgtgtgactgtggacagggagcttcgccgccggggcctcggtttcctcatctgtcacatggaggtgtagtggagggcacatgatatccttctaagtgagaccctggctgtgccccccgcccacagcaggcaccgtgtctaaggggtgggggccgtggggaggcggtctcgtggggaggcggtctcgtggggaggctgtctcgtggggaggctgtctcgtggggaggcggtctcgtggggaggtggtctcgtggggaggtggtctcgtggggaggcggtctcgtggggaggctgtctcaggtcacctggccgccctctcctggggcactcagtcctctgttaccctctaggggatccggctgttcttacaaatgcttggaggagagccgccagggaggctgagtgggtagcagttatttccagaagataggttttattattttcaagcatattcgcgattcctgccagcttctcaggaaagcccaaccttggagggacccttcctctgcgaggaggcggcgagtgagcgtgggtgtgtgtgcgtgctcaccacacagttggcatcctgtggggcagctcagatacaggcggagcaaggccctgctggaggcacctgccctgcggtcacacagcacacacctgaaaccacagccccggaaaccaccgccagggaactggagcatcccagccccgccccccgaggccccgcctcacaccccaccaagccaagaggcttccttggcggagcccctctgcctcctcctgttcccttcccgtctcccttccaacctcttcctcccatcccgtccccgtgctcctgggaagaagctccactgttccatcctcacctcctcctgtctgcgctgcctcccacgtctcacacaaccgctgtgctcacgtccacaccactcacaggcacacataccacacacgcatgcacacataccacatgcatgcacacaccatcacatcacatacaccatcacacacacacactttatcacacaggcacatataccacatgcacgcatacacacatacacaatcacaaacacaccacacacatcaaacacagatacacagactatcagtcacactcacatcatacacacaccatcacacaccacacactatcacacaggcacacacaccacatgcacacatacatacaccatcacaccacacatcagatacacagactgtcacacacagtcacacacatagcacacacacatgcacatacacaccatcacacacaccacacacatcaaacacagatacaccatcacacacaggcacacacactatcacacacacacatcacacacgcatgcatacacacaccatcacacatcagatacacagactatcacgcacacacatcaaacacaccatcacataccacacacatcagatatacacaccacacttatacagacacacgtatcacacgcacacacaccacacacatcagatacactatcacacacagactcacacatttatcatacaggcacacataccacacacatatcacacacattcacacactatcccacactattacacacataccacacgcattatcgcacacatgcacaccccatcacacaccccatcacacacacaccccaccactacacgcataccactacacacagcatcacacatgcacacaccattacacacacaccatcacagcactgcacatcccgagaagtcctggcccagcctcccctccacactcgttcattgagcacctgctgtgggccccatcctgccctgggtgctgagcttgcagatctgtgtgaggctcagtcctgaccctcagagagcttacagtctaggaggggagaccgacatacagacaagggccacagaaggagggggtgtggccgggttgcagcctgaggtgggcacacacacggtgtggcccattctttagagggggcaagggtgggaaggcttcctggaggagggagcctgagtagccagtgctcactgggcaaagcagggctcctcggtggagggaggaaggtctctaagcaagaagctaggcatagcatgaggaaacgggagaagagtaagagcgggggcgttcagtgcagtgtggggcccagggaggctggagagaggctggtgttggcctcatcagttgcatctgtgtgccgaagccactctgacccctccagctcacgtggacacgcgggggctcccatccacgccccgatcccctgcctcaggtggcctgggtgctgccgctggcttcttcctactccctgggactcagaaagagggggagacagagagctcacattctgaaaggtgagatcatctcacttctgccagttcttggaaaagttattcgttcccagaaatgtttattagtcacccttttgttgaaagacattttggcaccaccagatggaaaaatcaaaatgcttctcacaggacgatttgtctcaagtattccgcctgacatcccacaaggatgatttctgaggatacaactcaaggaggatgttctgttggcatctgtggggagaagccagatctgttcagctgtgtgtgtgtgtgtgtgtgtgtgtgtgtgtgtgtgtgactgtgtatgagagtgtgtgactacgcatgtgtgattgtgttcgtgactgattgtgtgtgtgtgactgcgtgtgtgactgggtgtgtggctgtgactgcgtgtgtgattgtgtttacgactgagactgtgtgtgactgattctgtgactgtaagtgtgactgtgtgagactgtgtgactgggtgtgtggctgtgtgactatgcgtgtgtgattgtgtttgtgactgagagtgtgtgactgtgttactgtgagtgtgtgactgtggctgtttgtgactgtgtgagactgtgtgtgtgtgactgtgctctcttgggggtccgtggaagcagtgggcctggggacctgagcagaattctgatttgcatcaccataccgtctgcgtgccccggtacctccagaaccagtggaaaccaagtagagggcttgcccagccaacaactattccctcccgctgctgggacccggactgggcacatcacagccttgatgctcatccttatttaatctccacacacaccttgcgagggagggattttcattctgtcaataggacgctgagactcaacaagataaaatactctgcgcgggattaggtactccacggctgagaccttgcttctctcccacacccgggaggccaggctttggcagcaggagtaggcgcggcagtcctttagaacactcaagaactgggaccccatcggggccactgactctggatgagccttggaggagagaccacagagacatcttcatgggcaaacaggcgggagcgggcaccgtggtgctggggatgtccgagatgatggagcagaggcactgggcatagtggcagggatgttggtggtagcgggtggtggtccagaggtggattggtgatgggcatggctgtgtgttcgaggaagcttccaggaagacccctgatggtgaggggggagacctagttggcaatggaggcaggcatagagaagaggcagtggtgggaatgaccgtagctcactatggagctgatgtgggtcagtgtgtggtgggcggtggtggatggatcccggtcctggctcagcccttgtccagtcgctcaggctgggaatcagatgagccggggaggggagggtctcaccactcccgcctcttgtctccagctagcctcagggacacggggcctctcagcaaatgacggactcttccccctcagcagcaccctctctccttttcttgaccttggagtcaatggctattcctgatcgggctcaatcccttcaagtgtggaaagctggacaggttatcagcccctttgtagggatgaagttactatgtcttggatgtgggcagagatgttagaggagcaccctgggggctgtcccccaaggtcagggcccctgctgtgggcccagaggcagctgatgtgatggctgcgaaaggccacctctcccgagcttgcccccctgtccagggacaggacgcagaccagccagcagcacgtggcatggtgtttcggagacttgctgacccttccctggggtcaccggcccctggggaatcctctgatttcccccaccagatgtgaccccccccccgagtgccagccccatatggaggccagatgtggagctgggcccgcgtgagtcagtctgaggtcgtggaatgcgggtgaccaccaggttggccagggaaggccagtcggtccccatgacagctcgacagaaaagccccagagcccacaggaagcttgctctggtgagagcccggtgggggcagggtgctgtgatgctggggtctccaggcccaggaggctctggggggatgcggcccttcccagcacagcgacttgccatcccgcagagcgggagccctgaggggagagatgggccccagaagggccctccctgggatctgggcagctttctggccctcatctgctccttccctggagcttcctcttgtctctcccgatgctgttttcctctcctctgagcatcctgtttttaggaaggaggggtggggagagagggctctaaggggccacagaggcatctgatgaacagtatctcctgcccttttacagatggggacaccaaagctcagagtaggggtggggtggggatctgtccaaggtgcccggagtgtggggctggggacaccaggcgggaaaggctagtcttctcctggctcagccgtgccctgtgtctccgtgaccacagagatcttctcccgacgcagagcgcgggtgggcatttcgtgaggtgtacccgctggctctcccctgggatgagtgcctttggcactgaggacctcagcacccccgccattgttcctgggtttccttcctgaggcctgtctcaaagtcttcacaaacctatcagctcagttctgcctgtgctgggctcaggcctctgagataccatggggtacccggggggggaccccagcctcccaagtagtctacaggagctttggggggcatctttgcaagccctgacccctgagtcagttcatccggcagcgctcagctctgcccccaccctgctgtggcccccaggtctcagctccttccttcaggtctcctcagggaagcagattttgaagatggcttgacttttaggagctgacgagttccgagccaagtcccgtgtgtagagagtgcatggatgctaaccccacacgggacagggctccacaccagggtgccctgggagcgccctggaaatgccagcccggcttgcggtgaggggatgctcttggctgtcaggcaaaggggctcgctggaggtggcaccttggtggagaaatgggcggtctttgagaggttctcagccgggccactcccgctctgtggagtggtattaatatacatctgcaggcctggtgggcctctggctgaaacaccttccacaccaagccttctgggagccccggagggagctgaaggtggactggattgagcccatgccaagggaggctggctttctcactttccctcctccagaggctgggcccccattgctgctgagggcgctggcctcggggcggttggggggacgctcactgctccaccctcctactgggtggttctcgatggcatgtcccgcgggcccagccctcaccgatgcctttgttcagggagctggttggctgctccagccagcctcggagcactggggctgagccagaggtgggagggcctcgggggaggggagcactgtccacccttcaggatgactctgacagccatgtccctgcctctggtgggcccagccccttaaagggtcggggggacaagtgtggaattcggaggcaggagaaggaggcggctgcggcttcctccttgggcagcaggctctcccccaggctgctgtgctggaggcagcagcctgcatcccgagggcaccccagctggggcagagcagggcccagatccactccctacttaagcctcttgctaagaagggtgccagtccccgatctcttctcactgctgagcctcacggtgcagagctggacaggccaggcctgactgtgcccacctcccaggggacagggctggtctcctccccaagggtctggctctctaggacctccaggacctagcaggggaaactgaggcagcatccacactgctttcagttctgagagagagggtcatcctgttctgtctttggttgaggggaaaccttcagccagctctacgttgggtgtcctcatgttgtctaagtcctggggcagggccccggtggcaggcacatggcaggagatccctgaggactcctgagggcagcggtggcagttgccaggcctggccacagtgagcctccagccctctgccttgtttgatatagactgggcaggggccacggtgaccccccgtcccgggtgtggcggccccctctcccacactccccggcaaggagtcaggagagggcagatgagcatcactgagaccaagccttggctctggcggcccttcctcccttcgcagggcctgggaagcatgtgctcagagctgcatttcaggaaagcagctgcagctcgtgacacgctttccacagcgggagatttatggggctgtgcggctttcatggtttctgtggggttcctattctccccctcatttgtcctggccgctgtctccgaggcagatgggtgacaagcctcccctagctggaccggcccaacaggaaggtatggctgtgtaggggaggggagaggctgaccacctcagcctccttcggagggggaagctgctgggagccactgggggcccacctcgagcagcccataaatctgcgagacctccaggaggtaggaagcctccccgcggaggtgtcccacacacttaggccttgccagggaaaggagaagggccagcagcccccagagtctgtgctgcggccactcccccagggcccagcctgcaagttgtttattcggggctgggcctttcccgccctgtgtcggttcccaacaggcagatgaatgggcagcatctataacttctgcaccggccggacagctttcctacaacctggcccgggcggggagctttgatcccagcaggaggtccaccaaatctgcaaggaggggcatccgtcagttcccatctactcctgccaccaactttctggggtggtgacaatgcagggtcctcagaaggtctagagctcacaggctatggtggctcctgggcccggactggaactggggagggagggaggttttggatggactggggtctggacagaggacagggatgctccaagtccccctctggaggaatctaagcataggctgtgacctagagttccccattcttcaggttgcctttgacggcctggtaatgggtcaacattgggactctggggaagttgaggtaccccaggaaggaagaccagatgctcactctggtgcctttcactgcagccagggacgcgggaagcagcagctgaaaagacacccagggctggacaggccaggcctgactgtgcccacctcccaggggacagggctggtctcctccccagggtctggctctctgattctacttctgccctccttgcccaagggaagtgctcaaggcacccagcctgccctgggcctgcctcctagccccctgccccattggctgtaaccaactccacactgcggcaggctgcccttgttgactctggcccccatggacctggccctgagcccctttcttgcctcctcggagccacggccagccctccagagccccatgtgggcgtctcctgtggggcggaggaaggtgtgtgcccctgtaggcagggcggcaggtgtgggttagggcaagggaagccagtcctcttagctcgcactgtcctggtggctgagagagttcttggaatgaaagaccttcctgtgaaccccagaattgctgagagggagggctgctgctgccccaccccacctgcatgcagccttgttcaccgagctctgtggctggttgcaggaaaggagggtttactgcacagacgaggggtggcccatgggctgagggcaggagacaaagctcagccaggtgcctaggacctggacagcagaggccactcctggctgccctggaactgcactctcttcttgctttcccttgggcatcttttctaggcacccgcctcctccccatggtggagcaccagggctcagttaggcttccagtcagcccaacccattcagcctccagggttccagttcccacatccgaaccctggttttgtctgcactgacagcagagccctgccctgagcagagccccctgggaagagcgtacccgctcacttgcagcagtcagctctgggggcagcaaggctcgaggaagggaggatgaagttgagctgtggactctgggacgcagccgttgagcacttatgataaaaccagaagcagcagcaggcggaggccaggctcccctccccaggcagggttgaggggctctgctaacatctgcctcattgacttccttgtgtccacttcagagaatggccattctggcttaaggcagtgacctcttcctgtataccagcagtccctaatttgttgggttttttttgtctgttttttgttttttggtttttttttttttttttgagatggagtttcgctcctgttgcccaggctggagtgcagtggtgcgatctcggctcactgcaaactccgcctcccgggttcaagcgattctcctgcctcagcctccccagtagctgggattacaggtgtccaccaccatgcctggctaatttttttgtatttgtagtagagacagggtttcaccatgttggctaggatggtctcgaactcctgacctcaggtgatccacccacctcagcctcccaaagtgctgggattacaggtgtaagtcaccgtgcccagccagcagtccctaatttaagggctgtcagcacactgctcatctccctggtctgacctcaccgtctgcctttctgagagcaatctcatctcctttctgaatacatggtgggggatcctcagcagagcccccctgttccagcgttgttgaagacaacttttaggacatcaatgcagggacagtgggagttcaggcatgctaagggccgaggctaaattagcttggggtgagtttcatcgtgtgggtgtgtcttagtcagttctgggctgctgcaacaaaaccccttagattgggtgattgataaacaacagaaacttattgctcatagttctggaggctgcgaagtccaagatcaaggtgccaacagattcagagtctggtgagggcttgctctctgcttcagaaatgctgccttcttgctgtgtcctcacacagtggaaagggcatgggaactagctgcagcctcttcttctttcttcttttttttttttttggagacagagtctcgccctgtcccctgtcacccaggctggagtgcagtggcgtgatcttggctcactgcaacctctgcctcttgggctcaagcaattctgcctcagcctcccgagtagctgggactacaggcgtccactgccacgcccagctaattttttgtattttagtagagacaatctgcctgcctcggcctcccaaagtgctgggattacaggcgtgagccaccatgcccggtcagcctcttatataaggacactaatcccatccacagggtgagatcctcatgatttgatcatgtcccaaagaccctacttcttaatattctcacactggatatcaagttccaacataagaatttgggggggggggtactaacattaaaaccttgatagggtctaagaggcccgtcctcgaggccatggtcctaagatgggcagagctgcccatagaccactgtgccaagccccctggttgggtgacatcacaggtacatctgggttgggaggggcgccaggttccatgtagcccagagatccccatcattccttgcttcaagccagaggttggtcggaggtgacagcagcctggtggagtgccgtgtgggtgctgatgctcatgctcccagacctgcagggcaggtctgtttgaggtcactgttgcaatgcgcattttgaatattttcagctgtatgtgcacggcaggggcttggcccatgcactgcatatgtagctcatacttggtgagctgtgtaatgtgtagaggtgttgccaagggcagcggaaatgtggcctttttccagcataatcatgagtcctaccactacctgtccctgcccctgcggccaggacagctcccacccctggagttgctgagatctgctgggggtggaaggacaagggctggttgctttgtcctgactgaccactgtccattgctctatccctctggactcccggcagcaaggtgtccagaggaaggtacctttcagggctttgcccttggtgttaggcagttaagcaggtccccttcaggaccgtgtggcagtgcctggagaagcacagggggctgctttggatgccatgcctggtttccagggcattcactgatgggggaaagctcagagaccagagagggttgggcagggctcactggcccttctgctatgaccccagggagtgagaaggccccctgggaggcctctgcaggaagtctaaggctaggccttctccagccagctctttctctagcctcttctcagcaaacttgagactctgccagctctgcccttctgcctggccctgagcagaggcccaacatccccaaaatcttcaagatgaattgtattagcttctagggctgccagaacaaagtaccacagaccgagtggctgaaaccacagaaatgtatttctcacagctctggagtctggaagtccaagatcaaggtgtcggtagggttgctttcctccaagtcctctcctggcttgtagatggccaccttctcgtgtccttacagggtcttccctctgtgtgtctgtgtcctcatctcctcttacaaggacacaggtcatagggcccaccctaatgacctcatcttaattatacttaacatttttaaaaattttaatgggtagttaattatactttaaagaccctatctccaagtaaagtcaccctgtgaagtccagggggttaaggtgtaaggtttcaacagaggaatttgttgggacaccattcagcacacagcaccaacagatgctcggagcctgggatcaaagctgagctctcctggagccccagcccagggtgccttctgcagcatccttgttgggctgctccagcccatgctggctggggacaccacagctgtacaaggggtccgaggtgtccagcacggcagaaacagccatatcccgagctcattcgtattcagctcagtcctggggagaggaaagcggggctctcagggatgctgggggtggctcccccattgcttagctaaggggcactcagttgccacggtgacctctgtctgcacagtcaaatacactcggcccagccacttctctgggctggagggctccccccacccagagttcacactgagtgttgagtcccttggtgacaaaaacatggaaacggttgccatggcagccattctttggagccctcagactggagtgcaaagttcaggatgcccaggaacagctgaaatgaaaatacgggaaaatccgcttccctcaccctggaaggatgactcggttggcattcagtgctctcctgcactcggctgtccctgccctccccatcccctggtccatgtgtgggtgcaggggggtgccctcggagtgcaggagcagagtggcccccagagacgttgacagaagccagccagcataggagggcaggctcagctggggtggttccattgtctggagtggtaagtggggaagtgatgactgctggacgttccctggggaggtgtccttgtggctgctgaagccacagagcttgcctgtgtgttggtttcttcaagctgctgctcctgtctcaggagggctcaagtctactccatggcccagcctggggaataaaggtgtttcgcccagtgaaggctacagtgtgtgagggtgggatcagtgaggggaagacagtgcggggcaggggagtgagtggatggctgtttctcttgaacagaggtgagtacagcagaggcccctccaggtaccccctggtctgggggcaatgatcatgtgtccacccccagcaggtccccaagaaggccccatgaggctctggtgacctgagatgcaccaaccaaagggttctgcagtcacagttgtttgagaaaccaacacacgtatacaggattcttaggttaaaggctctgaaaagtcttgcagtaaggaacctcttgactttgtttaacctagtatttcacaaacttactagagcaaagtttctcatttatttagcgtctcttatttttgaaatctcccttactatcttgcagaaatgacatctggtaacatttgtcctctgagtcaatgacatcggcaccacttgtgagaaatgcatattctagggcctcacccagatctgttcaatctgaagctctggggcggggcccagcagtgtattttcacaagccggccaggggattctgatgcatgctccatttggggaagtccttctactagggaaaatactggcagagaatttggagtaagaggaatggtctggggaccttgggcggcatggaggaagggaggccacctggtagggatggcttaggcgtgggaagcggcagtccaaggttcccggggctctggaaaaggcactacggccaccccaaagggtgggttctcatcttctgtccctgagcattgaggacccattatggttttctgaggctggttggagggccaggctgtgtgtggagtgtcatgagggctggtgtaaagtgacttgggcctttggagaagcgcacccctgaggaacctccctctccccgccagcactgctctcacccgagcgcctgccctgggcagacagcttgcccagagtgctgggggcgtggtcagcacctgtaggcttcctggacaaagtgggccttgacaaggccaggagatggcttgtcccgacggcagtgctgggtggcaccctcacagcgtgggaggcaaggcttcttggccctgttgttagcaggtgggggtctacgatcagcttgccaccacccacgcgctcctgtatgggccactctgtgcagtcacttcctggggctgggtctcctttcccttctccccaggctcaggcagggcggacctagccacagcagctgggagcccacccgtctgcctgtgcttccttgcagccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgggggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcacttgtggtggtctctgaggccacctcagcaacggagctggcgacacgccaagcaacaaggcatcttgcggaaaattcagccagtgtcctgcccctcccttcggctcagcaccccgcagggcacaggctgtccacccggtggtctggcccttggggaatgcgtcagggtgaccagatccaccaggctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacactatgccgtctcgcagtcttgattggtggcctgggctgtgggaggtgggcgtgtggggaggcaggggaaggatggagttttcggggagtttgaggaatatggcttcaggccgaagaactcccctgcaagtcagagcctgggttttacccagagcctcagagacagagccctaactaactcccccgagaaggcaggagaagagcagttttgcttggaatgtcctagggccttgctggccgtgctgttttgagctaaaaggttctcgaatgggacagtctgtattgcaggctgcaggaaaccactccagggacccatccttgccattccctggagttccaagacagagtggggggaaaggggtcccctcccactttgccttacctgcaacccccgggtgggcggagagccacctttgaccctccccatttgattcagaacctgcaggtagtttctgacttttacataactggcttcttctatgaaagccaagtagagactcaagaaactacagcagggttagtgaaactcaagagatcttgcaaaatattttttttcaagcgattgctaaaggcttcgtgcggtgcagagactgggccggtgccagcaccacgcagccaccaagagctgagctcacttggtttctgagaggctatatttaaacctccaaatggttgtgatttctttattaaataaacaattcagtcattaggaacatattgtgttgccacgcaaagtggggccgatcatcactaggaagctataatttctgcacccagctgttttgaaggcagccctccgccatgggccccgtctagcccctcagcaacgcaggctcaacaggcccttccttcgaaggtatggaaagccccttccctgctgtgtggagagctgactggagatgccattagcttctgctcaggaagaaatagggccagccctgctgccttgggggtctggctctgcggatgggagctaggctctcaagagcctggggtcaaagccagggcaggtacatacgtgagtggtctccgggtgtcccaatcagtctcaggtgtaagtctctgctgaaatgacaacgcctgacagtgggtgggcagggatgacatccaggtctcagttggccagacaggctaaggagaaagcaagcctattccggggtctcaggtgctccccagggccagcggggccgctggtagcatttaagacccgctgagagactgggctaagaggcctgtgatgcacttgaggcagcttcattctcagctttggtcattttaggtcaagggtccagttcttaaggactttcatgatgtggctttttttctgtccatttaaaaacaaaaaaagtgcgtgtctgagagggccgcgtttccttgggacgccaccacagtcgggccctgtgagggtggctgcagccccaggcccacggccagaaggaagcacactgttgctcagagacacattagaacatgtactgtcaacggcccctctgcctcccaggaccttatgctgtagttggggagagagggcatctgccaaactcaatgcaggaaataagctgcgttgctgctaaggactggcccaaggtagtgggaaaagcccattttagagacgggaatgcagagtcacaaggaagctgggtgatcaccatcagggacccagaagccagtgctatccagtaagaaatgcctgatggtgggtgggcagggacgtcagagccctgtgggtgtcagagcttcatggggcctgcccggccacctgacctgccaccagggaggctcagtcattcataaggctctcccctgcccattcccctctgcctctcagagatagtgatggcagagacaagtggcatgggaggcccacttgtagcagacacacccttttcagattttgttgaacagacatctctttctccactcttcttaaaactaaataaagacatataagaaataggccaagaaaaatggggaatgaaaagaacaacggagccagtaagagatagaggatatggacggattacacacctgccttatcagactggagcctcagcgggacggcaagtcatttctggaaagagatcaatgtcttttgttattgacatgtagttgggaggaagtctgtgaaattgtaggaagcaatcggaggaaagatggatcttggccccctttttaaaataaggggcaaaaacgcacttaatttcaacagggctgagttagaaaatccaactaagagatgatccttaactagtctctgcttaagataccagtgtcactgtgaacctcaagaagcagggcatacgattctaaggaggctaaggcactctttcctgacctggaggaacaatgcggctgtttggccagccagcagttctctctgactagtcaggagggagcctcgcaggtttttgttttgttttgtttttttgaaacggagtctcccactgtcgcccaggctggagtatagtggcacgatcttggctcagtgcaacctctgcctcccgggttcaagcgattctcctgcctcagcctcccgagtagctgggattacaggcgcctgccaccatgcccagctaattttttatatttttagtagacacgggttttcaccatgttggccaggctggtctcgaactgctggcagtttttggagaggggccgtcggcaacctgcatcagccacgtagaaggagagtttcagggatctagctcatggaaaaagcccaatcccagccaggccgaaggctgcaggcagcagagaaagaattttccctatcaaagtcacaaatgactggtggaggccgtgtctaggctggggccctgcgggttttgaaaggagctgatcgtcttggggctaatgatagctaaggtttagttacagttactaataaaaatgaagtttaaatggaacaaaagtaccagctgtacccaggtatctggatttctttatatggtatccagagttaaaatgcttataattaataatcggttaggttaaacagtacttacactgttattttaatcacggtttattttcattgaaaaagcacccgacatggtggctactaaggccctgccttacctctcttctttatgcttggggtgagggctttaggcttgcccagccaactccaaagcactcactgtgggtcacccaggactgtggtcctggcagctctgaggggggacagccaagcctttcaaaccatgctggaaaatgccacctttacattagccacgctctctagggtggctcttgaggcagcaaatccccaaaagggacacatcccagccacttgggtaatgcttgccacttctggcctggttggggtgggggtctcatatgtcacccaccccttgaggaaggcaaaggggagccggggttttcctacccggcccgtccccaccctgtgtggcctgcgctgccccaagcctagacggcaggtccctgcattctaacctcctgggtagctttttatccaccctgccctgcctgtgggtccacagaaatgaagtaacttgtccagggtcacacagctagcagtgctggggtcgggcctagagcccattcagccaaaagaacagaagccgctgtgtgcagacatcggctcagtgttttgcttgaaaaggcctttcagtctgactgagccaggactccgtggctctggttcaaagacgccccacgagttgccggggctccgtgctgagcaagtcgagaggaggtgagaaagtcaaacagactgtcaatgccgcctcccccgagccccaaagtggggggctccctccaaggagacactgtttgtagagatttggggtttcgcacaagactggaagatgaggctctgcagattcttgatcgtccgttggatgatccgttagcaaccaccccaccccgacgaggaggcgcatcccagggcgccttaccagaaagcccttggtcccctgtccagcgtggctcctctccttcaggaacacacgcacctacaacaagcccgcttcctttccttctccttcctgtgacaatccaggtcctcggcagtatggctcatcctcactgctgcccctgctcctcatcctctcagccctttgcacctcctgtctcgacgcagcccgtttcattcttctaactctgcttcaagggcctcgacatcccaaggctagcctgggtctgcatgtgttggcagcttctctggaagcagggatcaggctccatagagacaggagagcccttgtcctgggccctggttcacgctcacatcctcacaacagtctgtcctattgcactaggtggaagcatgggacaggatccccaagatgtggacttggaggcatctggcccactgggcctagacttgggttggggaataaacttctttttttctttgagacggagttttgctcttgttgcccaggctggagcgcaatggtgcgacctcggctcgccgcaacctccgcctcctgggttcaagcgattctcctgcctcagcctcctgagtagctaagattacaggcatgcgccaccatgcccagctaattttgtatttttagtagagacggggtttctccacattggtcaggctggtcttgaatgcctgacctcaggtgatctgcccacctcagccagaaggaactttctttcagcggagccaagcagggcgctctgtgcttgtgtgtgccaactcactctgtcctcgcagcaaccctgtgaataggaaggacacctcatctccacgccctagacaagggagcagaggcagaggaaggtaacttgcccacggtctctgagctggtaagtggtgtggctgtcattagggccgttcactgcatatttcaggctcttggccttccagacacttcctggtcccctcgtggtgaagcaggccaggtgatgagctctggccagtgagctgtgagcagaggcaatgggtgtgcttctgggctgcacgtgtcactgctggcgtgagagcttccagagctcccttgtcctttgccagagagaccatggtggctttcccatctgcctgggtcagagctgggcaggtgtctgggctcctagaccccaggtcttcccgggacccctggagccctcagtccctaggaaatgacattacaccaggctacacgtggctctctctctggtgtctctgtccacagggggtttcaggtcatgccctcttgagcaaatccaccagaaactcacctgctgtgaatcccctaccttcttctcagtgaaatcttgtgctttggaaatcacccatcatcaaccctaattctttcccctttcgtcctggagggcagagcaaggccagctggcctagcctgctttccacacgtataagagagagcacatggtgcttggccccctgacccctgctaacacgaactcagccatccatgggcctggcgtcctccgcaggcctgccccatccgtctgccctttctgagacacacacacgtacacatgcgctgcgcacactcaacacacagggctctgtcggagccaggtgaggcgccacggtaatctcatccctctgaaccctccacagtgctttccagcccgaccacctcctgccccacctgccttattccacagacttgattctggctgcttataaagatgtgtcagccctgaaagatgagagttgattgtcaccaaggagatgaaaaagaatgcgcttccagggctaatagcagttcccacaggaatatttttgtgaagtggaggctggcacccctaggaggagtgctgagcctggcggggtgactcgggtggggcagagcagcacggtggtggttacacactcagacacaggcctgtgtggctcctccgcacagccctcacctcactccttccccgctacctggacacacgtggccttgaatatacacccatttcctacacagacatgtggcttccacaagcaggccagacgtcaaggtttcaaactgcctattaatccagtgtccccaggatgcccagagtactgcggggtggccagaacccactggccaccatgaggtaggggaccccgagggacctc

SEQ ID NO: 99 - DNA, 1993 bp, Homo sapiens
agccttcgggggcgagcgcgcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggc

SEQ ID NO: 100 - protein, 269 aa, Homo sapiens
ACSSARRGPSPWPSTSPWTTGRCPSSSTPRSAARCTTGRTARPSPSRTSRRPCAPTRTPTCARSRAASSPSARWTGGPRRTTSTWCCRTGSRPQTSAWPSAACTRSATRTRTTRSWRATRTSTRCPTCRWAAGASATAWAACATATTAWCATAGTWARSATADSTTTGPGSAPQPAKPTSAWPVTATCMPGAAASTWSSTSFRGARAEVSASTVATTPPAATAITARRATTATWDSPTGRPAKPVIATLWVLLAKPATKPPASVPARTA

SEQ ID NO: 101 - DNA, 111331 bp, Mus musculus
  misc_feature (1)...(111331): n = A,T,C or G
tagacacctacctaggtaccatatagacacccatctagaaacccacctagacacccatctagacactcatctagatacccatctagacacccacttagacatccatctagacactcatctagacacacatgtagacacccatgttgacattcatctagacatccatctagatacccacctagacacccatctaggcacccatctaaacacccacctaggcatccatctagacacatatctagcaccatctcaaacattcaatctgacaaaatccaaacgcatctccctttgaaaaccagttttccctggggctccccactactctctaaaagagccccatctctaggcgtccagtctcacaaccatcatgccacttctgtccccttcctccacccctaagccatcactgtgctccattgtctttgtcctcttgccctagctggactcatatatcctcagccaccaaatccaacctgactccccccagtcaatctgcttcaccccacagcagggatagaaactgggcttcctaccataaggtacctctgacctcctgttagcaatgtgctaagaatgagctaagggcacgcgtgggttctgctgggtaatgcactagaaccacaaaccccttcctcctgcaggtagaaaggggacgtttggaaagggagaacaagccaagatcatgaactctgcccctgcccttatctctgaggaccactgctgtggtgtctacaccctcgcacacatagttctgttattgatcacctctctttctcgtctctcaatacctctcaagcttagggcttcacgaagccctactcccatctccagcagctaaaggctctgccttatcccccaagggctgggcatgggtatctccctcagggaagaacccctgagaccctacaactcccacttctcagtaaccccagggtctgacactcagctgtgagatggtagggacagttctcctcaacatggataagctgttgccagaagtaccacccttcactgagcacctactacgtgcacctacctacctactatctacactcacgctagaccagctgagccaccccactccagcctccttccaaccctcagcatctttaagtcaccaatgagactttccttcccaggaggacagatcctatcatctttctttgttgggaatccttcattcctgatatccaccaagtaagatgtgttgaggaggagcctaaatccacactgcgcagtcaagtgcaatgatttgatttttcagtactaggaatcaaacccaaaacccacaaatcctaagtaagggagccatacctgatctgtgttccctagctgctgctttttattcaagatagagtcttgctaggttacacaggctagccttgaagtctctaccttcttgcttcggcctcccaggtatcaatgacaacaggtttgcagcacctggcctagctctggtggtgatttttttttttctgagagggtctcctatagctccagctgatcttgaactcaataaaaagctgaggatcgccttaagctcctgatcttcctgcctctgctttgtgtaccctgggatgataatgtaccaccgtgtcccattgttatattgaaggtctcagtgtgtaaccctggctagcctggaacatataatgtagaccaggctgactttgaactcacagagatccacctgcctctgcctcccaggtgctagaattaactccgagccaccatgcccaccatcatacccctgcctaccactgctgcctctcccaggtaccaagttgggaattgaacccagagcttcctgcgtactaggcaaacactgaacccagtgagctatgtccccagctccaagtaacaattcttagtccgtatttgttcctgagaaaacagagagactgagcagaatacagtcacctgtctagatcagccccagaacacctgggacggagcaagcctaaggcccaggcttccctaagccccaggcctatcctcttcccctataccaaaggtcctcagccaccatggcttctgtaggctgctgcctggacctgaccacatgctccaggggggagtcccagtgtcacactaacagcccctccttatttaatctccacctccccatagctgtccccattgccttcctccgggctgtctgtttatcaggccagcagcaccggctcagactctaacagtctgtctcctcggcgtggcccattaatctgggccatggtacctgcgcgcaggcatgtaataaacaacttagagcacacgtttatggattcagctatatcagcagctttcaatccgatcgcactttatggcacctacatgagactttatattgttgcaattactctgctttataccgccttcttgcccgttcattttcctttatttttacattttatccctattcttcctcagctgtttctaacgaggcctagagctcagccaggaaacctgcctggggccagccagagcggctcacagtggctgcgagggtacttggcccacagaggatcatcacccccacactgtcacctacacctgtgcaagctgtcacagtgggctctctctaaggagccctggaaggaagccaactagagagatttgtagtcacactagaaaaaagttctctctgggtgtattttaagagcccggaagaggtgcagagtggatgatgagactagaggcggtgctgggccgatgctggtccagcaagaggagccaggcacctctgaaagagcctagagtactcagaaaggccatgaaactaccctgtccacagcaagggtgttgcttctttgccttttatttcataagcccgtacgcaaaagccctctttcgtttcatcctgtatccctggaggtgggcaataatgatgactgcaccatggttcttcagtcacgggagggcgtgtgcacacacctaccaaccaccatgtggctgttccctgcttgagacatggtggccgccaggacgaaacatcagctcagaggcttgtaacaaagccgtatgtccagccttaaactgcatttattgacgccgtcacgggttctgagttggagacttaaggtcagagagtcgcaaggcagggctggcaagggtatggctcctgactgggacacaattacctgctcannnnnnnnnnnnnnnnnnnnnnnnnnnnnnnnnnnnnnnnnnnnnnnnnnnnnnnnnnnnnnnnnnnnnnnnnnnactgctcttcggaaggtccggagttcaaatcccagcaaccacatggtggctcacaaccatccgtaaagatatctgactccctcttctggagtgtctgaagacagctacagtgtacttacatataataaataaataaatctttaaaaaaaaaaaaagaactttaaaaaaaaagaaagaaaggtaatacaagagagaaagatgatagagagataaagaacaaagagccaagagatacagagagaggggaaggggacaggaagtgaacaagagaaagaggctgaaggtgctagtcccatggtgggggccataccccacaggcctagccaagtctcctcagcttctacactctcacctccaatgccatcatatcaacgttacggccccagaatatgagccaccaggagacacaatccaggccagagccagcaccttctgggcctccatggcaacacctgggctggcccctttcggtcagcgtaacagcatgccaccacagggaggcctgtcgtaagaatggactctttcataggtctggagataaaatctggtatcaaggggtcttgaggtcctcattccccctcgggaggctctagaaggtctccacagcctcttccattcctcaaagctgacatcctctgcactcccttctcggctctagtctccacctctgtctttgctcagcttctcccctgtgggtcttgtactggagtccctggcccctatgcagaaggatgccgttcccattggatagagcgcctgcccccactgcagtgcgatctcagctgagccagttatgtctacaaagaccctatttctaaataaagccacatccacggctgccgggcggaccagagccaggggaggggactcctgggagaattccctccctgaagagatgtcaaagtctcccccctcattataaggccaaagtacaattccaccaaagttccctcccaccccatccccagatgtgttaggtgcttctcattgctccaggccaacactttgggcagatgggttcagagggagaatctaaacggcaggcagctggagcagagagccgaaagatcatcacatcttttaaactcaaacatgaagcagaacaaactgaaaggcgagggaggccacaccccctaaaagttccatgaccttcccccaagcagcactgcccactgagatccaagcgttcaaacctatgggggacatttctcactcaaaccccgacaccgggaaaccaatgagtgtgctagacctattcatagagcatgggagggttctgaacgggagcttggggaccccgaagcagccatattggaaagccttcgcccaacatggatgggggttttcctatacctcgtagcctctttcggttaattttcccaagcctgtagatgctacccaccgccaaagaccctgaccctgaggcctcctgaaatttgcttaattgcaaaagatggcaaggaggaccagccaggatctcagtccagtgactctccctgccccttccctgaacctcagatgtccacggacttgattccaaccgtgtcgtacacccagcaggtgcagctgaactggggaacatggcagctgtttcggttggaggaccatgttttcccaacagtgactattcattgtagagagagtgtgtggtctggcgtgggggcaaggatgaagtagatcatcgaggtaaacttaggcgagagaaagggttttgaaggtaatggaacgggatggcagtgagtggaggggcgtggctggcttgcgtgtgggagaggcgtggttggcttgcgtgtgggaggagtcaggaggaggcctttgagagccaaggaccccctagaggtcccctgacacttcaactcctgagcagaggaagaaaaaaacatcccagatctgtccacggagcagctgtgggaacttcccatacagctacctactctgtgccttaaggaataaggtctccttgtgccacataggcaggcagagatgggatttctggctccgccctcctaacacgtcacctcttctcagatgttgggggacccgctgaccccattgcaccaaccatcatcatcccacccaagaataccagtgtcgtggctgggacctcggaggtgaccatggagtgtgtggccaacgccaggtaggtggcgcgtctctgactgatcccttaccagagctgtagccgggagcactgtcctctttgagcaaagtctagctgcctggtccgaggaggatttgtgaagagctggggaggagggatgggtggacactgcaaatccagggcaccaagctccaagcaagctcaacggagtttcttgttcatgtatgtgcgagaggtcttgtatgtgcgagaggaaagtgccagccgtggtgggccaatggacagcagatttagcccaggctatggggccagagggggactctctctgtttctaacacaaagtcatccagagaggggaagatgttccctcagagaagaccccttctgtatgtgaggtgcatggaagggagttgtgtatggaagatggggaatggagttagtacaacatggactttgtagctgcaattgcatcccttcagtccctcacagagcagactgttagatcgtccctaaaccccctcctaagagagctgtgtggtgagagcttcttccccaacatgacctaagtgtcaagagcttacagcacacagagggcgggcagtgtgccccagtcacccaaatggccagtagcagtgatgactgaagccagctcccccaaaggcccagatccctgccccacaatgcacctcagtctactcatctataaagtgggtatgacctggcacacaccataccataagacattcagggagagtactgaccccagcctgccctgcctgggtaatctacagagaaaaagtcaagtaaagtgccatgatggaattagactgtggtcccaaggtcctctgaggatttcagggcagcctagcccccgtagcactgtctgtgagagcatgcttcacagagctcagtcttgtcacaaaggcgggaaacttggccaggatgtgtgttcaaagcctgagaaatcctgcagccaagaccctgcctgggtttcccacacttgcatacccatggagaacctttttctagaaaattctgagtgcccccactctacttagggaggtccgtccttagaaaccactaggtgctggggaggaatgtgagagcaaaccagaactctactcccatgatgctcagcaaataacttaggccagcccccaggctctcccaagggctatgtgtgcagttaccattgtgtccccgccccgttggggacattcttcatgacagacattcataaccacccagagccactacacttgcccccattctacagatagagagctagccacaccaacgccaactccatccctgtttctgcccacacttgcgcttccccatggcccttccagacgcccttgactgaaagcgactgcctccctcgcctcgtaggcctctcatcaagctgcacattgtgtggaagaaggacggggctccactctccagtggcatcagcgactacaaccgcaggctcaccatcgccaaccccacggtcagcgacgccggctactacgagtgcgaagccatgctgcgcagcagcagcgtggcccctgtcacccggggcgcctacctctcggtgctgggtgagtcccagcaagttctggggttcctccgctatgagagagggagggcacagcagtgtgggctacatatgaaagccgtaagcctctaatcctgtctcctgctccttcccctgcagagccacctcagtttgtcagagagcctgagagacatatcacggccgagatggaaaaggtggtggacatcccctgtcgagccaaaggtaacacagaggcatgcatgcgagtgggaccttcgacccctctcatccctgctgggggttctccaagccccgcctccctctccagaccacatcactaagcaatgacaggctggctaggagctggcacccaggaaacaaacagccaaattaccgtaatctcagactgcaaatcaacccacgtaactccagagttacaaatgagcccaaattaccgtaatttcaggacaggtgacagacccaaattgcccataatttgagagttgtagacaatgtcgaatcaccgttttgccagcatccgcagacctggtgtgtctcacctgaacgggtgccatacactcagcccatctgaaaggggaggggtacctggcttggtcctcaccccctgctagtcctacttagcccgctgtcacagtttctggtccttactgcctccatcctgacagagctgagcctgaaaggatagagggttaaaaagggctatttcatggagtgtagagactcaagcatcctagcatctagtgaggcaggaggattgctatgagttccaggctgtccggagaataggaaatcctgagcaaaagatctgatgtggccccagtagtgtaggaagtcttgtgaagccacagctcttctgagacccttacgcagaggcctgtgggagcagaggggccgcaggtagacactgctgtcacataatctcagcagggtctctcattcttggctgcccaaggggagtgagccaggctgactttacagagggaccacatagcccagtccctcctgttttccacctgacatatttgcaaagagaggaagaagccaataaacaaagatgccttatttcatctcattcgagatgccatgagcagtgagatctgccattattttatgtgccactaagaaagaaacaaggctgccaattaaatcgtgacatgctgtcgatggtgagccacaccccggccccccattgcattgcaatgaatagcaaagaattgctgtcatccaatggtggtggctggatgcagggtggaagggagctggggggagggtgcagagctgtgtagagcacccctggggaagttaagtctgagcgaaggcagagaggcagagggtgagcaggagcatgggaagaactgagggacacctatggggagagagaaccaggccaagagatggagaactccatcttcctttgtgtgcagacctaagatgggacatagggggatctcctgaggaacagaggcctctctgcgtgcttctctacctgggctccattgccagggactgagtatggctcttgaaggttagcacagtacacagaagaactaaaaaactaaagacacacacctgccattcctgctcaggaggctgaggaaagagagttgacgtgagttcaagaccagcctgggctacagagcagggtcttgtcttgaatatataatagtaataaggaaggaggagcgagaggaggaagaagagcaggaagaagaaagcagaagaagcaggcattgaggaagccagggatggagagtttgctcagttgatagtatttggatagcatccccagcactgtattaactaggcacggcagcacatgctttgtaatacagtatttgggagatactggattaaaaaaaaaaaccaaagtcaaagctatcgtcagctacatagagagttcaaggccagcctgggatatgagtccctgtctcaaaaataacaataaggtctggagatatggctcagtagttaagagcaattattgctcttgcagaggacccaggtttgacttccaccacccacatacatgaatcacaagcacccacaatcccagttgtcctcttctgaactctgtggacaccagtcacacacgtgatcccatacatctgtgtaagaagagtacgcacacacatacaagaaatgcactttaaaataataatcataatagaggctggagaaagtgctcagaggtcaggagttcacactcctctgccaaggacctgagttcggttccaagcactcacatcaggaaagcctggagctccagctctggatgggatggatgcctctggctgcctcaggcgcacacacacacacacacacacacacacacacacacacacacacacacaacacaatgagcacacacaaattaaaatgaaatattttttcttttttcttttcgtttgttgtttgtttatttgagacaaggtttccctgtgtagccctggctatcctgggttttttgagacagggtttccctgtgtagccctggctgtcctgaagtgctctctctctctgtaaaccaggctggccttgaactcagagctcctcctgcctctgtctgaagtaactcagcagtaatagggacagatgagatgactctttgggtaaaggtgcttgccaaaaaccctgacggtctgagttcaatccctggaacctacacaaaggtggaaggagagaaatgactccacagcgctgtcctctggcctccacacacacgcccactctcataataataaacaaagatgtgatcaataatagtaataatgaaccttccctctaaaaacttcccggctggccttgaactctcgatataactgaggatagtcttatagccttgacttttttttttttaaatccagtatctcccaaatactgtattacaaagcgtgtgttcagccatgcctagtttatgcaggaaactgagtctaggagatttccactttctgaaaaatctctactctatcctaaattttttgagacttttaaaagagcatactctataaaaacaatgcctatgagagcatcctagaaaacaaggcagcctaggacctcctgcagactctggcctgggatggggcaaaatggctgaccatggccctggccttccgcagggattccgcctccctccatcacctggtacaaggacgctgcgttggtggaggtggggaagctaacccgcttcaagcagcgcagcgatggcggcctgcagatcagcggcctgctgcctgacgacaccggcatgctccagtgctttgcccacaacgcagctggcgaggcccagacctccacctacctggccgtcaccagtaagtgtcctccccatgagtcacagcatccctccacactcactgctggtagggtggactgacctgcactggggtggggctnnnnnnnnnnnnnnnnnnnnnnnnnnnnnnnnnnnnnnnnnnnnngctcctcacaccccctcagcacagcattttgtccaccctgctcactcatgatctttttcatgagtcctggagccattgatgcccatggagaaaagccagttccaattgatgtgtctgctgacctcgggtcagaggagtcacccagggttccggagacccagcacaaaggcagctatcagctgctcgttcttgcacaaactggtgcatgttcaatggagctcaggttccactgagtttgtcactgagggtgtgagcttccctctgcatcctcagtttccccttagtggatgtctgaggttccagagggcagacctctcttgacgggtacctggggacctcttatgagcctccctgcagaaggccctgtaataccagggccagatggtggagtggagggaaatctgtcttttttgtgggctctaagatcttagcccctaagccgggcatggtggcgcatgcctttaatcctagcacttgggaggcagaggcaggcagatttctgagtttgaggccagcctggtctacagaatgagttccaggacggccagggctatacagagaaaccctgtcttgaaaaaaaaccaaaacaaaaaaacttagcccctagctgggggtcttcctagatatcgctaatagatcccactgcctccccctacaggcattgcccctaatatcaccagaggcccccttgacagcacggtgattgacggcatgtcggtggtactagcatgtgagacctcaggggcaccacggcctgctatcacttggcaaaaaggtaggcgggatggtccttcagagggcgtagtcacgtgagagtctaggaaagccttccactctaggttcaggagtgagcaggattgagctccccacgtgcagctgtaaaggctagacactgtgccgccgcccatctttcacaatccacattgctctgctctctctgtctctgtctctgtctctgtgtctcccaggccagacccaagaccccctatgtcccactgtaagaggtctatctgtcccaacctggtagaatctttatccatctgcctgtctgtctaccgatctacctgtgtatatctctctctgtgtcacgcctcccctgcactgccccgccacaccctatatccatccatcacctcctcagcttccctgaaggtgactctctccagaagcatcctgtcctgtgctgaggtacccctcatcaccttgtcagcttgtgtcctgcctcctctccccagcccaagtgcatctgcccccaggccatggctagctggctgcaagcagccacagcagacagattgtggcctcatcgggtgaaggacagacatggcggtgggtggaggcatggcagaaaggatgatagaaagggtactgctgccctgtgagcctgtgagccccagcctgtcaccaagtcccagctcagcctgtcacttaacacttaactcatttaacatgtccagagatgggtgggcggctgagaccttccaatgctggagcatttagggccagcatcaaggtttcatctgataacccataaaaccctatgtcacctcaggggagcgcatcttggccagtggctctgtccagctgcctcgattcacactgctggaatctggcagcctgctcattagcccaacccacatctcggacgccggcacctacacttgtttggccaccaactctcggggagtagacgaggcgtcagcagacctggtggtgtggggtgagtgaccatccgtaggggtgggtcgccagcatctgtactcccatactgtgttgctgacacaaccaaggctcttcctgtcacagggatgatgacaaattaactcagaagccaggaaccaggaggaggtggccctgccagcaaggccactggatggagaggtcatgccatgctcagctgagtccagagaactataaaaaagctgtcttgtgtattttagggcagaatcaacacagggccagagagtaaatatttttggctctgcgggctagacagtgtccatcagggtccctctcctacccttgtgctgctgagaaagcagccaagacattagtggcatggtggtgaggcccattgaggtgagcttgtctgttcagtatgccacccaccattatcagcctggagagaagccagcagatctctcaagccttttccacttgaggtgtgcaccccagacatgcaggtttatggacatacctctccaggctgagccctagggcctcgagtgagtagttgcctgtcaccaggaagctggcctggtggctctggtcactctcagtttgcaattttcattctttctatggcaccgagtccacaccgtgtttgtggcttcagagaatcacagtgtccctgggacagtttgtcctttccactctcctgggacttttttgtgacataaacctgtcaacatatgaggtcatcgctcaacatctcccagcatccagatgtgcagctccagcgtgtccctcccccgccaactatggtgtcagcccaacctccctgttcactaaacatatccctgtcttacagcccggacacgcatcactaagccaccccaggaccagagtgtcatcaagggcacccaggcctccatggtgtgtggagtgacccacgatcccagagtgactgtcaggtactccatgcaaagtgggaagggacgcttataagacaggatggcagcatcggggagttgatgccgtctgtaaggcctcacctggggggctatgtccagagctggatacagggcgagatggagaagaggcttggtgcctaaggaccatgctgtgtgaaccgtgttgatgcagagtcctgaggcaggagatggtagacagagaaatagagcaaggaggaggactcaggggtggggggatgactcagagctaagaacacctatgtgttaaccacgaggacccgagttcaaatccccgtattccaaagcagggcacagctgcataaatacctctaaccctagctgtgtggagaggcagagacaggagggatggagcttgccccagacttctgaggttcaatgagagacactgtctacgagtacggaaagaaattacagacaggacgcctggcatcctcctctggcctcacacgcttagcacgcagatatgcacttcaccatacacatattgtgcacatatactagacaggaagaaaaggggcagcaagagaggagggagacgaagagggaagggaaaagggtgtttaggataaagaggtagaagacccctgccgcgtgctccccactttttaaaccccctaactaacctcgtgtgaatgaattagtttaagctcctattgtaaggtcttcaggtcttattttaatattcatagtggagctgtctgggcaagaagacacagaggtgatcacggggctaagacaggacaggggatgaccccgtcagagggcatgtaaaggaaaagcttaaacagaagttacctcctgcccctgtgggaaagccaggaccaagagctcagtgtgggtctaaagcaagtgtctcgcctgggcgtctgtggaccaaagctccacagacccaacctcaaacaaggacgcccagggtactcccaaaccataagaagatctgggagccgcaagacggaggggtgtgttgtgtccctttgtgctctccggagagctccagaggctgggagtcagcataactgctccttcagaagattccagcatgttgctgtctagctaatgagtagtaacactgtcccacaattgccacagaggccaagaggccacgaggggcgggcactcctgcctccagcagacatggcctccctaagcctcacagtggtgtcctggggcgccacctggtggtcactagacagaggacagtctgccaatcagtataatagagttctgaggaaccaggattgcaggactccaggcctgcccaggctgagaaacgcttcatgaagtgttcaacattgacctttggggcgttgtaacatgccagcagggacaaacatgagccctgaaatcacacagaggtagtcagaatgttggcagactgacttcaggatcctggctttatcagatttttctctaaaagaaaaaaaaaaaaattaatagagcaattgtgaaagtgccctcagagagaagccatcccctgagtcacagtctcgatgacatactagtgtcctttctctagttctcaactatgttctgctagttgaaaaactcccaaatagccactatgttatgtcagcagctgtttccattgcttgtgtgtatgcgtgcatttgtgtgcctgcatgtacatatgtatacatgtatgtgcatatgtgcatgcatgtgtgtatgtgcatatgtgtgtacaggtgtgtgcatgtnnnnnnnnnnnnnnnnnnnnagcaattgtgaaagtgccctcagaagagaagcccatcccctgagtcacagtctcgatgacatactagtgtcctttctctagttctcaactatgttctgctagttgaaaaactcccaaatagccactatgttatgtcagcagctgtttccattgcttgtgtgtatgcgtgcatttgtgtgcctgcatgtacatatgtatacatgtatgtgcatatgtgcatgcatgtgtgtatgtgcatatgtgtgtacaggtgtgtgcatgtgtgtgtacatgtgtgtgtgtgcgtgtgtgtgtgtgtgtgtgtgtgtgcgcgcgtgcacgcacgcgcacaggcaagaggcagacatcaagtatctcttctctatcaatcaccaagagtctctcactgaacctggagctcacagatttgcccaaggccagccctttgtctctgctcccagcctgcactccttgggcagtggcagcccctgctgccatctgcagcctcgagattacataggggtaggggacacaatgctcagtatttttaaagccgcccagtggttctgatattctcccagaaacaggatattctaactacaaagtacaacggggtcccctgagcagactagaaagggagaagccaacggctcacatttaagtattggacgctcaaatcccaagcaatgtgctgtcaagacaaagccaggccccaggggtgaggcccagacagctgcaggctgcccgccattctcaaagaatctatttggtatctggatccaaatctagacaggacacgaacaatccactttgagacattattaatattaataaatactttttatacttttaccatgtaatgaatttattacattgcaagaggaaaattcagatcaagaaaaaaaagactagcagaaaaacccatgtacagttaaccattccccttaatttgacaccatcagtaatgatatttgagttccattaaagaagccagacacactctagtctctaatccttttcccttgcggacctactgtgccccctgtgccatgtcaataaatatgtttgcatcaactcaattactggattgcttagagtccactgtctgagggaaacagtttaccagttcacagtgactgcattcttttcattattatttctaaatttttgctaatatgagaaatctcattacaagtatcctggtaatcaaattctgtacacatctctgatttgctaaagattggctgatgttatctggagccaaaagggttcctgaaaataatgccaagaatgtgatatgggtagaggggtgtgtgtgtatgtgtgtgcgtgctctcacgcgcgcacgcctggcttttttagataggctcttattatgtagcccaaggtgggttgaaacttgtagccactctcctgccccagcttcccaagtgataacattacagacatgagccaccaagtctggctacgtatatatttttgtttacttttgaaagaaaccactcaagccaggaatgatagcacacacctttaatcccagcactcaggaggcagacgcaaacagatctctgtgagtctggagccagcctgaactacatagcaagttccaggccatccagagctacatactgagaccctgtcaagaaaaggggggtggggagggaagcaaacacccaagtgtctttcagaggcatggtacacatcttggaagaggggatattgccctggcaggcactgagtgatgttggacattctattagttgtggtatagttcttgttgctgttctgaagtagtttgtttgtttgtgtgtgtgtgtgtgtgtgtgtgtgtgtgtgtgtgtgtgtgtgtgtgtgtgtgtttgtttgtttgtttttaattatgtgcatctgaggctagggcaagggttatgcgcctgtaagtgcagtacccatggagtccaccagagggcgtcagatcctttgaagccagagttgcaggcaattgtgagcttcctgtcttgcttggtgctagatcccgagctccagccttctgcaatagcagaatatgctctagaatagagtccttccatcctatccgctgcgctaatctgcatttctctgtggcctaggaggcaaacatctcatttctgtttccctctgcatgtgcctacattggggaggtatccgacaaggacttcagcccggtttttaatcaggctgtttgttttcttagggttgagttttaagaagtctctgtatattttggataacagcgccttatcagatatttgtcatgcaaacatcttcttccggcccgtggcttctctttttattctcttggaagtatctgtggaagagtagaaaattttaattttgacaaagtctgtcttatccacgcctctccaacagggatcaggccttcagtgtggtatctggagtcagcactgaaggccaggccttctagatttcccactacctcctggcagctgggggattctgcactgtgcctttaggtttgtaaccaactttgaaataaagatttgtaactacaactatgcctggagcaatgatgtccagtggcttcagaatcattgttgagaggaccatctcttggtttttatgctcatggtggtggtggtggtgatgatgatgataatgatgaggaggatggtgatgctgatgatgctgatgatgctgataatgctgaatgctaggagggacttttttgttttgttttgttttgctttgctttgttttattgtgtgggcttgcacacacgtggaagtcagaggacaaccccggaggaatcagtcctctctttccagcacgtgggtccttgagtcatctgctggccagcaagcaccttttacccgccgagccatctcaccagctctggttttgtgtcattgagtcactgtagaaacctggtttcataacgcagaggtcaacaaaccgtttctatagagggccaggagaagatggcttgggctttgagagccacgtgacctttggcatcgctgctcaactgtatctgtagacagcacatccacaaatggtcatgtccatgttacagcagaactttacagaggggctggagacgaggctcagtggctgccgctcttccagaggacacgagttgattccctgcacccatgtggcaactcacgactctaactccagtcctagagaaatccgtgccctcttctatcctcgccaaacacaagacacacactcatgcacgcacgcagtatacatacatatcatgcaagcccacactcagacacacaaaataaagataacaagtcttgaattttaaacagtttaggtatgcaagcatgtaatgggccaacatcccctgaccccaccgtggaatataccacattctggaattgctctatattctgctaacctagtcttccaccccttgtatttctaattagaatcaagtacctattaattacacttgagttcagtaacaaatgtttcccaggcagggacatatgctccctgaagcatcacgtcctgaagcaaagagtgtctgcttgccgtgggtatttcttaagccgcagtaactctctgcaaatagatctgcgtttagggaaagcctgctcattccctgaacgctagcgaggctgattcttctctaggtaacgagatgaatggaaagtgactggtattgtccactcctaaatctatattaaaagcctttaaaattaacttggcagtttcgccgctgataatttgtctttgaagaagcggagcgtaggtaaacattcttcagtgcgggcattcatcacgttactaactacaatagcagatgaaaaggaggtgcgtccaacaccagccgtcagtgcagtgacagaggactatggcggaacaccctgcatctgatttcattttaatgtgttgtatgggaatatcgcgtgaaaaagaatataagataattggatttaaaaaagacagtttttaaaacaggatatatagaaatatgggtgaacagatagacggatggacttgccggtaggtagagtcttagatgggtgaatggatggatgatgggtagatagaaggatggatggatggatggatggatggatgaatggatggatgggggtagattaatggatggatggatggatggacagataatggatggatggacagagactgatagataaatggatgtgggtagatggatggatgtggatgaatggacagatagactgatgtttaaatgaatgtgggtggatggatggacagatggacagatggatgtggatgggtggatgggaatagatagatggaaagctgcatagacaggtggtaagtagctaggtggctgaaaggacatattgatcgcagaaatcattgctataaatattcttcaatcaaaaacatccatggctaactcttactggccatctatcctatttgacactcccctaagccttttatatcgcctttacaatccctacaatccatacagccttatgaagtaaacaggttccacacgttacaaatggcaaacggagtcaaagagggttaaacaaacctacccaagatcaggtcggaagctgctggtgtcagggacagcctttagcctgagcttcctaccgctggacacagtatggctgcagaccaccagggaagaatctagaacgttcccatgtaatcagtctctcccaggactgagaacatttttccttcccgttgtcctttccttccacccccattgttcgtcttgcagtagctcatattgcttctattgacttttctattcaaactcggggttaaaatatcccagacgtactcttgttgccaatcttccattctctaagtccaggtaacttggggaccctgaggttgacccactactgtcccccggtgtcatcttgtccttctgagaactatagcccaccttccctggagggcatgagggcactatacacctcacctccatggaggcagcccttgggacatgcccgtgacaatgataatggctgtgttttctccctaacaactccggaggaggtctagtgtactgtcatgagccagcgtgtgtgtcatttctcaagactcctttcgttccgactggccgaagctaaagtgattttttttttcctttttggacactaaagtcaatttgtcaccgtgatgcatcgatctaacgattcccctcatagacttaattccaaaatgtggtctgctcgggaagtttgattccttcgcccagctgtaatcttttagcatcttcgggggaatcccttcggctggcactttcccagtggctgttttgtggtggcctctggccaaaagtaacaacattttgacccagatctgaacccaaagtgaaatgaccagtaatggcctgctgcttgaatgctcccagacccagcacctgcctcgggagtggtggacctccacgctctttccagggaacatcttcctcccctgccctgctccctgcccacgagcccagtcccagaggctatgcatgtaacagcctcccacctgcctttggcacacgccccccaggtggaggcttgggtgtggcccaccctggaaactttctgacctcctccccctccataggtacgtgtgggagaaggatggggccaccctggccgtggagactaatcctcggatccgcctggacagaaatggctccctacacatctcgcagacgtggtcaggggacattggcacgtatacctgccgggtgctctcggctggtggcaatgactctcgcaacgcccacctgcgagtcaggtaagggcagaggagacatgggtaatggcagcgacggggtattcagatccgaccagctccttttggtcatggcagaaaaccgcgtatggctaggaccacccaagtaccctaagacacctcctgaacacccttctaggcctgctcccacagctcagggacacctctgccaggagcagaagtcttcataggccttagatggggctctaggtccagagagaagaattggcaggcataaacatctactcactccagacaaggcaccaagatgccaaagttgagcttggtggaccaatgagcttatctgcctgactcaggagtgtggttaaccccgaggcggctgcatcaccaaaatatccccactccaacatggatggtaacttccccgtacttgccaaaatggagttccatcttggaacaagattacacgcctcccctgggaaggaagggcaggaagggattagcagggatctcaggtgagggtccagtgaccaccctctcctacgagggaacatggacaggcaatcgtttgtttattcgttttattgtttgagaatatcatgcatgcctatgatgcatcttgatcaagtccacccccatccttcccctcctatccccccccccgtacctcacgacctttccctctccacctcatggttgttgttcgcaaacctgctgagtccgcttagtggtggccctatggcatgggtatgggactgtctactggagcatgggggcttcttatctttccagctgtaggtgggactcaagccttcccccttccattgtgggatttaggctgatttgatcttatataacatcttgatcttatttccatgatgatctgatgacgatggacatttatacctgagcccgtcacagtctctgcctctctgcacactggccagccatgggtctctgtagttgtcaccacttaccgcaagggacatcttctctagtgaggactgaaggatgcccgaatccagaggtataaggataaagactaaggaggctgttaattcctgtgtctacttaggacaggaatagtgttagattctcacacacacacacacacacacccatgaccacgggttttaggcccatgttatgagttccatcttgtgatacagaccttgaatccaagcagaaagtggctctggtcacttaacataacatcccatagcatctgtgccactgttacaccagtgagtgggtgtgtcttgccaggctagctgttcttgcagcttgcaggagtctcagctaggtaagaacactgactccttttcttcccggttgcatacgttgaaccttccagagatgtaaaagcaagcaagtagggatgaagcttcaggttggtaccagtttgatgacgccatatggtctcttcagcagtaaggtcttaccatcaagttctggaacgtaagcaagagaaagggcaacagcctatgacagagagaagctatgggaccccactgacaatcaacctggaaaaagataccccatacatgccactgggcttttttattggatagcctataaaattataggctggtatctaggagaggcattgtgctcatattagagattaactccatttaaatgccttttatatatgtagagttgtatattttaagaaacgtctacaatagtagctttccacgtggtaatcttgttaaaggtcctctgcgggttatcatagctgcttagacaaggatggtaatggctgctgggcagcaaatgtctgtaatctaaggacaggatttggaaggtggaagaaggcagatcagaagttcacggtcattctctactacatagcaaattgaagaccagtttagcatgaaggacagagttccataagacacgcccagtacacagcgtcatggaaacagaagactctctgagcatgcagctcggccgtcacctgatggcagagcatggcactcggggacttggggtggcccctccacacacatctctcctccaggcagctcccccatgcccctgagcaccctgtggcaaccctcagcaccgtggagagacgcgccatcaacctgacctgggccaaacccttcgacggcaacagccctctgatgcgctacgtcttggagatgtcagaaaacagtaaggttcccccaactgtcaccttcccatgtctccacacagcctgagcaaaaatggggtgtgatctgtgaggtcaccttgtgagtcagctagccctaccacacacttcttgaacctctgggcagagcagatcttctccctgagaagccgtggttttcttgtgtgtaagggggcaaggggttacatctaggaccatgcatgccaacagcctaccaaaacagctgataggctgttatgactctccaacaagactttctcgggggagcctggtgtgtccgtgtagcctgtagtcccagctttcgggaaacagaggcgggacaatcaaagttcaaaggttggctttgaacgatgtaggtgaggggcttgtgtaagacctgacaagcagtggcctcaaagactgttgttcttacaagtgccccactgtgaatgtcaactcagtgacgccctcgctgtggcttttccagaattgaggcagctcagttcccatgaacctctgcttcccctccacttcctcccagctccctccaacccctggatcccatgggctagtgggacccagagaagctgacatggtgacctatgctgccccaagttatagagacgttcactccccttcccacccaaaggagagggatgggggtgaagggtagactccatcacatcgctggccggcaagatggctcagctggtaaaagcttgctgccaagcctgatgacctaagtccagtctttgggagccacagggagcaaatcaatgccctcaagttgtcctctgacctccatataacacatggcacatgcatgcccatagatgcacacatatgtgcacaaaaggaaataaactttgaaaattattttttaaaagaggaacatatccccctccacacagtgtgcccctctaccctaattctgtgtgtctgcagatgctccctggaccatactcctggccagcgtggacccagaagctacctcagtgatggtcaagggactggttcctgctcgatcctaccagttccgcctgtgcgctgtcaatgatgtgggcaaaggacagttcagtaaggacacagaaaggtaaggggagcaggtgtccccctgagtgcctccaaaccacgatgacacatggggcaagccagagggcgggtctggctcagcttctctcagtcttccactctgtagaatggggggatgatgtgcttaaaggaaaaggcagcatcctgtgggtgcagcatggtccacaacaggcttgaacaagcttgggtcattcctatgaccgcaagctgggcaagttcaaagatctcccggattctgcccagtcccatgagcttctatcatggttcaaaggaaacaggaagttccagggggaagagggactccccagtgtccatgtcagattccaaacggacgccagagcccgtgggtgtcctcccagtgctctcacaaggtgacagacaccaaggacaactaggcaatccacataagagcgcctcacgatgaacacacttccgtggaagctggacccggcttggcttaccctgtgtgagaagaagccacccctaccgggagagcagctatcatttaggaagtcagagtggctgtggcacagcataagcgccaagctgtgccgttggctctgcaaaagatgtcgtccaagctggactaattggcgtgggcctgtaatcttagtgtctgtggggctgaagaagaatcatggattccagctcagcctgggccaagccatctaggatacagaggaagaccctgtctcaaagacagcaacaagtgtgtcttggggaatggctcagcggggaacgtgcttggtggacaggtgggaggacctgagctctggctcttagccaattcggataagctggccacggtggcacccgcctgtgatcctgacgctgagcaaggcagagctgggcagatctctcgccagccagtctaactaaagcagcaaactaccaggcgtggtgatgcacgcctttaatccccgcaacttgacaggcagggtcaggcgatctctgagttcaaagctagccctgtctacagagtgagttccaagacagccaggcctacacagagaaaccctgtctcaagcaagcaagcaagcaagcaagcaagcaacaaaacaaagtgagcctgttgagatggctcagcaggtgaagtcgtccacctccaagcctgatggccaatccccagcgcccacacggtggtaggagagcactgcttcctgtatgttgtcctctgacctccacatgtgcactgtggcatgtgcgcgcacacacacacacacgcccacataataagcactacttattgagcatatacaatattgcaggctgggttcagcccccaggaggtgcactgaacaaacaggagctcagcccctggaaaatatcagaatcacagcagggaccctcaaagtcccaggagaccctgcccgctcctgctgtgcaggcggctgctctgggcaccaatctgtcctcgttcggaatctcagcacccatactcctgagtcaccacgggaaaggttaaaccacccgcactttaaaaagctaagagcagacgggactgtttgggaggctatccatcagagagcaaaaacataaaaataaataaataaataaataaaataataataaagtaaacaaaaaagggaaaggcatccatcaaaaataattaacttttgtgtttaatggataagtgtcaacggtgtgaaaaatacacttgggcgttccccagccgtgccagggaaaggaaggtggtgcttagcctcagaagatgtctggggctggggctggggctccttcccccaacccatggccacccacctatcctggggctctgctcacccagcatggggatctagataagacctgccaccaaagcctgtgggaaatgactgatactcctagtcctaaaactattaagacaagcacagtatcagcatgtgcctgcattcctacactcagggggctgaaggaagagggttacaagttcaaggccaccctgggatgaaatgcaagaccctggcccataataataataataataataataataatagttattattattattattattattattcacaaaaggaaagcagctcagagacatgaaatgagctgcccagaaacacagcgcaagggtgcagagttacaggggacagtacgcaatatggttagccctttgtcattttattatagccctttgtcattttattatacacctttgtagatggggtagagaaagatgcaatcaacgattgctggtttctgctctagggtgtcccttcctgaggagccccccacggcccctccgcagaacgtcatcgccagcggccggaccaaccaatccatcatgatccaatggcaaccacctcccgagagccaccagaatgggatcctcaagggctacatcatcaggtacagggccattctaggaccatcagggcttcctaccctgaggggggaggggcttagagaacagtacagactcaaggtccatccttgccgacataaagaccaggtgatgagaaatgcccacactgcgacaagaagggctacggtaaaatggccaaagaagaacggacaacaccaatagccttgaaaatgagtaggaccagcccagcaagggcacagtttaatccccgcaggctgcatggaagccagggctgctgcaggccagggctgccgcaggccagagctgctgtgggagcaggcaggaagcaagaggtgactagactgcaacagcccacctccctcacaaccccggaatgtcctgctgcaagcctgacgtgtctaaatgaaggtgtgtctagcccatggactagggctagcaatgaatgggtctcaacacagaaatgcacaaacttatttagagcattcaaagggtttgtttgggttttttggtttttttttttctgtttcggtttggttttttgcgatttctctttgcaattcaattgtacaattctcaacatgaactttgcatatgacagtgtcacttcacagtatccaaaaatcggaccaagcacaagtagaaaaaccaacagggcaagaacccgctgaaaggagaaagttgtttctctggttcttgctgaaaacaaaggccagttctgggagctgacgaactaaaatactcccaaatacaaacagctcagtgggcagggatgagttcaattcccagggacccacatggtagagggagaaaccagttcctacagattttcctctgatctctacaagtgcaccatcgcataggcatatccaccacacagataaaaataaaatttttaaaaatgcttctcagaggctgaagagatgattcaaaggttaagcatgcttcggcttgctggttgttcatccaaaggacccggggttcagttcccagcaccctcaaccgcagttcataccatctatagcaccagttccaggggatctaatatccactcttagcctccctaggccccaagcacacacatggtacacagacatatatgcgggcaaaacattcatgcacatcatgttttaataatgttttaattatcttgggattttgtagtcagtggaaacgcccatctgtattctgaatttggctggttgcaaaacgcttcttcaagtctgtgcctcttccacgcacaccaagattcctgggtgctaccacaccccacagttggaagagcccatggctccgactatcccatgatcactcgatttttctgtggttttgggagcttatccctaaaagttctcagagtgtggtccccaacccaacagggtcagtgctacctgaatgccagtgagagaccctgattgtcaagtctgttcccaagacctccaaagtggatagtctagcagtctgtgttttaaccagcctctgggttattccgattcatgctaaggtctagcacataccagctctggggggctttaggaaatgtgtagaaacactttgggggctctgattctgcaactgttagagcctaaagcaggtaagcatcatgcttctccctgggcctagtttaccatccatgcagagcaccccacgtttgcttgccggcatcccttcctttgtcatggttggtttgcaccagaaagtagatatggggacgtcaggagccttcagggttctcagtccccctcagcaaaggagccactgtaccaaggagagaaagaaaatcagctaaatttagggggtgctttcctggttcataacctccaaaagctgacacctgtgtcaccttccctagggaccctcagcctctgtggttggcagtctcatctgtgtcttccaaacccatcaaaaagaatggtccagggggctaggaatggctgtggctccattgattagaatgttcgcctagcacgcataagtcctgagtttgatccctagcctcatatagattgggtgtggcgatgcagctctgtagtctcagcacttgggaggtagaagaaggggtattaggagttcaaggttatcctcagcgacatagtttgagatggggcaccctgggctatactccctagacctgcactaatcagcgaagtagagaggagtcaactgtcatgattcagaacaattaaaactacaacaaagtcaaattcatccctcatttgcacaaaagccattgtcacatggccagcagcatgtgctctagtggtgaccctattaggcagcccagatgggtgtatcagtggagtgatggagcgttcccagagcatacaacgttttagcagacagggctgctctgggcagtttgccaagcacaagtctgtaggctgattcaactcactttcgcctcttccttcagatactgcctggcagggctacctgttgggtaccaatttaagaacatcacagatgctgacgtcaacaacctgttgctggaggacctcatcatttggaccaattacgagatcgaggtggctgcctacaacagcgccgggctgggtgtctacagcagcaaagtcaccgagtggacgctgcagggaggtgggtggagacaggggccatggaagaccaggtgcgtccttttctgcaggcccctaggtctgttgggccacaatgccctctgggtaatccacatgttcagttatgagcaccccagcccacattgctggtttcacctgggccttcgtaatggcgcttaggtgacatctccaccttacacctggctcccatggagcagatggctgaggggaggaggagagagtggttaggagtcatgtggaaagaggtgtaggaaccttctatggtattttgacattaactgggtaacaagacagcttgggaggtggatcagacaatttttttaaaagaagattcttttatttattttatttgagtacactgttgctgtcttcagacacagcagaagagagcattggatctcattacagatggttgtgagcaaccatgtggttgctgggaattgaactcaggacctctggaagagcagtcagtgctcttaaccactgagccatctctccagcccagatcagacaaatttaatgaacttgagttaatccagagagtgggagaggaagggggcccttgggtttgacaagcattgcctttagagtctgcctgtgtcctctaccacactgaaccagacgaacaggtacagaggttggggtgggggggaaacccctcagctacaaccagtttctctatttcctctagttcccacggtgcccccgggcaatgtgcatgcagaagccacaaattctacaaccatccgattcacctggaatgccccaagcccgcagttcatcaacggcatcaaccagggctacaaggtagatgagggtctcttctctccttgaaaggaagccaggaggagctcagggtgttagggctgaggggtggggtggggggctccagggaagagcagtaaaatcactgtgggcttctgaaaccagactccagcagacagaggtcacagataaaagcaggggacaccccgcccccagtgactttcaaggttacatagaagattctgggagagcacactgtgccccagctgtcaccagaaagaggctgtcctcagcaactccagccacaaacaaggcgtggactcctggccattgaggtagtccatcaaaacaatgccccagtcactcactccttacctctatggtatgactgtcacatgccactggctgtacttgaccccaaacacagtgagggtaaagcctcgggattaggacagagttgaactacaaaccccagcttgcctcttgtcgactaatgtcttagattagagtgtggatgtcactctctctccttatatgttcatgagtatctgtggtctcatcccctcttcttgcaaaagtgccagtcacactgggctagggcctgtccctgatgacatcactcaactttaagcagcactttaagggcccaagttccaaacactctgggagtccagcttaaaacttcggcacatgagttcagtacagacacggtctagccaatgactaatagaagcgtctgagctgtagccatacgaatgctggctgggttgtctggccagtttaactgctgggcatcaggacttctcagtcctcctgtcctgcatcccaggcctggggtcccctactcctcccacaaggaggcctgctgtcctctgagagaactgaagacacaccaggtagcataggccaacgccatgtttggaagcttctgacctcagcaggaggtaggtagacagatgtcacagggtcatttccaggtgtgaaaaaaaaaaaagaagcagaggatttaaggggctggaaagccaggagaaaggagagaaaattacaaactctggggtttagctcagggtccagtgatagcaaggtgacaactgccatatccctgagtcctctgccccgaggctgcacatgtaccacaaggacaagcgtctgcaccgttacgacttggtagcttgggaggctggagaggaaaggagtgagattattttgcaaaaagaatcttctacttgtgttagaagcaacctagagaccagagctggagccactgggccacagcactttcaatcccacgaaggcagagagcacgggccaaaaagaatcttcctgggataggggctgtagcccaagcttgcagttgctgactggctggaaaaaaagctgctaattgggactcgggggagggaaggaggtctgcatggccatggaacacagaggccgagctgggaacaattagcttctggctgccaagcctaagcacaagttttattctacatgtgggagggacgagctacaagcttctaagatgaaaagccctccaagggctgaaaggccaccaagtggccaggacaactagggcaatagcctgcggtgacccagaacaagaagataccgcagaagccccccaaccctgcttcatcccaactttctcctgtactcaggagctgtgtagatgggccagtgaccgtcagctgcctgatattttgagcatacaacaaactcatggggcagcaatagcgtattgtcacactaatgggggcttacccaataccaggcaaccagctacatcctctgctcattctctcgtgcaagtgcctgtgaacttctgatcctcctgcctccactttccaggtcctaggtttataacatctagtctatgtagtcctggggattgaacccagggcttcaggcacaccaggcgagcactctaccaactgagctatactctcatccctgtgttttattgtaaactgataccttcagcttgttttcggttttgttttgaagtacaagtgaatcaaagttgaggtcttttctcttcgcttcgttagccttcagaatagggggatgcaatggttgtcccatctgtacatgtgatcagatagaatatcctttaagttgttagaatgttcggacatctacacaagttggggggaagactcaaatgtccaccttacacccatctccagcttcaacgtgaccaagtggcagtctcctcctcctcctggcagtctccacctcctccgagctcctcccagcccttagcccatcctgagcaacttgccgaagtgaatctcaggcagttcatcacaccgtctgtaaatgtccttgtagagaaagagtctctacaagctctctctattaaaaacaaccatacctaaaaatgtcaaccatcnnnnnnnnnnnnnnnnnnnntctccctcccccccctctctctccctctctctctctctctccctctctctctctctcccttcctctctctctcctcatgatttatttggtgaagaaacttagtcattcatcccatgcattttccacagccctgaattttgctgattgcctccctacggggtcatttaactcgatcctctgagtactatatctgcacacaattggaatgtagagccagtggccgactggattcaagtttgtttgattaccttttctgcagggaggtgggggtccctcggtgatgctgtgtgttgacatccgaaggtgcaaagtttgattgtctctttaactgtgaacctggtggccgtgaacagccctttgtaggggttgtgattttttaataggagttacaaactgagggtggaaattttattcttgattagctaaaatgccttcaggaaggaagaaatgaggtgggaaaagagggagggatggagagagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacacacatcagtgatcaagaaaatgctcccactgattggcctacagaccaatctgacagaggcattgtctcaattgaggtttcttctttccagatgacgagtctggatgatgatgatgtgtcaagtaaccaaaaaaaaaaaaaaaaagccaaaacaaaacaaacaaacaaacaaacaaacaaacaaaaataggacaaggccaaacagaggaattcagtgagaccctgtctcaaaaaaaaaactaaaaagagagagctggggtagagtctagtgttgaggtgactgcctggcacatgtgagtccctgggttcaaatcccagcccagggtagggaaaaagaagctcttcgttgtacctagggtcagacattttcccaaggaactccagatctcttgagatagagagagtagataccatgatgtggttaccaggaatgtctcttgctccaaagatagtattgtttctagactctgaatggacaggaagaaggagaatctcttaaatacagtgcacattgatggggttggccgtatgacttagtgtttgcctagcaggcagaaagccctgtcttctgtctcacaatagcacacaagtcaggcatgataacacctgtaatcctggcaataagcagtgcaggtagtagggatgccagacgttcaaggtcattcgtggccacgcagcaagttcaaggacagcctgggttgcatgaaactctctaaaaagtttgttttttgttttttgttttgttttttaacgtatcctgatggttcccattcaacatcaagattgcaggttttctcataagcccaattggtctcttgtttgtatctttttttttttttttgtccacagtaaaaatctagttcttgcacaacttcctcggtgccaacagtctcatcccacagacacacaacagcttcaggaccatagcgggagtgtaatgctactgaccgacagcctcaaattatcggcatcttttgtggttgttgagatgtaacccacaggagacacacttcacaccgctctgctatgatgtcttttgaatagtttccctcactgtaatttgtctacagctcaatatcctattaggttcattgacttcacgttgttttttgatttttagggattgatttttttaatttaattttatcctataattatgtacaatatttacatggtttcaaagtcaaatcaacaaaacaaatttttaagaaagtcagccttgatctggggagatgattgactcgccatgcaaggccataacctgagtttacaacccatgtgacaagccggacacagtcaccattcacatccctaatctcagcagagccctaccaggacgagggaggcagagcaaagggaaccaccaggagctggcaagccagccagcccggcataggcaaacagtgaacaacaggagacactgtcgccagcagtgaaagcaagaggagacacccaaggttatcctccgaactccacccgtacaccgtagcacacccaagcccacactcacacatgtacacatacgcatcatatacacagcaaagaaggaaggagggagggagggaggaagggaaggagggatggaagagagggagggaggaagggaaggaaggaagagagnnnnnnnnnnnnnnnnnnnngaaggaaggaaggaaaggaaggaaggaaggaaggaaggaaggcaggcaggcaggcaggcaggcaggcaggcaggcaggcaagcaggcaggcaggcttgaccctgcaccataaattcatcaatgtattaattgatgagagagcatttattaataaatcacctgtcaatgattggacccaccagccagagacagaaccttcaacatcttgtgagcctttgggcaggaaggtgggtactttatatccaaaccataacactgagaaatctggggaactttgtgacccttcagcttcaccccgaggatgtgtgttgttcatagcagtcttgggatgctatgaccctgaggccattttggtctcagttgtgaagctggagagagaagccaatatggcttgttctcagaatcacactagccttgccttatgcatggcttcatgggtcatttttgtgtgtgtgtgtgggtaagacccagtgatactattttaagatatctgtaaaggaactcttttttcctttattttatttaaaatggtagtgattgtaattagcttaagaccaataaaataatatttacccaaattttacacttgctggggaacataccacacaattaattccaacagcataattaattcaaatttacattaattaaattaaattaaaacattaaactcatttctccatctactccaaggaagttgggcaatttaattgctatgaaacaagataactaaaataaagaggatatttaacatacttattaaatgccacttagtgtttctgattagtatttttagggtctaattagtgtctaattaacttgctatgggctatcttttcacaataccaattaaatttcaaaacatcctttataaacatccggccctgaaaaggaaaagattaagcattgttacgggcatgagttaatcaggagacattggcgtggtattgttttatatctataaatacccgtgcttattaaaactcttcaagtgtagcttttcaccattaattgctatttaatcaacttcaaataaatgaggaactctctgggaccagctgccattgttggagacagatgaagggcccagagaacaagagctgggggtaagagggcaggagaggaggaggggctagctcgggatgaggaaaagaggcaggcaagctatcaaaggatggagagaaagtacaaagggagaggggaaagaaagcgtggggtccaggtggggtctcttgccatcaccctcctctgggtgagatgtaagattgactacctgacctggtatagacggaggacaatagccattggcatggctgtggcatccgaccttggagaactcacagaaagactagccagtaggaaagcagaagcggcacttccaaatctccgcttctcctagctgtgtgatgtagtagaagggacttggcctttctgagcctccgtttccttgtctatgcactaaagcggtggcttcgtggatatgagacctgtgggcacccagggctacagacttagaaaagccccgcttaggtacactgctctgctgtctcttggaaggattttttttttttttttttttagacaggatttctctgtgtagccctggctgtcctggaactcactctgtagatcaggctggcctcaaactcagaaatcctcctgcctctgcctcccaagtgctggattaaaggcgtgctccaccactgcctggtggaaggaatttttttaactaaagggcctgtttctggttctgtgcccagacctcagattgtaataatggttctggtaaaatgcctcccttgtaaggtagctgggagaatggggtgacagggccctgtgggaagcatcccatactgtgtcttacctggagtcagaggctcaagacacccagagcatcagaatgtacatgggagtgacctagatacagcagcctcagtgttacctggcttgtctctctagtccctgggctgaagaaccactggaccagtgtccgtccattgacctgacctgttgtagagagcttcatttttcccaaaacatccttctggtttctcctcagctgattgcctgggagccagcccaagaagaggaggttaccatggtgaccgccagacccaactttcaagacagcatccatgtgggcttcgtgtccggcctgaaaaaattcacagagtactttacctcagtcctctgcttcaccacaccgggagacgggcctcggagcagcccccagctggtgcgcacacatgaggacggtaggtgcctttacccccaacttccacgcccacccacccccaacccagacccttagggagtctcgggctatcctggagcacagcggccatcctgcatagagtggccatgctctgacgctaatgggcactggtgggtgggggacccttttgggaacagtacctggacccgtgggacacctgagcttcaatgacatcctggacacctcgctgaaggtcagttggcaggagccaggcgagaagaacggcatcctgacaggtaggcatgacgatgctcctgagcccgagggtaggacagtaggagactgggattaacggctagcctctcccctgccagctcctacccaggcctcccaactgagccacactctcaactcttagcttttcccttccaatctacatacagcacatctcggggctcctgctccacccctgcagggcctcaggcttttaagaaccccaagcatctatcacaatgcattactctatctacctgaaatccctgcccacaagagacatcctactgacactctacctgagccctaggcatgacaccagcagctcctagcttctttgctccctctgctcctggggtgaaccaaaccaccaagctaggtacagagtaaggattggaataagggtcaaggtcaatgcacgatctcaacccagctcatgctactactactgtggactgttgccagggtaccggatctcctgggaagagtacaacagaaccaacacccgtgtgacccactacctgcccaacgtaaccctggagtaccgagtcacgggcctcacagcacttactacctatactatagaggtggccgccatgacctccaagggccagggccaggtgtcggcctccactatttcatctggtgtgcctccaggtgggtgcttcccattagaactcctgcctctgctcttctaaacagctctcatttttgagggggctctgtctgcctagtttgttgattagttaattggttagttgggtgggtgggtgagtgggtgggttgtttagtggtcaattggttggtagttgtttgcttggttgcttagttgtttgattggtttgttgatagttggtttgttgttggttggttggttggttagtttattggtagttggttgattggtagttcagtggttagttggttggtgggtggtttgttggttgtttgattggtttgttgttgtttggttggtggttgattggttagtgggttggtgttgcctgtttggttaattagtgggttggtggttggttggttggttgatttatttatttgtattaggttggttgattagttgccttattagtgtttggttggtcagctggttggataatgggtagtttgtggctatttggttggttagtgagttggtggttagttgattggcttgttggtgggggggtggatggttggttggttggcagttggttgtttgattagtgaatgggtggttattggtgagtgattagttgattggttggctggttggttttttgtttggttggttgttgttgtttaaattcagagtctcgttctatggctcaggctgcccttgaactcacagtagtcccattatatctcctcctaagtaaccagaattacaagaatgagacactacaccaaagttccagtgcattttaaggataagacttgccattaaacccatgctggcctcaaactttgcagtagttctgcttcagattttccagcactgggattgctagtgtgaaccaccatacctactcttggaggggttctgtcttggagtaatgttgattttcttccactgggttctcccctttgcttatctcttgggcccaaggtccttccgtgagcagacttggatcccatggcctcaggccctaggtgaagagctatagggctctccatcccctttccccacagccctgaacacaggagaaaccctgaaccaggaccccaccctcatccctgttgcccacaccctgctctcctcatcccatagtagactccctgccaggagaattcaaagaaagaattcttaccatccacattggactgcagcccatagacaaacttcttgtggggtggtcaaattagatgggaataatcagtcccaaacacaaacactaagcaagccaggcatcatctctgagcctcagtttccctatctgtacacatacagaattggaccagatcaccatgtggtcctttccagatcagaaaagctgtgccagccagactgcctggaccaacctactaaggtggccaagacacctcaggctccttcaacccccactcataatatctatcagtaatgctggtggttatctgtctgggacttcccaggccgaaagctacaggctttctctttctatgcctcctcgctgccgtttcctgctacgtgtgaccataccatcaccattataccaagacatgaaaaagggagggaggtgctgtatctgtagcttcccttgataccgagacaaaaacgcctgacaaaagcaacgtaaagaaggaagggttcactctggctcacagctcaaggctacagccgtcatggtgtgaaagtcacttcaaagggctggtcacattgcatctggaagcagagaaagacagagacagagacaaagagagagacagagacagagagagatagacagagacaaagagagacagagagactagtggtcaaccccatctctccttatcactcagtccagccctcagcctgtacaatagttccacctgtagttagggtgggtctccccaccccagcccaacctaaaaactccctctcatatattcccagaggcttgtcttgtagagggccctaaaccctgtcaatttaactatctcagttgctcaaagacacagtctgtaatggtagagttagattcaaaccgatgtttggatggttttatctgtttgtttgctttgttgattggttgggtgtcgatactgggtctcactatatacctttacactggcctggacttctgtagccaaggctagctccaaacacactacagaatctgcattctttcagtccatcctgagccccaagaagtcctgacttcctggttgaaaaaggggagcagcctcctgtctgcccccaccccaacccttctaagcctccccagccatcactggctatggagggctgtagggtcacgtggatggaggacagttctgatccatatatttgcatcaagcctagcttgatttgtgcaacttttcaagtattttattgccaaaacttccgagggaagccccagcatgcacagctccagggggtctcggctctcagatctgtgccagcctcccagtatgaatgtggtgcctgggtgacagaatcagagtcgttgtcaataggccttggctgtgcttctcctgagatgtccccaagaacggcaagctgctcagccccctccctgccacagagccctgttgccagggagccaccctcttactttttctaccctgccctcctttctcagagcttccaggggcacccaccaacctgggcatttccaacatcggcccacgatccgtgaccttgcagttcaggcctggctatgacgggaagacgtccatctcccgctgggtggtggaggctcaggtaaagtctgctagagggggctcagacagctccccagaccgcctcaggcagccctgtgagcatcctgtaaggcagcagttctcaacccgtgggcaaaaatcatatacacatatatatatacgcacatatatatacatgtatatatatatacacacatatatgtgtgtgtgtgtgtgtgtgtattaatagcaaaattataatgtatatatagtgtacatgaagtagcaacaaaattatttcatggtgttcaggtcaccacaacatgaggaactgtattaaagggtcacagcatgaggaagactgaaaaccactgcagatcagggcgggggggggggtgttcattgaagctacaagtacctggtatatcagctggtcttgaaatcaggcctgaaaatgtgtttctatccagcctgctatgaggtcctaatacaggaggactcagagccaccctgcagtcagttatggcttttacaccaagatattccctgggtgggggtgacacctactaggtgctagggctcagagcgtcccacttgatcgcagcaagttggacaggtctgaggttccgttctccaggtgggcgtgatcggggagggcgaggagtggttgctcatctaccaactcggcaatgagcctgacgcccgttccatggaggtgccggacctcaaccccttcacctactacaggtaaggcacaggtgggaggggtcgggggaggggagccggcaaccccctccataccttgctcattccctctatcccaccccagcttccgcatgcgccaagtgaacatcgttggcaccagcccacccagtcaaccttctagaaagatccagaccctccaggcgcccccagacatagctccagccaacgtgactctgcgcacagccagtgagaccagcttgtggctccgatggatggtaaggctccctcggggccagtgggatgggacattcacaggactgtccccaccctgtatcaatttgttgacctcaaaggtcactagtcaaatatcgacaattctttacctgtggcttaggtttgggaatgcacctgtttggtttggtttttacttttttttttttcttccttactaacctgtacatagtagttcattgtgctcaaaggagatttgagagttaaaagatactttatatggatggggggaattcacccagttataaagtgtttgttatacaagcctgaggacctgagctcaattgccagcaccaacctaaaaaagccagccatgttagcatatgcttgtagtctcggtgctggggaggcagagacaggaggatgtagagagaatctcttgtgtttgtatggatttgacacctgtcgataataaatctggcttacagcttaggcaggaaatacgaggtgggacatccggtaggcagaaaggattctgggatagagccagacacggtagatttgcccaggaagatgtgatgggacagatgcttggtacctgagcacaagtaaccagccactggctaaattcagaattagaataaatgactaattttaagttatgatctagtcagagaagagcctagccatatagtcaaggtccttctaaatatatttagagtctgagtcttatttctgggagcatggggctgggagggaatactacaccttacttcaacagaaagatccccggggcttgatggccagccagcctcacctagctgtccagtgcgagaccctgtctcaagaaatattaaatgtagggaagttgcttgtggaagcaaacacctttaaaaccagcctcggattataggtgtggatctctttgagttcaaggccagccggctctacatagggaatgccaggccagccactgatacctagtaagaccctgtgtcaaaataacaaaagaatagaataaaaaagcaaagtgtcctctgggcacacacacacacacacacatacacacacacacgcgcgcgcgcgcacgcgcgcgcacgcaagtgtgcggggtggggggaccgagaggcagatgtaatgttgctgcttgctagaagcattgccaagtggcaaacgccctaaacttcctatccattgattgaccccttccaggaaccttgatttacagctaagaacatgaaagctcagagagattaggaacttgcccacagccacccaagcagccacaaggtagacctagcgtttagaaagagttggtcagagagtgagcacacctgctgctgaggtggaagccgggaaggggccagccccacaggtcagagctatgcttactttgagggtcatgactacaattgacctgcaggaagtaacttgctgatgcgctgtgcccttctgggagctattctgggtgatttattcagagtctatccttaaaatgttctcatcaacccacaatagcagaatgaggctcgcccccaatttgcataggaagaaagtgaggtcacataacctccccaggaccccccacatcctccttacacttcccaagttaacagcaaaagactgagccgcaaaattcacagcactggccactgaacacattgtcatctctcagccaggaaccaaaacattgtgtctcttgggccaccctggctgggacagggcaccccagcaggagtcccaagcagtagtagtcttagaaacttgtgtagcagataagaataattctgacaggcatgagcaagaggagcagctggcatccctgctctttgggagacccagaaccctgacaaaaatagagccaacctgatggtgccccatggcctctctcatcacacagccctttgcctccaagagagagcattcattggttatgtaaactagcacaaaccctccggcaccatacatgccaagaaggagctggtggctgagagaggacttgacaccaagagcccccaacagacgctagttattaattatggctcctcttctagaggcagaccccaagcaacactttggggctagcccagtggcccagggcactgtgagtttgtaagtgggacatttggcctcctgtgacctcaacttcagctcttctctacccactgccagcttctctctccctctccctctccctctccttctccctctctcccccttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctcccccccatctctctctctctcacacacacactgtaattgtctccaaagatttccaaacataaaagttagagaatggattactggggtgctgtgggggatgggaagtcaacagctatgccatgcagccatctgcctcataatgaagcacatagccagttacttctccttaactagtaggggagtggcacaccaggcccatctcagccatttgggcccatccatttctgtcttgatgatctctagctgatgtcagttaaatgtctgtcgagggatatggaggtgaaaggagggtaggttcgtgaggcaggggctacaaggaattggataaagtgggttagaaaatgatacactgtggattatgggcacttagaggcccgaggaggcagaatggaggggagaaactgcagacaccccagcttcagaggcggagtggaagccagattctcagctggtgtctgctggaggccaaagggccacctccaccacctaccaaccttgccagattcatccaaccttaaaccagtaagcaggacctgtcctgctgagcgatatgaaccaggaaaaggatctgccttatctcattgctgagactctaaccagtaagagaaagatgaagtccagtgggagagcctgagatttgctcaatagcaggacttcctgacagtaacgtgcatataaggtgaccatataaggaccccttccccccaggttccctcctcccaagggcagtgtgagtaaagaccaggtgttagatgcagttaacagcatgtgttgacagccagagtaagggagttagttaaacaggaagacaccagagcctgagggctctgctcatcagctcactggtcagacaggttttgagcctgctgaaaaggaccagcctccaggcaagggtataagtcagccacgtgaatgaccaacaaaaatgttgcttctctgggagtccagtgtggagagtcatggaaacagtgctccactggggatagcacctcttttgggcactggctgctcaactcgtgggtgggaaagaggaaatacagagtgatctccctcctaatccctcacctctctgcccctgctttaccccagcccctcccagaaatggaatacaacggcaaccctgagtcggtgggctacaagatcaagtatggccgctctgacggccacggcaagacgctgagccacacggtacaagaccgagtggagcgagaatacactattgaggacctggaggagtggacagagtaccgcgtccaagttcaggccttcaacgccatcgggagtgggccatggagccaggcggtggtgggcaggacccgggagtcaggtaccacggctcctcttcctctgggaccatccaagagcagaccatgctgtggccatttctacagacagcttagcagctagcctctgtgctcaccccagggcagagcaccctgccagatctctaggtcccgcagtgcagcctctactggcaagctgtccaagcctaccccagccactgccccacacactcagccttaaccccatcacccaaccgagggatctcagaacattccagaaacaaaacctatctctcctaaggagcctagaaaggggtcttccctcctacactatgagccctgatccaaagggaaatctcatatgtccaatttgtagttcattgtaacacttttttaagtgtcagatgtctcttctaccctccctgagcccccacctttgcctttcttcgctatgtgggctggaaagcaaggtggtccaaagttattctggaatcagtgtaggctgaattcctgagctcaaggccagtcaagctatgcagtggtatcctgtctcaaaacaggtgagggtagacagcaagatggctcagccagtaatgacacctgtcatacaagcctgatgacctgactttgctccccagaacacacataaaggtgaaggggaatcagcttatctgtgagactgtcctctgagctccatgtacacactgggacatgcacatacaccctttacacattccatgggtacacacaataaaataataataataataataataatagcatatacaccctatacacctaccacacaatataataataataataataataataataataataataacatatacaccctacacacccaccttgggtacacacaataaagtaataataatagcacatacaccctatacacccaccatgagtacacacaataaaataataataataataataataataatagtatatacaccctacacacctaccatgggtacacacaataataaaattaataataataataataatagtaataataataataaaagttactgtgaacagggaaaaatttgggggccgggctgaggatattattatattatattatattatattatattatattatattatattatatattagtagactgcatgccctaaattgcttccccagcataaactagacatgatgattgaaactctaatcccatgatttgggaggtagagggtcagaagttcaggatcactcctagcaacatagtgaactcaaagctagcctaggctacacgagaccccacctcccacctaacatccccagaaaagaattagggagaaatagctgaccccggaaacctcgtctgcaacctcccccaaaccaccataggatcgattgcagctgtgatctgcgtgtactgtctttctcccacggagctggcagcatggagctggctctttggtccgcccccccacatcctcgctcttcttcccaccactgtggggggaagggctgtctctggattcccattcttcctcatcacccctctcttccacagtcccatcctctggccccaccaacgtgtcggctctggccaccacctctagcagcatgctggtccgctggagcgagatcccggaggcagatcgaaatggcctcgtgctgggctacaaggtagatgctgggacccaaagtgtgtatgggggggggggcacaccatcttctctaggccctccacccaaggtgtcctgtctttgtcttccttcctctggatcactctgccgcgcagaggcacagggtatcttcctagcttcccatccaccaatcaccacagcaaccaggaaatacccccttagggataggaagttatctagggactgagtggctgacagggtctttcagactgctcccctcttccagaaggctgatctgggaacctcaagtgttaccctcagccctaagggacccagtctggtttctattatcttctagaattcttttccaaactgttctggaccatgtgaccatatgatcctagatagccatgtggtcatgtgaccgtgtggtcatgtggctatgtggtcatgtggcctagccttagcttgaaaggtgagactcataggataatgtcacatttctgtcactatccctctgcagccttaagtaagccactttcccttgtgggcctatggggacttgtaactatgcagctgagtctccccaagtgtcttagaccttccaagaaccctttggggccaagcccgtccaaagggcccagtgttcctgccccattccccatcctctcctggaggagactccagaccgaggccctcctctgtgttggcaacggcaggtgaggtacaaggagaaggactcggactcccagccccggttctggctggtagaaggcaactcatcccgcagcgcccagctcacaggcctgggcaagtatgtgctctacgaggtccaggttctggccttcacacgcatcggcgacggcagcccgagccaccctcccatcctggagcggacactagatgatggtaagcctacatccctgtgagcctagagggtctgcccctcctcctgccccacccccacagggatccccagtctcaggaggctaccaactcactgcaagaagatgctattcaaagccgataagggaaagtgggggaaaggaccaggtaaggacagttggatgtctgactcgtcctcatggtctctccctaggacaagtagacagtacaaagacttggtgttaggtttgaggttttggtttgtttgtttgtttgtttgttttggggggggtgtcctctgctttgcgcaaaatctatgagagtctaatgcgtgggcatgtgcctcttggtcctgtttgtaaagccgtgacaccagaagagctccatccactgcacaatcccccggtctcaagctgacagagatgtctctacactccattctcccacacacaggaaaatggcctaacccaccacaaacacttgcaaggcccagacaaatgcggaaggaagcaagccccggtatcatatgtctgtatattctaactataaatcaagctaatgagctgttaaattaaatatgttctatcctcctgccttgacaaatatacccacataatgacccagaaggccaagtttgagtttacacatctcatctccttgacattctgggctggaatgaagtgtcacagaaagagtgccccctccccgctgccactagatccctcatgctgtcctcatgtcacccctcacaccttcctctcatccacactagtcaggctcctgccatccaaccccacccccccaaacagcttcccctgggccatccctggagtggataaaagatggatctgggaaacaagcccactcagagtctggggcgcacccttggtccctccctgagcttctaaacacctggattgcggagccaggtgtggagagaggatccctgcaggcaggatgagcactttccaactccgtcacaggtcacagctaagcaggaggcagaagacatcacagctgggccttccaaagcgcagaccaggctgggatctggaaggccgtgggtgaagccatcattccagcacagacttaaaaacttagaacacatgtctgcccattctgagagcccaggcacaacacatgatgggcaaggaagttggagttttggggccttgctaaataactaaggcctgtttgaggggcacacgtatcctatctcaccttctaggccctgtaaaataaccctgattttgaggatagatagttttgtggtcattccctaagatgtatactacacataaattccctgaactgattaattcccgcctcgatgctcagcttggcctgagccagaacagagaaaacagcagcctcaccttcttccttctgcctcctccagtcccaggcccccccatgggcatcctgtttccagaggtgagaaccacatctgtgcggctcatctggcagcccccagcagctcccaacggcatcattctgggtaagtctgcccttcctgtgcccttcttagggaagaggaggtggcacggtgggagaaaaaaaaaaaagagtagagatgggaccagcctggaagtgtccacagcctctgaaaaatagcatctgacatgtcagccatggtgttcacacttgcaaccccagcatttgcgaggtagaggcaagatgaatagaaatgaaataaatattttttcaaaatcgcaattaaataaactcatgaatatacacaccaaaggtggcttggtctacctgtgcctctgtcttgggctagtcctggaagaatggtacagctcagaggacaaagtgacagtagacatcaagtccattggacaagaaagcaccgggctattgctttagagcagtggacatcaagcccattggacaagaaagcaccgggctattgctttagagccacaacttgctagcaggtgacttggcctctctcgtcctcatgtaaactgttgtaggggggtctaagacactatacattgaaccccttatccccaccaaagtccatattcgtcaaccataagtgtgaccagaagaatgtcacacagccaaacaggagccagggggcctgactgcgtgtgttgctgcaaccacagagatgggtcctctcacaggacactggggctgccggatctgacattgcccttcgtctttcttcccacagcctaccagatcacacaccgtctcaacgccactacagccaacaccgccacagtggaggtcctggcccccagcgcccgccagtacatggccacaggcctcaagccggagtctgtctacctattccgtatcacagcccaaacccgcaaaggctggggagaggctgctgaggccttggtggtgactacagagaagagaggtgactgcccgtggggctggggaggcctggggagctgaagagggtttctggggagctgaagagggcttctggagcccacacagggccttagcacccctcctggtgggcaactgggagaagcggtggggaacggcattgctttagtctagaaaagaaaacagactccagggttggagtcaaggtcactaagggatcatgccatgccacagagctggactggaatgtcccaggatcctaccctgttccaggtttctaaaggacaggtggggctgaggcatggcttaattgaaagagtgcttgcctgacatacatgaagccatgggttcaagtcccaaaacagcataaaccaaatttggcaatgcatgcctgtaatcctagcacttgggagtccaagcaggaagatcgggagtttgaggtcagcctcagacagcctaggatatgagggatcccgtcagaataagaataaataatactaaggaggtggttggtgatcatctccaacccctggtccccttcacatccctacccttatcccttagcctgggctagatctgggctagatcctgcagtctgagctgtcacacctcaggaccctgagcaggcacctggagagtgggttccctagatgcaagcctgaacccccagttgggttagaaaacgtccccagtttctgttagaaaacgtccccagttggggtaggtgggggaacaacacacaagacagtaagacagtgaatttcctccaagggcttctttgctcttagggaatatggatacatctgggttgccttagctagaggaagatgctccaggcactgaacaggtctcaggggaggggcagggagtgctccataaagcatcctacactcacaaagcaaccctaccacaaagaagcgtcaagtccaaggccaagaacactgaggcttggcagcctgtcatctggggtaggaaagtggctagtgaaagagggatatggggcagggagatgacggaaatgaactcccacagggaagcatggcccactcccactcagtctggcacaatgcaggacctatctccatcataagcaaaagcaaacctgtcaagtcctcctccaggggctgccgtggactctccaggcacctagggcctcggaaactgagggagggtctcacctgaatactcaaggttagctgctggcagaaaccatgcaaggcccacagacatggaagtaaaatagaggggggcggtgtctgtcccaagttcagaaccccttcgtgctgcccttgagaaagggcagcccctccaccatcaccctgctccggctactgtctcacctatcccctgccctgcctcccagaccggccgcagccccctagcaagcccgtggtacagcaggaagacgtgaaagcacgcagtgtgctgctgtcctgggaaccaggcagcgatgggctctccccagtacgctactacaccatccagacgcgcgagctgcccagcggcaggtgggcgctgcactcggcctccgtgagccacaatgcctccgccttcactgtggacaggtaaggtggggtccatacccacttatctgttcccttctctactggagacagcacctcacgtgatccttgcaggagggaggggggcttctgagagcgccttcagcctgtcacccaggacttcctcagctctttccaccggccacactcacccctttctgctctcccccggtccctgggaagcccattagggttgcctcttaattatctatggagcccggccaggcccccttagcgaagcgcttgccactcttcattagcgattctcccgacagcccgtgtcctcctcccatctttaataggagtgcaaagctcctctccaaaaccctggcctcaatctaatccctggtggttgtattttttatactcccgtcgacgtgacctggaacttgaataggccttccctctcccacccccaaccctgtaaattaagaagacattttgttgggaagaagatgagggtcatagagacaattttccttatctcgggggaatctccgcacacacccccaaaaaattccctaatgtcaggaaaaggcttgcagcttgtatacaatcgtgtggagagggaagtttggatgtcttcctggccaccagagcatgggtagacatgagcctggagatgtatggcttatcattacagtgatgtgcctcccaagcaggggtggcatggggcctgggcactcagcatctcagggcctgtcccactgtgaccccttcccaagcctccaggtttccttctggtcgtatgtcagcgctgaagtcccttcttcccaggctccccgcctcaagcaggaatggatgagaccccacagtagaggtgacagcatgggtcttgagggacaatgtgtcagtcagacttgtcatcacagtgacaaactcctggaggaagcaacttatagggggaaggatttgtctgagaacacagtcatagaggtttcagcctgaggccaactgggtctgttgctctgggccagtggagcatgtggcggaggcacacggtacccaggaaacagacctggaggaagggcttgaggacgtaagatgcgtgcgcatgtcccagtgatgtgcttccttgaccaaggccgcacttcctgaaatttcagtttctcaaaacgatctaacccattgggacccaagtcttcaacgacctgtcgggggattcgttcatactcaaatcacagttgacaccttggtcattggtccccaactccctccctccctccacagactcaaaccctttacgtcctacaagttccgagtgaaggcgaccaacgacatcggcgacagcgagttcagcgaggaatcggagtcgctgaccaccctgcaggccggtcagtgccatctccctgcttgggcttcttgctcctgaccctgcttgctccctgggtacaaaaggctcttctgtgggagggacccctgtcggtgagagatggctcactaggcctgctaggcctgtctacctccaggccagaatgcccagaggtttgggacaaaagagactttgaccagagctcggggtcctaaatcctgcctagaatttgggtgcatttcttctccgatggtcctccagctagcgggaagtgggagcagatgctcactctggcactgcatcaaacagccacctaagtcctatggctttaagaaacccttaagaccctaggtttgggctgagaggcttccagctcaccctggctgttgtgaggaaaactgtgtggatgggtctccagggtaacttcagcaggacccgcctagacaaccaatgtcagcagaatctggtccctgtgggtttctgggtggtgctgacactccaggccccagagcctagtcctctgcctccctccacagccccagacgaggcacctaccatcctgtcagtgactccacacaccaccacctctgtgctaatccgatggcaggtaaggctaggtcgacaaggtgggttcattccagaaaaactcttggctgggaccagaaaaatctaccagtccccgccagggctgcctcagcctcttttctatacccccagagcacagggaaaggcagaggatgggggcgggacatcaaggcgtatgcatgtcacagagcatgaccatgagtcacagagtccaagtgacaggattagtttcatgaccccagacatgttgaatctgtatgcagagaagcacacggggactctgaggattccccaaggcttcgtaaagcccagacctggaggtcagtaacaggcttcccaacagcaacctgtgaccttcctcatgagcagcatccccttgtgtgtgttagtctctcccagctgcctgctcttcagagagtaatgtttgttctgccagggtccgagacaacctcagctatcacgctgaccatccattctctggagcgcaaccttgggctcagcaggtcagccacagaaacccctacataggtaggggctagctagctcctgaccctacttctcaggatctgaggaactgggcccagtagcgatccttgtgcagctgaggcctgggaccccagaggggacatccccctaagtggaaatgacctagcaacctctcctgagccagaggaggctggagccaatgggacacctgggcaaaagggccaggcgatacccatggcagccagggaagcaattaaggagccaataaaaaggctgatccatttcaacagatgtctcaaaggagggtcatcaagaaaacagtttctacttggcaaaaagcccgtcctccagctcagccgaggacagaaagcaaaggaggaaagagaggccatatctatgtgcatgcttatgctagtgtaggccaggggctcagctcataggagacaccaggatgtccaccaagtggtcatcagacagcagcagccccagggaggccagaagtgggtcacgggggttctggacgagcaatggctggtgattccaggggcgtgttttcaggtcttatttctgccatgtgaccatgggcatgcaccttcatgtgtctgagtaggtctcctgctctgctgaagggggcttgcatggtgatccctgtccttccccccacccccaaagagaccataacaacctatgcccacccctatccccattgttttcctggttgggacccagcacctgccctgtggctgcaggaggcatgatggacagagctggggtggagtgaggtgagccatagtcaaggcccctccccatgtttgaccctcccgtagcctccatctgaggacaagatcaacggcatcctcttgggcttccggatccggtaccgggagctgctctacgatgggctgaggggcttcactcttcgaggcatcaacaaccctggggccaagtgggctgagctcacctgtgagtagcacttccgggaccttagggagggtgggggtaggcattctcaccttccccatcgatctgctgctcccagtctccttgagtctgctaacccacaaccctgcctccctcccctcgtgttcctcttcttacccattcattcacttgctaagcgttcgtttattgagcaccttctatatgctccaagacactctgggcacagcagtagttaaacagacaggtccctgatctcttggatcagtctgatggaagaagaaccaggcattcaataagtaagccctgaggtagatgtcaatggtcatcgacatgacagggggagaatgttccagataaaaagtgacaaaaaacattcttgacatgggaggatgattgcaggttaggcaggtgaatgtgtggagggaggaaccagcagcctcaacatctagacccctatcaagaacaacagtcaagacgacccctcctattccctgggaagtcacttcccagacgtagggccaaagaagccaatcttgaagtatagaagaagcagagaaaagggagagatttaggggaaatcccagggagagagaatgctgagaaagccgtgagcaagaggagggtgtgagtggaatttgtagatcattcggggagcacggaggatgctggggaagccgtgagcaagaggagggtgtgagtggacttcataggatactcagggagcacagaggtggtgccccagccacgggagaggtgacagggagagaagcaaggaggctgtggtgttaacatagcaaaagagcatgagactgagccaaggaagcaggctaggtgtgccatgagtgtgtaatccacagggctcctcgtctgttccgggaagggagagggaggcaggcaggaaagaggaggccttgtagaggattaggaagggagctacactgttcacaaaagaggagttagcaggagagaggagatggcctaggtccccatgggctgtgctgccccatcccacatctcccaagcttaggcagccatcgcttccaggggtgagcacggacaaaatgactgagcaccgagcaagggacatgaagcgaatgagaccggcagaaacacccgacctaatagctcatgttattttcttatatttatttatttatttcggccaatgtctgcccgtggctgtgattttttttttatatgatctgcgtctgattcactcatatttcttggcaataaaattgtttctggttcatatgagggaattcacgatgccaatatttcaccgtggtttgcccaaactccggagtgaaaccagggagccagtgggatgaaagcggccccccagagctgccctcggggttgctaggctctgagaggctcccccatggccttggtcagtgtccaccgaggtagggacagcaatggtttaagatcttccccctccccatgtccaccccgactaagcactaggaatggttaacagccctgtctgctctgtcacagcctcatcattccatcccaggcctggttggttcccagtgggtggggtgcctgcacacactaacctctctctgctgtctccctggcttctcaccccctgcccctcagccttgtactccatgcggaacctgacccggcccagcctcacgcagtacgagctggacagtaagtccccttgcatgggtggtccatcatggccccaggcctcctgggatgggctggggaggggggggtcgccaagaacacctggccccaggccagcacactgtactagttttctttctgttgccctggtaaagaccaggatgaaaagcgacttgaatgggggaaaggatttgttaggcttacacgtctcagtcaatagtccatcactgagggaagccacacagtggtaactcaaggtaggaactgaagcagaagccacagaggaacaattcttatcggattgctaccctagcctgctcagcctgctcgcttataccacccagggctacctgcccagggatggcaccacccacaaagtggctgggccttcccacattaatcaagaaaattcccctccagagacataatctcaactgaggtctcctcctctcagatgactctagctttgtaagctgacaaaaacctagccagcctacccacccagggtgcttgaggactgcctctaacacatacatcttttaagcacatgaagcaagaggcattttggaagagagtcccccaggcctatcctataagtgcttgagtaggaacgtgtatagacttgcatgcatgaggagacagtgggtcaacagtaggaggtaaagcagaagagagaagcttgcccacatgctttatacaaggcaggtaggtgggcgtctattgctactgcccagtttgacccatgtaagacatgttggccctaactgtctctctagccccatctgaggctcctggatggaatatgtcaaccccccagcctgtcctcttgtggctcccctctgcccctggctgtttctgaagtcttggcaggttctgcccacatccacccaaggaaagccaacctcaggaactagactgccctcttctcctcctcagcctgagcctacgcatgtcagaactgccaccctggggaacaagggaaatagagagacagggacaatagagttcaggggatagggggacatattggcactgtgggaagggatcacgtctcccaccaaaggtggcaaagctccatttgcttgcagtggcttctcctcaccggcatccccaccaagcacttcaaacttgactaacacgtgggatttcttcaccccaaattcacattccataaacacgtcccctcttggactgagctagtggggctgaaggggttggcggtggcacacaacccaatagcaaggcttgttctccaccttggagagagcacaggattccatccctagccccaaaagagaaagggaaaaaagagctagtgaagggggacagatggggacacagcagggacatgacggaaatggattgcgtctgtcatagtgggaagggtacaggcaaggaaggtttgaccctctggcccagggtggccaggattattgacagtctcaacaccactgacttgaagattcaattgtattgatgaccctagagcagacggagactttgtgtcccgggcctgctttgcatcccataggcgcattggcagggtgcagcctaagcatctaaggctttccacttgtttcctccctgttgtcacgtggggggcaagaatggtagctatgcctccttcccccggctcccccgtagctccagcttccctggaggactccttccaccagctctgtgacctctgtgttcctgacccccactctcccccatagatctgagcaagcacaggcgttacgagatccgaatgagcatatacaacgccgtgggtgagggacccttgagcccgccgcaagaggtctttgttggggaggcaggtgagtttgagtcccagatacaggatccagggcccccatcttgccctagcccacctccccttccatagctgagacccatgaacactcactctccaacctctgtgccctccagtgcccacggcagcaccgcagaacgtggccatccacagtgccacagccacacagctggatgtgacctgggagccaccccctttggacaaccagaatggagacatccaaggatacaaggtatgtgtgacctggcagaggaatgaatggtgagcagaggagtcaaggggtggggagggctgggtgagtgggatgggtgccactgtacacctgtggcctgggctatgtgcacagctggcagaaatatttctgtggcattgtagaatatttccattctgaggtgggttgaacttgatcagaggaactcagaccctacctaggcttattctgctttaatgcacacaatgcccaaacctgtcacctccagccccacagtcacataagatgctccattggtagagtatttgcataaaccagatgtggaggtttatatagtcccggtcctccagtggtggaggcaggagaattggagttcagggtcatcttgggctttatagcaagttcaaggccagcctaggctacaggagaccctgtctcagaaaaaaaaaaaaaaatctatgaggttcttggcccatctttaattagaagaccaatttgcaaagtaccttggcagtctttgaaaatctgctttgaaactcttccagcctgatgaaagcccacaaagctgttacattgttacattgtgggtaccagtgcccacaaaatgtgcccattatatgaggaaactgtagcccaactgatatagtctgggcaggtcacaacctatcgggtgttagaatccagaagcccaaatcacccttgccaggaagcagagcacgtggtcagatcctggaggaggcggtgtgtggaagagttaagagccgattggcctccctcgttggagcacgcagcccttggctgtagcgaaagcttgcgtccctcaccaacatctggaatactctggttcctgatatttggatggtatttcagaaaactgtctccacgcaatggccctggggacacaggctatgcaaaccaaagaaccccatggttttcctggcccaacccatccataggtggcaatgagtgtgtgcccgggtgaaacactcgctctgccactcagcctgtggaggcaggccacccggtacaaggcacaatccagcataggaacctcttccatccagaatggaggagggggagaaacggggagggaggcatcttgtcaaggatgctctgaagatggatggtacccctccaagcttcgctcaggagcgccagctgggaaaaccaaatattgcactcacagcatacgcctctggagaggaaggaggcgccaggcagagccagccaccgtgtggaagccactagactgttgaagtggtgcgttaacacagagattcaggaaatgtgtgggtacccaggtaccatatagaacacagaggatgtctacagttcccagaaaacattgcccatccctgggtgtgaaccacagggatggaactgccacatcctggatgcgtgctaaccagcgctgagccatcagcccccgttgacagggcctggtgtgtttccatcagcatctgggctgcaggtgacactcagctggcagagtgcttacctggtgtgtgtgaaatcctgggggttctgtccccagcaccgtatatccagctgtgatggtgcatacctgtaacacctgtaaccccagcactcaggaggtggaggcaaaagcctcacacatcctttgctacctagcaagttcaaagccagactgggctacatagatccttggaagaaaaacaagaagaggaggaggagggagaggaagaggagaaaaaggaggagggagaggaggagaaaaggaagaaaagaagaaaggaggaggaagaagaggaagaagaaagaaggaggaggaagaagaagaagaggaggaagaaggaagaagtaatagtagtagtggtggtggtggtggtggtgatggagctggtagattctgacagaggaccatggcctgagggaagaccaggaaacatgagcagtgtcatggccaggggagcttggggaagatggaaacttcagtcacagggaaggcaaaggaggagggggctggagagacctggagtctggctccctgtgtttccaaaacatctacagttgagcagtggcttcacacacctttaatccaatcactcgaggccagcttggtctacagagtgagttccagggcagccaaggaaacacagagaaaccctgtctctattgaggaaaaaaaatctggcagccaccaagagagacaatgaagctgtagttacaagtggggcttaagagaacagctccaaaccagagaaagcactggactggaagagcctacacagacacagatggcaaacaaaagaagacctgaccctgagccctggggcaagagcctggtgatggctcagagcacaagggagaaactgagacagagcaagtgcagcccagggagcagctattgggctgttaagagagaactacaacccagctgttctgcagctcttgattggctttttctgagatgttggaaggggctggagatggagctaagttgattggacccaaagccctagggtccaacctgcagcaccacagaaaccagaatggggtatgtacgtacctgtaatgctaggactagggagacagagacaggaagatcggaagttctgcatcatccttggttacatagtgactttgaagatagcctgggctatgtgaaatcctatctaggaaaaaaaaaaaaggatgctggaattacaacagattattcactttaacaggattggccaactatagccaacaggccagatttagcccactgtctttgcataagtattcttttcttgggatatagccatgcctatatgtttacaaattgccatggcaacatttgtataagaaagtgatgaacaaggacagccagggctatacagagaaaccctgtctcaaaaaaaaaaaaaaaaaagtgatgaacagacttctatagttgcaacagagacctacaaaacctaaaactttggtcatctagtcctctacagacaaaaatatagtcagtgtggccttaaagagagccaacagagccttggtgacacacatcattaatcccagcactcaggaagcagaggtaggcagatctctgtgagtttgaggccaccctggtctacatggtgagttctgggccagccaggaatacagggtttcaaattttaattaataaatttaaaagtaaactatttggtcatatattatgatgtatgcctgtaatccaagtacagaaagaaagtaggggtgagacaggagaattataaattcaaggtcagctagtgctacatcgtcttcaaagtggatgagtgaacgggtggatggatggatgaatgaatgaatgaatgaatgaatgaataatgaataaaagagagccaccaaagtactgagggaaagaggagctgagagttatgagttcaaggctagccaagctacaaagtctcaaaaatgaatggatgggtggatgatggatggattgatggatggttggatggatggaggatgggtgggtgggtggatggatggatggataggtgagtgagtggataggcagatagatggatgaagagccactggcccaggcatggcagcatatacccatcattcgagctggaatggaaagcagggttgaggcaggagcattgtaggctcatagctaattttgtctacttatcaaaattcttgcccaaaaataacaagggtgaagctggagagatggctccctagttaagatcacttgcttcgtttctcaacacccacagctggctgggacttcagctccctgaactctgacaccttcttctgaccctgcactcatgtgcacagtggcacacggacagggacactcacacacacacacacacacacacacacacacacacgcatgcatgtgtgtacacataactaaaaattttaaatataataaaaacaagggctataacttgattgtggcaaaacacacccataataccagttttctgaaggtggaggcagggggatcaagagctcaaagtcctcctcaaccacatagctagttccaggctgcatgagactgtgtcagtaactaaaacaaacaagggctgagaaagtgactaaaccagagaacagctgtttatcatgcacaaggccacgggttccattccagagttgcctccctcccccaacaacaacaaactggcattgccatgatagcagtgaagtccctcacggtcccaggcaggcgggcgggcgggcggattcctcctgcagggatcacagctatgggagggaaacattgggccagcgtgaccgtgagtcattgccctgttgtagttccctagatgcatgtgctgtggtgacctcttacgtagccctcccatagcttcaggtgttcatagcagtctaaaggctgtggaattcacaggaggaggacgcaggtccacgtgcctctaagtggcaagacttccctgctttgaaagcaaaatttgaaatccattgtaaatgcacaaatgctggctgttcatcatctcacccactgacataatgagaaggggttgtttgtttctttgtttgttttttgagacagggtcttacattagctcagcatggttttaaactagctatgtccccaagggtgaccttgaacttgtgaccgtcagcctccaagtgcggggtgacaggtgtgcaatagagtgcctggattttctacatcttggcttttgtggctcttactacggcgtaacatgggagtgtaaatatcttcttcaaaatcctgattttaatacttttggatacattcccagaaatgagattgctggatcatatggtaattctatttttaattttctttgaagaactccagactgtttcccacagtaactatgccattttacatttccaatgatggcacaggaggcttctagcttctcaccagagggctggctatcttcttcttcttttttatttttcaagagttatttatttttttatttattttatgtatatgagtatactgtagctttcttgagacacaccagaagagggcatcaaatcccattacagatgattgtgagccaccatgtgcttgctgggatttgaactcaggagtggaagagcagtcagtgctcttatcagctaagccatctctccaggcccagggctggttatcttttgatactttaataacagccactgctgtagatgccatattttgagtcagggtttcatataacccagactagtcttgaattcactgtgtcactaagaatgacatttaacccctagtcctcttgcttccattacccaaatgctgggattacaggtgtgtgtcctggtgcgtggctggtcatggtggcatggactcgaatctccacccaattcatgtttggtagtgcctcctgacttcccaggttcctgctacccatttatttgtctgctcttggggacggtctgtttgttttcttgtctcaaagctatatgaacccagaagacattgtgttatgtgaaatgagccaaccaccaggaagccaccaggaagactgactggtctgcatgacctcactcacacatgacctgactcatcaaagtccctaggatagtaataataggatagaatagtccaagtcgggctggagaaatggctcagggtttaagagcactgactgctcttccataggtcctgagttcaattcccagcaaccacatggtggctcacaaccatctgtaatgggacccacccaatggatctcattaatataaataaataaatataaattaaataaataattcttaaaaaacaaaaacaaagactagtccaagtcacaaaatcgggaagaagaaggtggtcgccagatttgggagggactggagagatgctggtcatatggcaaacatttcaagccaggcatggttgcacacacctttactcccagccctcggaagacaggtacaggtgggtctccatgaattcaagccaaccagagctacatacagagaccctgtctcaaaaatgaaagtggaaaaacatgggcacttagaagctgaggcagggccacagagtgagtcccgggccttcctgaggaagagtgagcctatgccaaagaaacaaaaataacccccagccaaaagaggtccaggcgtggaaggatgaacccgtccctggagctaacctgcaggatgctagccatgcccaataaaactgtagtgtgtagctgaaacacgtatgctgacccttgctcttaaaggttcttactgtgcatcaaaaaaggtaactgtaggtcagggatttagcacaattagaagcattcgcttaaaggcttcggttctgattgtaatcctgcagttttctaggaatcgcagcacagatgcccagtacaggaaaggggcaatccctgagccaggatcaaggcacagcggctcctgcttctgctctctcagcgattattcctacctacacacacacaaacacacacacatcacacacactcacacacacacactcacacactcacacacacacactcacacacatacacacacacacacaccacacactcacactcacacacactcacacacatacacacacacacacacaccacctcctgatttatccagcaagggcagcgggtagagtttattaaggactttcttgagttgtaaccaacaagatataaatactaatgctaaggcttaattaagactcttcttagggggctggtgagatggctcagcgggtaagagcacccgaccgctcttctgaaggtcctgagttcaaatcccagcaaccacatggtgactcacaaccatccgtaaggagatctgactccctcttctggagtgtctgaagacagctacagtgttcttagataagcccatacccaaatagataggcttttcttattctttctcaatcatttggttctctcattacaatcatttctgaatcactgttctcaaaatctgttaataaattgtgatttttatgaaaagtcaaaaaaaaaaaaaaaaaagaggtgaccattggaagtaacaggtgccaatcagcttggcttgacagtgggcccagtggatgggtatgaaaacatcagagggcttggggtagggctcagctgggagagtggctagcattcatgattcctggggtttgaccctctgcaggcataaagcaacaggcgtaggggcctctacctgtaatcccagcacttaggaggtagaggcaggagggtcagctccaggttgcccttagtcactttgtaaaatcaagggcggctgggctatgtaagtcctgcttccaaaaaagggtaagtaaataataataacaacaggttggnnnnnnnnnnnnnnnnnnnnattattcctacctacacacacacacacacacacacacacacacaccacacacactcacacacactcacacacatatacacacacactctcacacatacactcacacacactcacacacatacacactcacacacgcacacactcacacacatacacacgcacacacacaccacacacactcactcacacacatacacacacacacacaccacactcacacacatacacatacacacacacacacacacacactcacacacacacacacacactcacacacacacacacacactcacacacacacaccacctcctgatttatccagcaagggcagcaggtagagtttattaaggactctcttgagttgtaaccaacaagatataaatactaatgctaaggcttaattaagactcttcttagggggctggtgagatggctcagcgggtaagagcacccgactgctcttctgaaggtcctgagttcaaatcccagcaaccacatggtgactcacaaccatccgtaaggagatctgactccctcttctggagtgtctgaagacagctacagtgttcttagataagcccatacccaaatagataggcttttcttattctttctcaatcatttggttctctcattacaatcatttctgaatcactgttctcaaaatctgttaataaattgtgatttttatgaaaagtcaaaaaaaaaaaagaggtgaccattggaagtaacaggtgccaatcagcttggcttgacagtgggcccagtggatgggtataaaaacatcagagggcttggggtagggctcagctgggagagtggctagcattcatgattcctggggtttgaccctctgcaggcataaagcaacaggtgtaggggcctctacctgtaatcccagcacttaggaggtagaggcaggagggtcagctccaggttgcccttagtcactttgtaaaatcaagggcggctgggctatgtaagtcctgcttccaaaaaagggtaaataaataataataacaacaggttggccagagagaggtgcagtgctgatcaagtgcttctgagcgtgcttaaggccctaggctctgtttctagcactataagcaacgagagagagagagagagagagagagagagagagagagagagagagaaagaggggctggagagatgtctcagcagttaagagcactgactgctcttccataggtcctgagttcaattcccagaaaccacatggtggnnnnnnnnnnnnnnnnnnnnattcatgattcctggggtttgaccctctgcaggcataaagcaacaggcgtaggggcctctacctgtaatcccagcacttaggaggtagaggcaggagggtcagctccaggttgcccttagtcactttgtaaaatcaagggcggctgggctatgtaagtcctgcttccaaaaaagggtaagtaaataataataacaacaggttggccagagagaggtgcagtgctgatcaagtgcttctgagcgtgcttaaggccctgggctctgtttctagcactataagcaacgagagagagagagagagagagagagagagagagagagagagagagagagagagagagagagaagaggggctggagagatgtctcagcagttaagagcactgactgctcttccagaggtcctgagttcaattcccagcaaccacatggtggctcacaaccatctgtaatgggacctgttgccctcttctgggatgtggatagcaacagtatactcacattcacaaaataaataaataaatcctaaaaaaaaaatcctccttcccttccctcactccctttctcacaacagtctcgggtttggcttagagattgttgtcctctagcagtaatcaataaatctttttttaaaaagaaaaaagaaaggaaagaagagagaaaaaagaacattaattatatatcttaattctattaaattttcgtcaactatacgtcagaaaagtgattaaaggggaaacgggctgggaataaaaaccaagagttaagaaatggggtcaggggctggtgagatggctcagtgggtaagagcaccctactgctcttctagactgctcttccgaaggtccagagttcaaatcccagcaaccacatggtggctcacaaccatccataacaagatctgactcccgggctggagagatggctctgtggttaagagcactgactgctcttccagaggtcctgagttcaattcccagcaaccacatggtggctcacaaccatctgcaatggggtccgatgccctcttctggtgtctgaagacagctacagtgtacttacatataaataaataaatcttaaaaaaaaaaaaaaaaaaagaaatggggtcagcgtcatctgctgccgctccagccacttccccccatgacatgtctgttggcctatgtatcaaccatgagtgaggtgtctgggacacaaaggagccagatgggccagggtgcctgccctctggagcccatagcctgggttcagtacatactcacttccccatgagtgggtgctctaccaatcaatcatgtcaccttggggaccaggatccagcctcagcccttgtcccttttactgtgtatcctcatctaacaaaggtctactgacagcaagcaggcagcctgcttctgtatgtcctacaccttggcactgccctgcccaatgccctccccagccattgaccctgtctccccaacaacaccaagtatctccctctaggaccagtcataggcaggccataaaggcattctgaaatttgtttcttcttttgttcattacttagtattttcatatgtttatgtgcttgtctgcatgagttcatgtgcaccacagggacccaaggaggccagaagagggcatcagatctcctagaactagacacataggagcttctaagccactagatgggtgctgggaaccaaacccaggtcttcttcaagagcagtcagtgctcttaaccactgagccacctctccagtcccttatttcctcttttaaaaaaaattatttatttatttattttatgtgcactggtgttttgtccacatcttgtgtatatcttgtgtgagggtgtgtcagatcttggagttatagacagttgtgagaacccgggtcccctgcaagaacagtcggcgctcttgaccactgagccatctccccagccccttgtctccgttcctaatgccctttcctgacctcgcggttttgttcacatctcattatgtccttgttgggtctctttgctggaggattcattcaaaggcttctcccatgatacagggacatcgctaaacgataaagtgcttgctgaccagtttgctgtgctctggtgagacacgggcacgagacagtctacatagaactcaggctccatcttcagcggagggagagagaccctccagcagagggcaggaagaagggaagagcagggaagaaggaaaccaaagacaatctcccatagtctctgccccgctcaagctgactctctactctcttttccaaacccaaccccaagtacgttctcatcttcaccgttcctccaaatctcacactgctaaggctgctgataaatctgccctgttcttcatcaaccggtcacaagcttcgcccagcctgtctccacagcaccgtgcctcacccagttgagacatgacattcccctgcctgtttctcctcacacagccgtcacccctcctcggcctcccctaccgttccagctacccctgcatttccacagaggccctggaaacccctctatccctctcctcaggccaggagaatccaacagttctctgactgtcttcgccaagctgctgatgctcagggcgtgtgcagagctgtagagctagccttgagctcttccccaaacgatgaatccaggagactgctttgtggctgttgcgttctcatagtcagtggatgcgtgggtgattttatgaatggagacctcaattccccgtataaaaagatttttttaaatggaagcaaggcagtagagaagcaaatcttttgtagtaacaagatgtcctgactgcctctgcacacgctgggggtggacacttttattagctctttcctacttttattggtatggaggaaaggaaactccaatagcgttcagaaccctctctggccagcagagggagccaaatgatcgtcaatcctgtacagggtttgggatgccaggctgtatgtagcagaatcccagctcttaatgtagtttgagagtctttgatgcgtgtttaaaagcactaaccatgctcattatagagtgcccggaggctccacgaagctcctgctgcactgaggacttaaaatcctccacaagcgtgtaacaatacccttagaagctggccagtccttacggcctgcagccttcttgctcgccccggaaagcgggtgtccttaagccctctgcagctgaccaagtcacaggcctagcaaatggtgccatcaagagttgagccacgaaccgaatgccacctctgtccagcctgcatcagacttttcagactttgatccacgattatcagattggattgcgcatatgcaccgccaggaactttatttacagcgggagctttttacaggggccttagcagctgaggctgcctatgtggcacacggggcagagctgaggctcctcaccagtgccctggcattgccaagctgctagcccttgtgccccacacagtggagcagagcccatgattgctcccgcctctccagctcaggctggtgagatgcaggttcctattgaggctgacacgcctgttacatgggacagatgccaaccccagagacacaagatacacaggggatgacgcttacagacgatcggagggtcggtattgactacaaagtgaaaagttcccgaatccttcttaaatagctcttagctacttccatattgtttcctggttgaaagcaggggtgtctttgaacccccgagatgggcaggggcggaggggaggcctgatgtcttcgtccctctcatcccacaatctttggttcccacagatttatttctgggaagtccaacggaggaacctcacagagagggtgaagactctcttcttggctgagaacagcgtgaaactcaagaacctgacgggctacacagcctacatggtcagcgtggcagccttcaatgctgcgggggatgggccgaggagcaccccgacccggggccagactcagcaagcaggtagggagaagtctcttggggaggtcagggtttgggggacaaactggtgtccacgtctggtgtcggagctttcacgcagccggggaactgggttcggatacccaggccccacttccagatgccctgtggaaagaaaagcccagcctgcaaagaaggctctatgtgtccataaaaaaaagaaaagaaaagaaagaaaaaaagaaactctcactgggaaccttgagaaagtccccagatctcacctagcctgttctgcccaccttgtctcagcttttgggacagccgccactccccgcccctgtttggctttctcctcctttcttgtctccttgcctttgctcagcacaccccgcgttcattgtcttctgtgagcccacacttttgcttcacactggtgatgaaacaatgattttttttttaaaagtaagtctgtgtcctgctgaggccaggggacaggacataaacaagcacagcacagatgagctggctggggggtagggggagctaaggggagcagggtgtggttcacaagatggctggctacacctgagctgagctttgagccagaggagaccagctgtgggaagttctggagacaagcaggaagccggaagcaggattcctgtcagaaggaccagcaggtgcagaggccaggaggctggaggggattcgagggacagaccccggtgttgacaagagaggtggagtgaggcccgattcccaagggtctggagaacaggatttgtgttgagtgtgatggggagactcagagggttggagcggttaagaattagaactctgcctcagtggttaagagtactggctgagctgggcagtggtggaacacacctttaatcccagtactcaggaggcagaggcaggcagatttctgaggctagcctggtctacagagtgagttccaggacagccagggctatacagagaaaccttgtctcaaaaaaaaaaaaaaaaaaaaaaaagcactggctcttaaaaacccggggttcaattcccagcacccacgtgacagctcgtaactgcctgctactccagtttcaggggacctgatactctcacacaggcatgcaggcaagcaaaaacaccaatgaacatgaaataaaaataaccaaataaaattttcaaaagggcggatttctgagttcgaggccagcctggtctacaaagtgagttccaggacagccaggactataaaaagaaaccctgtctcaaaaaaccgaaagaaagaaagaaagaaagaaagaaagaaagaaagaaagaaagaaagaaagaaagaaagaaagaaagagaaaggaagaaagaaagaaagaaagaaagaaagaaagaaagaaagaaagaaagaaagaaagaaagaaagaaagaaagggaaagggaaagggaaagggaaaaagaaataaaaagaaaaactggctctgccttctgggctgagtctggaggagatgacagagagaggtggggactagatccaggcaggatggaggaaggagagaggggacagatccccttgtcctgaggtgtccaaagccactttttggtcagtgtcacactggattcccctagaattcccagggagtaagcagtgtagtgtctgtctaacaacaggggttagagtcaccccagaaaataggctttttgctcctgatcccctggtaaggtcataggggaaagggcagatgctggaaccaaggcagatctgagatctgagagaattcaggatctctctctctctctctctctctctcttcccccgtgtgtcaaccctcaaagccatgaatttcatatctgcagtttcaaccaaccaagaaaggaaaatattccccaaaattgcgtctgtctgggtgcagcagcacagaccttaagaggtgaagccaggaatgggcaagagccagggctcagagatggctcagcattgctgttcttccaagagactgagttccattcccagaacctacattaagtgtctcacaaccacctcgagcctcaattccaggggacccaaccccctttgtgctggcctccatgggcatgggcgctggtgtgacacacacacagagacacacatgcacataaatgaaaagaaaagtaagcctttaaagtcgatcagagccacctttagctacacagcaagttcgagactgccctgagctaagggagaatgcctcaaaaggcaaataagcaagtgaaaatgtatctatgctgaagacagacagcaccaaataacaaatgtgtctttactgagcatgtacaaacagcaccgagtagcaactacttagtaaatagatacagtactatttgcaatgtgtcaggaatggaaagtaacctagaaatgagttaatgtatatgggaagttctagatgatatctcagtggtacctcacttgcctagcctgagagagatgccctgggtttaattcccaacgccacagataagggaggagtgggtacatagaaggatgtctgtagctctttgccaaacaaaatggcattttatatgaaacaagcatcctccgatttttttttttttttttttttttttgagacagggtttctttgtgtagccctggctgtcctggaactcactttgtagaccaggctatcctcgaactcagaaatccgcctgcctctgcctcccaagtgctaggattaaaggcgtgcgccaccacacctggcttcatcctccgatttttgttagaacaaatcgcccgttagtatagccttctgccctggcctccagaaggtggctttttccagcctgatactttccttatgtggcccccactagtcttcagttgctgcagaagcgggatcctctctgggacaagatcccactccagggcagcctttccctctcctggctccccgggtcagccagaggctgagcttgggtgtgctagcctgtccgtctgcctgcctgcctggccatctcaactacacttcatcagtgtcaccggtcagacatgagcgcccccaccccacccccaggagcctagaagcttccggtcctgtagcataggacagaatgtcctgtcccacgtccttctaaccccctagtgtgttgagggggagggcaggaaagggccctgagttcacctccctccttcaaagacagcgggggagatgggccggaagctgtcaagattagttctggcctggtgggaggcagcactggacaataatagcctgaccatccacccaaccagattgggatgctgggggggtgggggtgcttcctgtcttgcctctttgccctcccatttcccagcacccccccacacacacacacaccagaatcttccatccttgtgttttcagagttaccccaggggtcctagaacaagaaaacatctcttccagaggctctggctgtcctctggtctggctcctgctgacagcttaatgtctctatgcaagccctgccacccagggatgaaaggcacgccatgtctccggagttctgacatctcctttagtgcccactctgtatctcaaggcaccccaaccccactctaccgggatgctgaaaaacacaccccacggtgacaagaaatggtcttgcccccatagtgaccctcaggggtcatccgttgtaatgcagtggctggtcccatgctactagccagggctcagagccacctaggagtgagtccagattctccatctttaaggaggtctttctccccatgccagagcctctgctcttcttagctgagagctagtgacggcaagggaggaggagattttgagggccttagctgacccttcctgccttcttcttgtgcctagcctcactctctcttcttcccgggcatggacccaagagctcctgctagttgcttagagcccaacctgaagctttgcacttccacagaaagaggaaaacaaaaaaccctttgctctctctccacagcccccagtgccccgggctcggtcaagttcagcgagctgaccactacctcagtgaatgtgtcctgggatgccccacagttccccaacggtcctctggagggctacaggctggtgtacgaaccctgcaccccagtggatggtaagcgggggcgtcttccatgtggcctgaactctctcccctttcaagggctggtttgtacccacagaccacaccgggatcactcgtcagcagtcagatgtggtgagaatcctcctgtcttataaatggggaaatatgacccaggaattggggtgtttctgagagataagcatgtgagagcaaagtcgcagcagcatcacagggccgcagtctcctgtgcaggccaggaacctggaacataaacaccctgttccacaaaccgaatcaggactagagagagaggggatccaagcaaaacatggttgccccaagaatggacagaaccccaaagaaaagagtcctctggtgttctcatgttatcccgggccccttccaaacctcagagttctcagcacaccccctctggagggtcagggacccttttagaaatctaatcaaagcctgggagcgtctcccccaggaagatgtgtgacagtgagcagctaccacactctgcaaatgactgtcctagcccaggtcaaatgcactgtcttcagatcactctctccctctccacccctgcccttcccaggccccccacccagaccctctgccatggggctctcaggagggcttggaccggcagcgctgcctgctggcatcaggtaactgccagctttcttacacagcagctttctcaccctgcagctacattaagagaactcacaggcaagaaaggggctgggcttctcaatggctgggactacttacaacaagacatagggagaagactgccctagaagtgacaccctggtggcaggaagtgaccacttttgtacatgtgcatgctctctctctctctctctctctctctctctctctctcacacgcacacacacacacacacctcctagcactggagcctggtaagaacaagggacaaagcttgggaacattaggcagctccagttatgggtcagggatggggacaatgatcctcagtttttcttgccaccacctaggtgccagccgcccatcctgcagagccgggctgtgtcacaaccaaaggggaggcaggtcctggaaagagatacaggaaggaacagaactaggtcagaggacaagaagacaagatgcagggaacctagacaggctcttgtctaagtggtttcttactggcctatccagagacctcccactttgagaaacagagttcttggcctctcaagatcttcgtccatcagggtctaaactccatgtccttataggttcctgagtcagggtgtccatttagaaatgccacagctctgcagcaggccagcagccccccattttcttatagagaaagccaaggtctaggccaggatggcatctgctcagcaaagaggactcattcagtaagtgaaagggctagagctgaggctccattggcacagtggttgcctggcattcacagagtcctgggtaccatcctcagcaccacgtaagttagccatggtgactcacatccacaattccagctctcaggaggtataggcagggagacaggagttcagggaagttcgagaccaatttgcatcaccagagaccctgtctcaaaaataaatatggcatagagagaacacctagcagtttagggtcctggctactgtcacaaagggccaattcctaagcacccgcatggcagctcacaactgtacataactccagttttaggcaattcaatacctctttggcttccttgagcaccaggcatgcaagtggtatccaggcatacatgtgagcagaatgtcccctgctccactctgctccctccggggcttgatgctggatcattagcatctaaggaaaagaaacagtgtcaggcaggggtggcgcacgcctttagtcctaacacctcggcagccagaggcatggagatctctgtcaaagaaagaaagaaagaaagaaagaaagaaagaaagaaagaaagagagagagagagagagagagagagagagagagaaaggaaggaaggaaggaaggaaggaaggaaggaaggaaggaattaagaaattaaatacataaataaataaatttaataaagtacctactatgtgtttggtgcactctccttttatgtgaagttccatttcccatttccttattaggaatgctcctgaccctctgggcttgttggaagaataaactgaaatcatatatatatatatatatataaatatatataatatacaaatataatatttatatgtttatattatatatttatttatatttttctccagctttaagggaattcatacacacacacaagcttaagggctatagcaggttctgaggtgaccttctataagagaacaaaacctggtcctgactctcagggagactttagggttaggaaagtgcagagcgcacagaaccaccttgtggaagcccccaatcctgcccctggctgccatgaccttagctgctgaagcttcaaccctaaaagccacatggttacagatgatggggcccctggagctgggctctcattggccaagaagagaacaaaggtgggactggggtggggctggggctagggctggggtggggttagaatagtcaccgggtgctatccagctccaatgctggaggcatcttcaagaacgtcccaacaccagctgcctaaatgtcacgttctgtgatatgttggcttgggatgggctgacgggtagtctagcagtgagacaggatggagactttgtggctgttccgggatgcacagacaggacatagctttcctccgggtactttaaccatggagtgttttttttttcctgagctcttttcagagccatgttcctgacacagtgttggcagcctgtgggcttgagtgacagctcggctgattccaagagatggaggccacaaccgtcacctcctcccaggagctgccagtggccttggtggccctgttcccaccagctactgcagcccctattcacggtccttcccccacaggggtcagcaagattgtgacagtggacgtgaaggggaacagcccactgtggctgaaagtgaaggatctggccgagggcatgacgtatcgtttccgaatcaaagccaagaccttcacctatgggcctgagattgaagccaacatcactacgggccctggagaaggtaggggagacgtcacactgtcctatgccccgcatcctcaggcctccaagtaagagagacccaggaggtctagagacctgtctagctcagaagacactgggaagcggagagcttacttactcctctatccctgccccaagagtcctccctctctcctcctcctccctcttcttgactcctcctccctacccctcctcttagcttcactcttgtcctcatcctcggcttggttattagcatctaagtcaccgggctattcccgcccaagcctggactgacccagaccctctccgccacgcaggcccatacacacatcccaggctgacacggggtctgcctcaatatagagcccaggttggcctgctattcatggttctccggcctcattcgctccagtgccggttttacaagggtgagccactacaaccactgaggtttccgcgtgttccttctttccttcctctctaaccctcagcctttgtcacctcagcccctgtcacctctgtccaggaaggaggcagcctggcaggcatccaaacctccatcctggccggaaccacctccctgtacctccccctcccccacccagcagtggctgtcggagcagggggcagaagactctctcccagctcctgtccggttgtacgctccctgggtgggcacagagcttctgattcccatgagacgcagtcatctcctctaacgatgacactggcacctcccgtaactctctgacacatgagctacctcctggcagccaggcctgccttccccaacacccaacacctcttttcccattttcaagacagggtttccctgtgtagccctggctgccctagaacagatacctttacaaatagaaggccactttgtatttgcatgtcagtgttctgcccttagggtcccaccctaatcctctctgtcactgcccctggcctctgtcacttctctctctccacccaggaccctgggggcaatcagggtttagtatcctctggccctgtcaagggttcaaggttttccatgctgaccataaaaatcacctcctaagccaccccgccgcccacaccctctctcgaggaagactccagccaggcccagcccagcttccaccctctccttcccctcccatgtccctgggccatcagcagactaaactttctccagagtctgggctagaagaagaaaaggcctggagagtccaggccctcttgccttctacctgctgtgggtttgtcacccccgtttctcattcagtaagaacaggatgtgcaggaccccgagaggctgctgtcccagcctcctcagctctgctcctccaagacttcctggtatctaaaagctagaagagagttggcaaatagcaggccacctgagctcagtttcttccgacttaaggtttaaagagttcaggcttggagtttgtggcacggggtagggaaggcgttggacaagaaatagaggaggagtggggaataccaagaaagaaagccaaccttacccacgagggctctacaagacacaacacctgcacagctgtccttggctcaccaaaaaagccagtggcagcccttttctctgtcctgagcgatgccctatacagagtgaaaagcagggactccaaaggcctccccagcctgcaccccactctcaggccgtatctcccctttatgggctgcaggcaggatgctccttagagaagggaaagtgtgtgtggggggggggactgaagctctccaaaactgacgtcaggagtagatatgggggcctggcaatggggtatccagctgtgcgaatatgtattccaatgtgtgcaaagtctccatcggcctcctgtctgagttgaacgactctccggggtcccagagggctttggtgagaagttggagttgtgttctcttcttatcaggcagcgagaggccatcagtcagcctgaacgcacgcacatacactgctgcctcagcccctggtactatgagcccataggaagcatctactgtgggctaggctctagggatggttagcatcatgtctactgggagacatgcctggtggggaccacacgcggcaggagtctccaggaagggtcaaggcttgtgctggtacactcccagtgaagcgatgcagcatagacggataccggcccagtgctctgtccacacaggctgcctccaggctgctagtccaccctccctctctaatatctcagtctgcaagacacaccttctgccaggttctcctcctgaggcttcctagggccccagcctgctctctccacacctagcctaacagcacatgcacgtaggggtagcagatttcaagtaagagactggacgggcattatcccatgtcaggtaaggagatgttaaagggaccttcaccccctcagacaggcctccatccctgggcacactccaccatcagtctgttcacctctgctgcccactatgacatctcctttcaggattatccttccacaggacccttgcagatgggcaaactgaggcacccctgaggggttccatgagtggatcacgtgatacgttctgcctggtcttacatgccttcgtcctctgtctctgctctggaattcttcccaggagcatcgcctaccctgtcccgtgccttgtcctgggattcaggaggtgtgggaataacaggaagagagactggccacatcctggcaggcccggcccaagatatgctcttcggacctagtatttgcaggacgtcccagaggctctatgtctagagttgacctggttgcccagccccctcccaccagcacaggttttttgtaaagagaggccactcttggttccatgggtgccctcatgcactatgggatgtttgcaggtgccccaggaccaccgggagtaccgatcatcgttcgctacagctcagccattgccatccactggtccagcggagatcctggcaaagggcccatcacgcgctacgtaatagaggccaggccttcaggtacgccctgctcaggctgggctatcttccctctgtggcccacgccctacccttctcccatctttacccttgggcttgttcccatcctccatccatgaaggtatgtatgtgtgcaattactgtaagtgaagctggagttggggacagaggacagggctttttccttagagccagactcttgcttaagaatccccggggccgggcgtggtggcgcacgcctttaatcccagcacttggttggcagaggcaggtggatttctgagttcgaggccagcctggtctacaaagtgagttccaggacagccagggctatacagagaaaccctgccttgaaaaaaaaaaaaaaaaaagaatccccggaaacagttgttagcaccttgtaggaaccaactaaggctaaagattgttcaaggggccagaggaagggctggacagtcaaatgttcaggcatgaggacccaatttcaggtccccaacaaccccatagaaaagtcatacatggtagtgcacacctgtaacaccagcacgggggcagagccctagagtttgctggctagaattggcaagctctagtttcaaagagacattgtctcaagaaatagagtagagagcaattaacagacattcaacatccccctctgacctccatacacaagtgcacgcaccctcgagcatgcacacatgcactcgcacgctcattcatgcatgcacacccatgaagaccacgaagccagaaaagcaaggcttggctcacgttagctaaatgcccatgtcctgcttgtgactcactttgtcatcctaccgacctctcctgtcaagcctgaaatcgaatcacaagaacttccaaagccatcaggcgctgagcggctgataagtcactcctgagggggcttgctctccgctcctgtttcactatcggccctgcacctgcttccccgggcaccagttccattactccgcaaactccagctccctctgttgctaggtttccaagctaatcagaggagcccaagtcagccgagagctgccggcttgatctttgtattctgaggctctgcgcctaggcgatagaagttgagaaagataagataagtctttgctgccaaatgagaattaatagtcagaggtaggagagcctagtagtagttgacatgtgcatgcaggtagatgcctaaagtcagcctctggtgtaattcctcaggtgccgttcaccttgttttatgagacggggtctctcactagcctggaactcaccaaattaacctcggctagctggccagagagccccagagatcatcctgtctctccagcactgagctcccaatcgcttgccactgtgcccgtgtctggcttttgaaaacaaagattaaaaacctgggatctggccaggcagtggtggctcacgcctttaatcccatcacttgggaggcagaggcaggcggacttctgagttcgaggccagcctggtctacagagtgagttccaggacagccaaggctagtacagagaaaccctgtctcaaaaaaatccagaaaaacaaaaacaacaaaaacaaacaaacaaacaaacaaacaacaacaacaaaaacctgggttctagggaatcaaactccgatctcaatgcttgcaaaagaagcagtttgctggccaagccatttccacagaatacttcttatggagacttgaaccagctcccaccaccaccaccacaggttgtacattcctcagggtggctgggtcaccccaataacaaagaattaattattctgggagctcctggaagccaccaccacccaccactgccctaatctcacactaaccatcacagccaccatagctcagtgtctagcaaactcagatgcaccaggtcgcctacactgcaggtggtgccggctctccagatggtccctccctggtgccggctgttgagttggcccagaggcctttgcatgcatctcctcaccaaggcctgtgcctgcttattccaccaaagtcagccgacccggtgccaggctgtggaatgttggccccggacctcagcctgttgcttttccagtgtttcctgggaggcccagcatgggccactgtccttccaagtttgggggttgtgacttggtgcacacaggtggaacagaggaaggactgagccagcattccgtgacagatacagaagggtcaacaccagcagttctaaggaagaacagacagtgggaaagcaggggaagggagccctgaggatgcgtggacaacccttaattaaacctgttggaaagtgagctgcttttcagagatggctgtctcccctcctctgggctgccttccccctcttttatcctccctccatgctaatgtgctcctcatgacaaaacagccctggtgacacaaaatatccctgcattgctgtgctttgtgctacacagactaagctagacataccgactttgagccatttagctctcgggcagagcagagcgagggaggggttcgctctgggactgaccgggcctgtgaactggctcccacatctgctgactctgaggactgaggccattgagggacattctagcagcttctggcttggtctcactgcccagcccccatcctttgtttgtgtggggtacagagaagggggagtgggtataaagagcaggcaggagacctcagcctctagaaggcaacagcaggattctccatgagctattagcagacgttggttgcacccaccgcttttcccgggtaccatgaggaaactcaatgccaagagtcgggtagctcagcagaaaatgccagcactgttagccatgtcgctgtgaccttggcaagacaagttaagttctctgagccttgtcttatctgtcagacaggagaagttcttaccccctgtcattgttacagctactcccccaccccacccccagcccgcgcatcaggttgtatgacacaggactgtcagctgctatgggagaggccacattgttacagtaatcgcatgagggatctgagccccactacatcccaaggaatgaagtgctgagctacgcattgacctgcgagataatactatgagaaacgcaggggaaagtcagagctcctagatttagcacacgccacgaagggtgtctgagctaagtgctggtgtataaggatataaagacaagccacacatgatccttaaggattgcacagcctcgaagtagggagagcgccaggagattaaacagaaagataattgggtaactggatatgctggcacaaggaaagaggaggaggcagggagttgtggatgccagatcagcttgggccacaaagtgagaccctgtctcaaaagatttttaagttagcgggctggagagatggctcagtggttaaggacactcactgactgcttttctagaggactagggttcaaatcccagcacccaccgtggcaactcacaactgtctgtaactccagatctaactctgatatacatgtgggtggcagctcacaactatctgtaacttcaagatctgacatcgtctcacatagacatacatgcaggcataacaccaattcacataaaataaaggtaatttttaaaaaattaaaataacgtaggtaataatcaagtagatattcaaaaatactgacaatgaggcaggaaagacgactctctgggtaaattgcttgctacccaagcatgaggtcccgagtttgcatgaccagcatccatataagagctgagggaaaattctgtgaccccagtaccgggaggtagaggcaagcagggatccccatggtctatgcccagccagcctagctgattgctgagctcaagattcgatgacagaccctcactgtctcaaaagaatgaggtgaagagcaatgaaggaggagcaaaggagacccagacatggccgtgcacgcacgtgtgcacgcgcacaaacacacacacacacacacacacacatacacacgcacacacatgcataatgcatactaccagccatggctcaggacccagggccttctgggagaatctctgaacagacagacctcatgcaggcttcggtaaacttgcagggtctatgatgcagagaggcaggctgccctcgacccggcttgcagcacacttggacttggtccaaaatgttttttcaaatgatgctagggcagtggtggctacttatgtcccagattcccctgctggatccgagggaaagtgtggtaagagcaacagattccttcaatccgggagagaatgttctggaactgggaagccagccctggtacaggagatcggctcagaagttcacggaagaatgaggtccctgagagtgaggctggggccgctgcggcagggagagctgggagatcaagataattctataatacatatcctgttatatatgtatattatatatacataatataacatagaataagaatataattgcctatataatatctatgcaaatatactaaatatattttggatagacaaatataaattttcttatgtgatataccatatacacatagcctaaaaattaattttatacactattttagtattttgtacatgaagtaaagtttaagcgtgtgtagtctttctgcttgagatgttataggtctcaaaatgtttctttttgggagcattttagattttacttttttattcatttaagtctcactgtatatcccaggctagcctcaaggttgatatcctctttccttgacctctggagtgctaagatcacaggcgtgtcgatattagagtttagtttctctgattaggatgttcagcctgtactggtttggttgttaaagaatttattgcatggtacattttttaaatgttttacagatgttttaattttaaagaaaagattttagaggcacactctctcagaaagtatctgtctctaagacaaggccgtcctaagagccaggctcaggcatgcgttgggccactgattagatgggacccgttattcagggggttacagctagaaccagatcagctgggatctgaggctcttccacctcacagtgcctcctctctctgctcctgcagatgaggggctctgggacattctcatcaaggatatccccaaggaggtgacttcctacaccttcagcatggacatcctgaagccaggcgtaagctatgacttccgggtcatcgcagtcaacgactacggctttggcactcccagcagcccctcccagtctgtgccaggtaccagcctatagggtggcaggtcagagagtccatggaagagttgatgtcatgctgggggaaggggacaggaagaaggcggacactgggcagcagaagagtcaaggtggtcatagaaatgcactgtccctcaacttctctaaccatgagctctgggctccatgcctaccgcagttcacagcctcagaggaagttgctagccaggccataaactatggctccacacaagccacttcaccccactcccaacagacagcacccaggtgggccatgggctaacactggtggcctctaagaccccactgggcagcaccccaggtgggtcctgttcactgccccaccctccccctctctttcattcctcctatccacctcagggttcacatgtggcactaggcctacacctatggccctgcccagttactgaccactttaaatatagaggcagaaaatcggctctctgcttgggcattagcaacccagctccttttccacccatatactgctcctgtgccgagatggataacaccaaattatgaaagacaaagagatgaaaataaacttcttagcttcctaccatctgtaaataaataaacatataaataaataacaacaacaacaaaaacattcactataactttgaggaaagatctctcaggcttactaaagtccagagaaacatctttccacacacaaattagaatctgtctatcaaagtcttttttttttcccccaaagtcaggagagcaaaaacaaaaaagcagctaacaaactgctactctccattcttgatcccctggcagacatcactcatcgatcgcagcactctttcttaataaacccagggaattctcaatcaactagaccataaaactcttcttaaaatggtctcccaggcaaacctttgccagcagatcaaagcagaaacttttagagtgcacagacccccacctactggtaatgcccatgagcaggtggtgggaccccagatggaccaagaaggcttgtaggcaggagagtattgagcatccaggtcctgacactctactgctgttgcagcccagaaagccagccccttttatgaggaatggtggttcttagtggtcattgctcttgtgggcctcatcttcatccttctcctggtcttcgtactcatcatccgaggtcagagcaagaagtactccaagaagacagattcaggtgagtgaccctgtgtcctcccaacggcaggcttgactcctgggggtcttctttatgttgggggctgggaaggtccattttctagcaatgtaccatctcaggcgaggcagccaggaattcctccacacaaccctgggctctaatctgggtcttgatactaacaagcaagaaaaaggagcatcccagctaagtgggagaatggacctgggaaggaatggctggctgtgtggtctgatgggtaccaattctctccccactctccccccacatctctttgccctcaggagggaataccaagtcgggagcgctcggccacggggagatgctaagcttggatgaaagcagtttccctgctctggagctcaacaaccgtcggctgtccgtaaagaactccttctgcaggaagaacggcttgtacaccaggtactacgcctgcatgtgtgacagaggacagagacttgagggccacacagcagcgtccagcagggatggccaggaaggagcatggaacaagccatgcccacgtggccttccccttccctgggaaatagcatccatgcttcagggctggcaatggtcagcggaaggtcacgtgggaccccagcgagatacttaggggcttctgttagtcccaccagacccagtcacagcttagagaatgttagaaactccatgaggaggtggacactaagagtctctgccaatagctgcagagtgcagaaacacatagtcatggaaaccaacctacagtagtttgcagtcaattgcactagtaaccagccttacggacagacggccatgcaccccatctcagacccagatgagacacctcggtgcgaggtgccagggactagcccattgtgtgtgcctttcttagcaaggggagagtaagcaccttctttcctgggcttggcttactttggttggagtcaagtcaagatcctgccaccatctttcagcctctggaagcagttagcatggaaggacctctggctcagctgccagagagcttgcctgtcacggttgaggcctaacactgtgaaaactggatgtagtggcgcacacctgtaatcctggcgggttcctgggaggcagaactgtgaggatcagtactgaacgatcagccctgagttccatagtgtttgaggccagcctgcaccaaacggggtcctttcccaaaagcccaaagcaatgaaaaaagatagcggccattttggtgggacccaactcccattcctgacttctttctgactccagtctattctggatagtcttccctgaagccaccaagctgtccattcttttcttttttccctccaattttttattaagtatttacttcatttacatttcaaatgctatcctgaaagtcccctatacccccctccccaggctgtccattcttaagggccagggatgattctggggtctacctggtcctcctctgacgggactgggcagtttaatgttcccaaaagttcaagggaggttgaggctacagccaaagggactccggtctccagcctcagcgtattgacattcacagttcggtggaggcagcaggctgggggtgggggagcaacctctttgagcgaattcacaaagcctctctctgtctcctcttgcaagggtaagccatgtgtacttctccaagggggtggaggggaaggcagagggcggagcactcaggctctcatccctcgccaatccagacttccaaagaaagaagcgtttgaagctgcggtaaaactcacccaagcctggcatggctgccacagccccgctgagcaggctcctgggactgccacggggaacaagggggcatttcacccatggccccacctccccttgtccccctccccctcctactcataggacacatacatagaggcctgcatgttctatgcccccatgggaatgagaaaaatcttgttttcaccaaaccagattcaggctgacctggactcagtaatgtctgtgcatacatgtatgtgcccaggcacatagacacacattccatttgccctatatgttcaaggacttcagtgtggtattctgttttctctcctcctcctctaagtcccccctcaccccacccattctctaaggcccaggctgacatagtgtggtcacaaggaggaacccagggtggaggggccggtggcctgcgttcctccagacctctctgagactacctctcagcctcactcctctccctaggtcccctcccaggcccagtccaggtagcctacattactctgatgaagacgtcaccaagtacaacgacctcatcccagctgagagcagcagcctgactgagaagccctcggagatctctgactcccaggtgaggggcacaaggggcacgagggcacaagcctagacaggtggtggctgctactaaatgtgggtgaagggatgagcagcatcccaacacacagccagcctcctcctcctcctcctcctcctcctccctctcccttctttccttccttgactttggagaccagagtgggagagaagctatccagaagtcattcatgggtcattcaccaccacctccaagccctgctcagtttcccccagagcgaatggggtctgggccacaggaatcacgagaggctggacccatacagtcaccagagccccgccatttcccgggttctctgtaactcggacttatggaggaaccttggagctgaagagtaactaaaagaggggctagggatgcagctcaatagatgagcatacggcagtcccggggttcagtctcagcagctcagtggatgagtacttacctagcatgtgtgaaccccggggttcagtctcagcagctcagtggatgagtacttacctagcatgtgggaaccccggagttcagtctcagcagctcagtggatgagtacttacctagcatgtgggtatccccggggttcagtctcagcagctcaatagatgagtacttacctagcatgtgggaaccccagggttcagtctcagcagctcaatagatgagtacttacctagcatgtgggaaccccggggttcagtctcagcagctcagtggatgagtacttacctagcatgtgggaaccccggggttcagtctcagcagctcagtggatgagtacttacctagcatgtgggaaccccggggttcagtctcagcagctcagtggatgagtacttacctagcatgtgggaaccccggggttcagtctcagcagctcagtggatgagtacttacctagcatgtggggatccccggggttcagtctcagcagctcagtggatgagtacttacctagcatgtggggatccccggggttcagtctcagcagctcaggggatgagtacttacctagcatgtggggatcccagggttcagtctcagcagctcagtggatgagtacttacctagcatgtggggatccccggggttcagtctcagcagttcagtggatgagtacttacctagcacgtgggaaccccggggttcagtcccagcagctcagtggatgagtacttacctagcacgtgggaaccccggggttcagtctcagcagctcagtggatgagtacttacctagcatgtgggaaccccggggttcagtctcagcagctcagtggatgagtacttacctagcatgtgggaaccccggggttcagtctcagcagctcagtggatgagtacttacctagcatgtggggatccccggggttcagtctcagcagctcagtggatgagtacttacctagcatgtggggatccccggggttcagtctcagcagctcaggggatgagtacttacctagcatgtggggatcccagggttcagtctcagcagctcagtggatgagtacttacctagcatgtggggatccccagggttcagtctcagcagttcaggggatgagtacttacctagcatgtgggaaccccggggttcaatcccagcagctcagtggatgagtacttacctagcatgtggggatccccggggttcagtctcagcagctcaatggatgagtacttacctagcatgtgggaatcccggggttcagtcccagcagctcagtggatgagtacttacctagcctgtgtgaaccccagggttcagtctcagcagctcaggggatgagtacttacctagcatgtgggaaccccggggttcagtctcagcagctcagtggatgagtacttacctagtatgtgggaaccccggggttcaatccccagcagtatttacaccagccacacccataatcccagcactggggagatggagcaggaaatagaagaccatcctggagttcactcaagtgcagcagactgggattccagcttctctgtttcagggccagatactatactgcctgcccatagagttgggtctggctttgtttctaccctatccccaaagccttgctcctagtagactttctagaaaagtcttctgctctgtccaataagccatctaagagaaccaaacattcatcactcctctgagtcatgttttaccaataacttgtggagtttcttttttaaaaaaaagaaccagcactcgggaggcagaggcaggtggatttctgagttcgaggccagcctggtctacaaagtgagttccaggacaaagaagaagaaaataatcaagtcccctctaaagactaaaggcaggcaatacatgctcttggcactaaagttattcccatcccgctcaccactcctacccacttcacacccttccaacccccacacggctttgtacacacattcgattgatagtcctatctccaaacacttggctctaggcccacagagaacccagattccaggttcactaggacccttgcatctcagagatgggactgtgggatgagcaggcccctactcccagtatgaaacttgcattctatactgtcaataaaatgtgtgcctagctgttggtaagtagccacatcccagagctcctaagtgtcaccagaaggaccccaggcagtcagctttaccactctgtaattagcaggaacacagcaccctaattccagctggctttcttctgcacgtctatgcttgacaaccatgggaactgtgtttctacatcagcctctggcttaggacagctccagcagaataatggggaagagctgtctctaacttctctcaaatcttcctgtctctctctccctatctttctttggccctgggaatgggacacaaagtcccccacttgctagatgaaaactttacccctgaactatatcattggcctctggcctatttcctgagcctgttctcagaacacggaggtgatggagataggactctgacacacccccaggatctccttggggtctgcagggttacatgtagaggtagaacagctaaccttgtccctgccagagctctctggattatcaatcagggtctggagtgtgaccctaatggctgtcctaggcagatgacaaatgcaggtccctggggactggcaaacccttccccctcagcatcccctcccccagcccccatgtgcatgaatgtgcagcctggtttatatttcaagtcaggccacccaaatcttgttccccaaactgatagaagtctgtccagcctctatcctgtgagacagtcataaacaaaatgtcaatttgacttaaaagtaaacatatatgataagatgcagtgtgagaaaggccccagagggctatgggtgaaaggctagaggcagaggctggctcctcccaaggacccagggccatgcctcaagaggtgctagagacagtccccgcccccaaaacaggaaaggcacacccaaagaaatttgtctgtggcttgtttagtgaaatgtctaaaaatgcagcctggctccatcccaattcattttcaaaataacagcacaagtttagtaggggaaaaataagtatatttaacactcaactgcatctcaatgggaaagaaacactaagcccacagctgatgtcttccaatcttaatttccagttcttagcaggattgtgcttagccagcttaaagctcatttaaaaaaaaatcaaatctatgtaaaaacatttaaagaaaatgtgtgggaccagtcacatctatttattaaggatatggagcatttactaggagtcaggatgggccctaagaattgtgggtacatgacactcttaaatccctggaagctactgatgacatgattacttctaggttaaaacaataagaaacagtggtggtggtatggggggaagggcagtcacacacagctcaaaaagtccagacccaccagggcgtggtgttgcacgcctttaatcccagcacttgggagacagaggcaggcgaatttctgagtttgaggccagcctggtctacagagtgagttccaggatagccagggctacacagagaaaccctgtctccaaaaaaccaaaaaaaaaaaaaaaaagtccagacactccccaacccccaactccctgttatacctttcctatcctttatgtgggtcaggcacattgaagaaatggctgttgacttcctgtctccatggaacgtattctttgattcactggttccttccttggggttcgcattcaacagctattggaccacaccactgaatggtaccagataataggttttctccaccaacaaaataagccaattcaagctgaatcaagagtatagaagcgggtttattggaggcagctcttgggggggtggggctcactggtctcaaagaacggggccagggaagtcacatgcagagaggaagacagagaagttggggcaggcagagatcgaaagagatcatgcagacagagacagtggtgggtgatgggaccctgcaacagacgcctagcacacccggtggcggtggtgacgtaaccagtcactgggcccctgatatcgggccagcagcactgcttgtatgttaacagggctagagttaggggtagggttatgggtcccaggtttgaatagcaccagacacatcaatggtagtagctgaagcagtaagcaaaagatgctttgtgacatcctattatggtctgccggagagggccacctgtgcgttaataaccacacatctcggttctcaaatatcacggaaccataacgactaactgtaggaagaaagggatatcctaacttcgttctatttcctgccgtttgaggaagttgaggcactgaagagacactacccaaaggcatgtgacagagggatgtcgggggggggggtgttcctagaagatgcgggtactcatttggtgtgtgctggtctgagtcaggtacactgtccccttcccctaaggcctcctgtctgttgaatgtttctcatcttcttgtccgttttgtttcttgtccatcaggttgggccatccctggaacaggcttagctaaggccctgtcttgtctctctcctctccttagcccaaagagaaagataccacaggacagagaagttggtcaataccttatccatgccaaaccttatactttatgcatctcacttagagcctaacagccctgccttggtaacaagttgatgtcccataaggcactgggggattcagatactcagagatggccaacattaagctcttggttacagagcttacagaagagcaggtgactgggactctgtctgtcctgatgactctgaggacaccatccattcccaaacctccctccggaacttccctcaaggcccttgaccacagacatcctagacagacatatggcttgcataggctgacatctctcaagttgttttcacacggggagcccaaagttctgaaaatgagccctcacaggaaaatcagtggagccctctgaagattctcaggggccccttagcatatcagcaacctctccaaccctgaagaaggtagccacactgccccaaaagttagcttatccaagggacagggacagagcactatgtccagagtgtgatcagacaggaccgatcccctgggaccccagatgagggggggtctcatagtctctgaagtcctcaaaataaaaacagagacatgcacactcaaacacacaaacacgggtacaatacacatcacatacacacacacacataaacacacacacattacctgcctggtcccatacctcaaacctgccccttacgccctgagctcgtcatccggaacctttaccagctagctgagtctggtacaagagacaagaaaacgagcaaagggctttttttccactttgagatttcagcttttgtctctacaattggccctccttctgggtccctcccccactcctgtccccaagcctggcgtctgccctccctcccgctccttcgaccgagtaattgctgattgagtggctttgaggagctgttaagaggccagggaactgaagcagtcgcttgccggcctggcaggatggtccctgaaagccccctttgtgcttgcccgctcccgggacaccgcattcagttactgagagagggttgaaagctacaatcggagcccctggctcccctcgcactctttcttctcaccccacccccaccctgaaaagaaacagatgttcagggaggtggaggcggtaactgccctgttagtctgggggaaagacacccccccccttcctccttgaccccagggagctggaggagggactagctaacagctcagaccccacctcagcacccccaacccccacttccagccttcccatctgtcagggctgtcttcccagagggccaggcatccagtgggcgctcaggagatagcagctgctggtctgaggtagtaaagataaacaggctttgagatttgggcctggaagagccagagtggacccagcacatcccccaaatcagacgccacccactgttgcctagcaagggaggctgttcctcccgttccagtgacgtcacggaggcactgtccaatccctggccccttgtgatctctcccactgaaactctgtccctgccccagcctttctccccaaataatatcatttattctactcctgcctgctttggctcctcttcgcctaataggtcacaagctaccattttgcagatcagtccaccaaggcctaaagcctgccagtgttggttacaaacatgctttactaacaagggccatggcaccacctctgaccccagaggcgcatgcattgtagaagtggcacactgtgatctggaactcctcccaaatgtggaagcctagggctagcggaaaattctagatgccttggagacactggcaagctcttccaagacaggaagctagtagaatgctctaacctggttctctacacccccagaccctaccagaagagagacaaaccaccctacccccacacctatcactgccacaaccaccactatggcccccagcctctggcctcagagtattagcctggcctcaacatatggatccttcttgttatgtcttttgttctgggaagacagatgggcacacacacacacacacatagacacacacacaaatggctcacattgtgctgccctgaacccaaagctaattgactggcagggctatccattgtgggcctaccttcctggggaggatgggtacttggaggctgcaagggggagaagctgagactgcagaaaggtggagagcaagggtggaatcaaaggaagggaaggaagttagccattggctggggagtttttgtctccctgggagtcgagggagggactctcactctcttccaggaaccctggagtaagtgcaagttaagtgccagggtggacatcagagaacaggcagatctgagctaaagccccaccagacctgcatcccagcaaacccactgtctctgcattcagcatcagcacacaaagtactcatgcccgtgcagcataagtactaacatagcatcagcactcagtcagtacctagtaccagtacctgcacaccagtagtactcactgggcattagtgctctctttctttttttgttgttgtttttggtttttgtttgttttttaagatttatttttattattatatctaaatacactgtagctgtcttcagacataccagaaggaggcgtcagatctcattacagatggtcatgagccaccatgtggttgctgggatttgaactcaggaccttcagaagagcagtcagtgctcttaactgctgagccatctctccaggcccagtgttctctttcacatagcatcagtactcacacacaataagtacttacatggtactagtacccatgcaatgttagtgctcacacaagccccttagtattcacagagtcagtagctgagtcacatagtgtgagtactcattcaccgcagtacccatgaagccttagtattttcatagcaacaataagcagcaggagtactcccacaacatcagtacttacttagcaacagtacccatgatgcagcagtattcccacatcagtgctcacttagcattagtgtccatgatacagcagtagtactcccacaacatcagtactcacatagcaacagtacccatgatgcagcaggagtactcccacaacatcagtactcatgtagcaacagtacccatgatgcagcagtagtacccacacaacatcagtactcacagcactagtacccatggtgcagaagaaatactcccacaacatcagtactcacatagcaatagtactcatgatgccgcagtagtactcccacatcagtattcacttaacaccagttcccatgcagcatcagtattcccaaggtatgagtacttcctggcaacatgcacactgagacagccttagcatccacatagtgaattcacaaccgcagcacagaggtgtgaaattcagaactaattacagaaatgccaagtcagcaactcctgcctccccaggagtgcctgcctgagaagctagcatagctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagttcccatgcagcatcagtattcccaagtatgagtatcctggcaacatgcacactgagcacagccttagcatccacatagtgaattcacaaccgcagcacagaggtgtgaaattcagaactaattgcagaaatgccaagtcagcagctcctgcctccccaggagtgcctgcctaagaagccagcatagctgtgcctcttctgagggtctagaagccacagggggctttggccctaaaacatattgtgcattccatctcccgtggccagagaacaaagtcacctccagttgctcccgatgtcaaatgggacacagtggatcatcccaaacttactggtgttggcctagctggattttgttgccagcactctccttgacaaacatgtcttccttaggttcatataagtggtgaattggccagctagggacactggtgggcagggacgaggaaagcaagacatagctggatagcagccaggcagccttggtagcaacctctgggctatatgtcaccaagtgtgcctttctccatccaagctggtctgttccccagaatctccatctgtcttattccttctcaaaacatggctggaagcttggggtgggggagggggagtggtaattttagctgcacaattcagagtttacagttcagattgacttgtctcctgccgaagcagcatgtgcctagaaccacagaatatcctaacagagttaagaataactgaatatttcacattcatgggggcaggacggcctccaaagtcatcataggagaatttggatcttttgttagcattaaaaaaaaaaagtttcatgtgtgtatgtgattctgtgattcctgtacatatgcacataggagcccagaaaagcctaaagagggtaccagagtccttggagctggaattacagactgtggtaaattgcacagcatgggggctgagattcgaactcgggttcttgggaagagtgggagatgttttccaccgctgagacatttctggtgacactattttgttttgttttgttttgttttgttttgttttgttttgttttgttttttttcgagacagggtttctctgcatagccctggctgtcctagaactcgctctgtagaccaggctggcctcaaactcagaaatgtgcctgcctctgcctcccaagtactgggattaaaggcgtgcaccaccaggccagacctatgacgatgctatagtatagaatagaataatatttattcagggtgtggggaggggagnnnnnnnnnnnnnnnnnnnnnnnnnnnnnnnnnnnnnnnnnnnnnnnnnnnnnnnnnnngggcgagcagccccttttatagtgagtcaggcacacctggccgttgccaggtaactgtggggcggagcttagacaaaatgctaacagacagtgttgagatcaatactctcacttgaaagaggcagagcagagaatggagccagaatgttctgtgcctttgagtcctgacctcactaacaccccgattctctcctcctaggggagtgacagcgagtacgaagtggacacgaacacccagaaagcccactcctttgtcaaccattacatcagtgaccccacatattacaactcttggcggcgccaacagaaaggcatctctcgggcccaggcctacagctacacagagagtgattccggcgaacctgaccacgtcactgtccccaacagcaacagcacccagcaaggcagcctcttccggcccaaggccagccggactccaacgccccaaaaccccccgaatccccagagtcagcagagcaccctctaccgtccccccagcagcctcgcccctggctctcgggcacccatagctgggttctcatccttcgtttgacatcaaaagaggagaaagaatggggagaaaaaagagacaccaaaatcttcctttgccgcctcccaaaacgcctgccagaaaacacacaagaaaaccccaccaagacatcgactcaacgtttcacctcccaagtttatttttccagagattccagggccagcaaagccgggttggaggacgggcggagggagaagaaacccacaggcggacttggatacacgtgacctgcaatggcttcacatccttggggtccactttgcagtgtggagggctggagaccagatagtctcacttctgccgaggacagaggggcttggggccctggagagagtgagccataaggcaggtggggctgagggatctgaaagcttctagagatgcagatggcttcacccctcacacttgtgctagatctctgggcttgcgatctttgcccctctgcaaaaaggatgggtgcgctcagaggcgaagcctgcctgctgtctctggctcttcgtggccttgtcaccccccttccctgcctcggcatcccccaagggctcatggccctcgtacaacttcttcaccaagcatttggcttattttggaagaaaaaagaaaaatcaaatggtaagaatcaatccacttagcaacttccttgttcctacaaaacaatttttttttttttaattataagttcaaagaagagggcctaagggttgggagagaaagaatccctccacagccacataactgagcctcctgttgcttagattcacctcccagaatgctgataaggaaaggtaacatctggggagtggagacccaaggtgctggctccacgctaagggatgcttcagggagatgtcctgcaggaagtcagagacgcaagaataaagccttgactgttccttctgacccaccagcccaacactaagagaaaggaaacaaagggttgggggcggtgcctaggataggaaactcagcgcacccagcctcgcaggaggaaggttgtatgtatgttcagattatcactttcctatgaatgtacaccttcctgctagcccatgcagctgccccatgaactcggaggaaaaggggtccaggggctcctcttaagaggatatcctggaactcttcttgcccaacaactttctcactttaagacctgtgtagccccgccctctgtctctaccacaacatacaggggcccagaggggcggtccagtccctggtcctgaggctttataaagaatcaaaggtcataaggttgtgggtcccgtgtctgctctaccacagggcatgaccgcttggggaagcagaacgcagggagactgcactcatcccacgccatcatcgcagggcgggtgctgggatgcagggaagtcccgggacacccctagcggggagggggagaagaagtgcagtctgaggagtggggcagccggtctctggggcttctagccttagttcaaccgaggaccacgctacctttcacggtccacttccccacaaaaggtcacttcaactccccctaacagctcccaggcggggttcagtgaaggcagggctgggaaggaccaaagaagggccagctgggaagccttgtccaaactgcacacagcaattgagatgcgtggtcagcccagccaggagaggcgggtcagatagcatcaagggacaagaatagctgatggaaggaaagctgttcctcccaggaaagttctgtaaataaccatgggggacctgagcttctcatcagctttggccttccaggccttccaactccaggatttggggaggtggttttctgatgtcctgggttgacttaggcccttggggacagtaatcagcctaaagctcgccctactgctggaaatgcttggctgcctccttcataggcttcactggggcatgtccaattcaataaagggtcagagttgctgggagtcggcagagcagttactgttggccttgttgagaggccctagtggagaacctgaagccattctcagcagtctctagtccctgctaattctcactgtgcagagaagccagggtcaaagcccgagttaagaacatacttgagccgggcatggtggcgcacacctttaatcccagcaattgggaggcagaggcaggtggatttctgagtttgaggccagcctagtctacaaagtgagttccaggacagccagagctatacagagaaatcctgtctcagaaaaaaaaaaaaaaacatacttgagtattaatgtggtctctcctccctacacacctgacccctgggatattgtaagagagatgtgggaagccagctcagcaggcaggtgacccatctgctgggagtgaacagtttgcttttcacagtgacttctcttaggcagatgcgaaggctcttaagccaggaagcacagccttgtccccaaaggactacaaattggcagagaccttgcccctccagggacacaggtttcccagggctaccttgacctttgtcagtcagctggaccccagcccccgcagcatctgacatcgccaaagccgcacatccgcagaggcaggggctgcctgagttcacactgccacgctcactgtccgtctgtcccttgtgtctttttaaaacaactcccatctttttttttttcttttttcctctgtcttcggaggctttaaccatttaaggatgttgtgagtttacattagggaattatcagcccagcccagcccagcccagcccagcccagcccagcccagcccagcccagcccagcccagtgagggagctttaaagaggaagtgggaatgtgtttttaaaaaaatcatttgtgtgtgtgtgtgtgtgtgtgtgtgtgtgtgtgtggtgttgcacaggaggccaattttcctttgcctttaacaaatcaccttgtgcactgaggtcctccatgtgttcattggaacccgtgctggcatccttgggcacagacccacttgggcttgcatataagcatataaagatatgcacagagcatacatctatgtgtgctaacataggggctcttggcaatgccctctgacggccccttggctgtctctcatcctcaggaggcacggacagcctgggtcacttgcacttggggtatttggtgagacctattacccaagcagctgagcacattacaagctacaactcggagatgagcctagggtgagagcctctgtttaggcactgcctgccaggggtgtgggggggaattattagctacacagccacagccacagctggacacccagtaggtgtccagctgcggaactctaggttgttcaatgagatcttttggcctatgtttacatttctgctgggcactggagcatcccaagaactccacctagacaccccaccatattctaagggtatggcaggcgggcaccgaccctgggtaaggggaagctttcattttcctgagcctgtgaggccagggctgttgtcttgtgactatggggaacaaggtcacagaaggacacgcctagccctcttgctgttgcctctctgtgccctgaggaaatctgccctgtattcaggagcccacacttagcacgctgggacggctctctcctctcctggcagcgcctgcctcctgcattcttgcaggctctgcgcccagattgccaagactaaccaaatagctgctctgggttccaggaacatcttccttcggagagcaacagggagtttacaacccccgcgctgttgcctctcctttcccctctccaccacaaacctgacactgcccgtgaatcagagggaacaaggacacagctgggctgccttgccagcccttgcttttcgaggccttctgtcattgctgtccatgaccgccctggacagcatttctaaaggtgccagaacctcacattagactgccccaggcaggggttcccctcgccttctcgagaggcacacagtgaaggtgccaccatatgcgtgcagccagccagctggaccatcaatgggggaaagaggggacccacagacagccaccaccagctcctgagtgcctctgtggtcccatacagggacacccaccctaaccaacacctcgagcacaggtgccccacccccttgggacaacccccacctttctgtttccataaaaagacaaatccaaagcatttaagtgtgttccttcctccacccatatagactcccaaaacaaaactcggtacaaatctttatttttttgatttaaaagctataatgaaaaattatagggagagtattcattatggcaggtgtctatctgtaagaaaaataaatatatctatatgtcatatagcttgttagcaagtttattttttaaatgaaaggtaagaaagaaattgatttgaaatatataccgccagaagtcctatgtcctgtcaaactgtcagtattttataaataaacttttttttttggagttctgaagcggcagtcattcttttccttggtgcaaattcctcaaacatgtgtttctatctctagccttgtggggactgtgcagagctagtccggagctgggctcatctgccctcttagttcatcagcacgtggtatctatacttttagagtggcacatagtgaaggtaccaccatatgtgtgtgtgtgtgtgtgtgtgtgtgtgtgtgtgtgtgtgtgtgtgtgtgtgtgcgcagccaaccagctggaccatcaatggaggaaagagaggaccgaaaaagtcctgcttgaggctgagcagagctcccaaggtagaacttcagcccaacatgcagaggctctgagttcaatccttagcagcaaaagaagaaaaagaaagaatgagttattttaagtttgggagatcagagcccctcagatgtctgatgcaactgttaatggtcaattaactgatggtagcatgggagtgggacaggggcctcagtggtttagagcaccccagttcagttcccagcacctacatcatagggctgcccacaactgcctgtaactccagttctaggggatccaattcccttttctggcctccacagttgcccatgtacacacacacatacacacactcacacatgcacacacacacacacacacacacatgcacacacacacacactcacacacaaatgcacgcacacacacaacaaacactaataaataaaatttaaaataaacatgtataataatgacaacattaagaagtgacacattgataccacactctaaggggtcagacggtcacttgatatgcagaacctgacaaagcccgagtgtaacagccaaggaaggggataggcacagagagccttttaagaggcttgctctccagaagcagatgggggcagagccaggattcgtcctaaggaaccagtttgactctggaggtacacacactcacagatctggtaagacagctccttgctaggttttgaccattacaaatctagcacctaggtgcaaccaaggctgtttttagtgtttgctgtaggacttttgggtgggcattttatttactttttaaccttttccctccagagtcttacttcccagactgccctggaaatcacaacaatgttcctgcctcagcatcccaaatgcttggattatagactgttagactgatcaaaatacatttaccagcacattggagacagagatagtcaggtctccatgatttcaagattagcatggtctgtctgtacagtgagttcaaggccagctagtgagggcttgtctaaaaaaaaaaaaaagatatatatgtagactaaatatgttagttttacttaaaatgcacagtgtaaattcattcactatgctgttggtattgagccatgacattactcgctttctgcaagttggcagttctctaggatcatctctttgcataaatctcatctattttgcataaatcacacttgcaaggcaacattagtgcgtcccctttttgctttttcttcttttctttcctcctcttcccactcttcttccttttgtttcattttagatttgtagttgtttttagaaatagttactttgttttatgtgtaccggtgtgttttttgcctgcatgtcactgtgcgggcaatgtatgtgtgatgctctcagaggctaaagaggacgttggagcccctagagctgcagttatagatggttgtgccctgccatgaaggtgtaaataatccaccctgagtcctctagaaaagcagtcagcactgttgaccactgggccatctctctaccagcttttcatttctttttttggggttttttttttttttttttggttttttcaagacagggtttctctgtgtagccctggctgtcctggaacttactctgtagacctggctggcctcgaactcagaaatccgcctgcctctgcctcccgagtgctgggattataggcgtgtgccatcaacgcctcatttcttgagtctgtattctcagatggccttgaattcaaagctgtccttgggtttcaacttctgtgtgaggagattacagaggtatactaagatttgtttgtttgtttaaaacaagatcttactctgtagcccaggctggcccagaattcagtgggtaggtcagcctagcctgaagctcatagcaattctcctgcctcatcgtcccatgcgccaggattataggcatgaactctcattcccagcttgagtttctatttaactgggtatggtagtacatgcatttaatcccagtggtctagaggcagaagcaagcataactcataactttgagttcaaggccagcctgatccacatagcaagttccaggcctgctaggattacatagtgaggtcataacgccaacccctcagaaaagaagaaactaaaaaccgtaaaaataaaaagtaagtgtgtgtgtgtgtgtgtgtgtgtgtgtgtaaatgtgcacatggcatgacacatgcgcattggttagggaatgacttctcctacagtttgggtccagggtattgaactcagatcatcaaagtggctttaaccactttggcctacctgagtttctctttcttaaagtctgggtcttttttcttctcctcttcctcctcctcccccacctcctcccctcttcttcctttccctctcctcctcctcccctccccccccccttctccttcatgttcctctattaagccatgagtccctggggagcaggttccaacagcgcaggcgctccttcccgctccttccggcaagttctcacacggccagctctccaggtgacgcaggctggagctggctgggcctttcactttggcttcctttcctctttgatcatcaccttgcctgtttctgggctgacctcagctcttagagcgcttgctatgcccaatttgcacattgatctctccgcaagactctctcgcccttcccttgctcatttagggcaatgccaacagctggctgagtgacattctggcctcctcgctggttttgtcacactgacatttatggggttgtccattctgaacagtgctcatttctctgacacctacaacatcacccttgcatgttgtacccaaaggactgagtccccattttccttcctttctctctcttccttccttccttccttccttccttccttccttccttcctttctttctttctttctttctttctttctttctttctttctttctttctttctttctttctttctttttaattatttatttattttatgtatgtgagtacactgtcactgtcttcagacacaccagaagagggcatcagatcccattacagatggttgtgagccaccatgaggttgctgggatttgaactcaggacctctggaagagcaatcaatgctcttaaccgctgagccatnnnnnnnnnnnnnnnnnnnntctctgtatatccttggctgtcctggaactcactttgtagaaccaggctggcctcgaactcagaaatctgcctgcctctgcctcccaagtgctaggattaaaggcgagcgccaccacccacccggctgagttcctatttctttaaggaaaagcagtttgcagaaatgaccggttgctgagagagcagatctctggatctcatgatctttccccaggattctctaggtcctacctatgaccaagtcaacaagactttggttttttgtttgtttgttttttaaagatttatttatttatttacttacttacttacttacttactatatgtaagtacactgtagctgtcttcagacacaccagaaagggcatcaaatctcattacagatggttatgagccaccgtgtggttgctgaatttgaactcaggacctctggaagagcagtcagtgatcttaaccgctgaaccatctctccagccctgtttttgttttttttaatagctcctctttaccagtaggaacataattcacagagaaatgacagttctgtgtctactcttttttttttttttttaaagatttatttatttattatatgtaagtacactgcagccgtcttcagacactccagaagaggacatcagatcttgttacagatggttgtgagccaccatgtggttgctgggatttgaactctggaccctcggaagaacagtcgggtgctcttacccactgagccatctcaccagcccctgtgtctactcttattttacaccttacaccatttgtgaaattatgtaaaaaccatcacaagatttgccgtcataaacaagtttgaaacaattgatgctttgtaaacagactgatttgggaatggggagtagacaggcctggtggacagcagcctctcaccttcaacatccagagctttagagaggactgcatgctttgcaagggaatctaaggcatgcattaaatccaagagtcaggaaagaagaggccagataagagacgtttgtttgaaacgcattgcaagccctgtgtactatacttcacaaccgattctcacattgataagagggtctgagtggtcattttgactacacataacttttatcttgcatataactgggaaccctgttcccacattagaagtaacttacagacctactgcctgaggatatttgcttaaagtataataacagggcctctttcgggtcttggctccgagatgaataaaaagggaagagacaacagtctcaccaaaaaaagggaccacggccatgtgtagcaaatttactgtaggaaccgtgcccagcataaagaactgcatcgcttggaacatagtagaggcatttgccaagagggatattaatgaaaccagtgtttcccatgctagcgtgattcctgtagctgtagctcaagctgcatcatggcgtgagctgtgcgcttcagagcaaggtgctcaggggcgagtatcgtgaagcaaccccaccacgacttagacacgaccaatgtgtcatggtaaacattaggggatttctaccccacctctgatcatttcgttctaaaaaaaaaaagacacaaaacatttacatttataataagtcttaaaggcattagtgctgggcagtcatcaactctctatgctgttttgtctacttccctgtgaataatcccgagatataacttgccgtgttccacctgggccacccccacatcttgaggtggccagccctcaaggtcacactctcaggatccacctaccccatggcgtcttctcccttcctcctcaccctctcctccttgtctctgcctcagaccccaaacccaggagatggaagccccacctacctctcttctgcccagctacaagctgtgggcatctttattaaccaatggttttaaaccaaggagcaaggtttgtgcaataaaagctgtcatagggaggcccctagaccctgggatacagaacttagactaacaatacacagcagcagaccaaacctcaacccctatgacctccacaagagcccatgtaaagaactggcttcctgaggacagaaggaaaaccatctggggaaaataagataaaatggaaattatatataaaatgaaatgaataacatggaagccaggagagaggtacaatcctagaacagtctttcaaaaatgttgggacttagagtattttcacaggatctcattatgtagatttgttgtggagcccaggctagcccagaatttatgatccttctgcctctacctcccatgggctgggattacaggcctgtgccagccaccgtgcccagccctcctactttacctaggagaactgaatgagcccttagctaccatcagcaagatttcagggtgggggtgctggctggaaagccaagcaaggtggcacagtccatcaattccagggctctagatgcagagataggcacatttctgtgagtttggagtcagcctgggctacaagaaaccttgtctcagaaaacaaaacaaggggggctggggaggtggctcagtgagtaaaagaaggcttactttgcaagcatgaagacctgagttcgaatccccatgtaaaaggatggacatgatgtcatgtgacttcaatcccagcgttgggggatggagacaggtgccaccatttctaccgccatcttcacatcaagttgtgctctgctctcctttagggctccccatagctggatgttatgtctgaaaaactgagtcttgtgcattcaggaacccttgggag

SEQ ID NO: 102 - DNA, 6122 bp, Mus musculus
ggattccgcctccctccatcacctggtacaaggacgctgcgttggtggaggtggggaagctaacccgcttcaagcagcgcagcgatggcggcctgcagatcagcggcctgctgcctgacgacaccggcatgctccagtgctttgcccacaacgcagctggcgaggcccagacctccacctacctggccgtcaccagcattgcccctaatatcaccagaggcccccttgacagcacggtgattgacggcatgtcggtggtactagcatgtgagacctcaggggcaccacggcctgctatcacttggcaaaaaggggagcgcatcttggccagtggctctgtccagctgcctcgattcacactgctggaatctggcagcctgctcattagcccaacccacatctcggacgccggcacctacacttgtttggccaccaactctcggggagtagacgaggcgtcagcagacctggtggtgtgggcccggacacgcatcactaagccaccccaggaccagagtgtcatcaagggcacccaggcctccatggtgtgtggagtgacccacgatcccagagtgactgtcaggtacgtgtgggagaaggatggggccaccctggccgtggagactaatcctcggatccgcctggacagaaatggctccctacacatctcgcagacgtggtcaggggacattggcacgtatacctgccgggtgctctcggctggtggcaatgactctcgcaacgcccacctgcgagtcaggcagctcccccatgcccctgagcaccctgtggcaaccctcagcaccgtggagagacgcgccatcaacctgacctgggccaaacccttcgacggcaacagccctctgatgcgctacgtcttggagatgtcagaaaacaatgctccctggaccatactcctggccagcgtggacccagaagctacctcagtgatggtcaagggactggttcctgctcgatcctaccagttccgcctgtgcgctgtcaatgatgtgggcaaaggacagttcagtaaggacacagaaagggtgtcccttcctgaggagccccccacggcccctccgcagaacgtcatcgccagcggccggaccaaccaatccatcatgatccaatggcaaccacctcccgagagccaccagaatgggatcctcaagggctacatcatcagatactgcctggcagggctacctgttgggtaccaatttaagaacatcacagatgctgacgtcaacaacctgttgctggaggacctcatcatttggaccaattacgagatcgaggtggctgcctacaacagcgccgggctgggtgtctacagcagcaaagtcaccgagtggacgctgcagggagttcccacggtgcccccgggcaatgtgcatgcagaagccacaaattctacaaccatccgattcacctggaatgccccaagcccgcagttcatcaacggcatcaaccagggctacaagctgattgcctgggagccagcccaagaagaggaggttaccatggtgaccgccagacccaactttcaagacagcatccatgtgggcttcgtgtccggcctgaaaaaattcacagagtactttacctcagtcctctgcttcaccacaccgggagacgggcctcggagcagcccccagctggtgcgcacacatgaggacgtacctggacccgtgggacacctgagcttcaatgacatcctggacacctcgctgaaggtcagttggcaggagccaggcgagaagaacggcatcctgacagggtaccggatctcctgggaagagtacaacagaaccaacacccgtgtgacccactacctgcccaacgtaaccctggagtaccgagtcacgggcctcacagcacttactacctatactatagaggtggccgccatgacctccaagggccagggccaggtgtcggcctccactatttcatctggtgtgcctccagagcttccaggggcacccaccaacctgggcatttccaacatcggcccacgatccgtgaccttgcagttcaggcctggctatgacgggaagacgtccatctcccgctgggtggtggaggctcaggtgggcgtgatcggggagggcgaggagtggttgctcatctaccaactcggcaatgagcctgacgcccgttccatggaggtgccggacctcaaccccttcacctactacagcttccgcatgcgccaagtgaacatcgttggcaccagcccacccagtcaaccttctagaaagatccagaccctccaggcgcccccagacatagctccagccaacgtgactctgcgcacagccagtgagaccagcttgtggctccgatggatgcccctcccagaaatggaatacaacggcaaccctgagtcggtgggctacaagatcaagtatggccgctctgacggccacggcaagacgctgagccacacggtacaagaccgagtggagcgagaatacactattgaggacctggaggagtggacagagtaccgcgtccaagttcaggccttcaacgccatcgggagtgggccatggagccaggcggtggtgggcaggacccgggagtcagtcccatcctctggccccaccaacgtgtcggctctggccaccacctctagcagcatgctggtccgctggagcgagatcccggaggcagatcgaaatggcctcgtgctgggctacaaggtgaggtacaaggagaaggactcggactcccagccccggttctggctggtagaaggcaactcatcccgcagcgcccagctcacaggcctgggcaagtatgtgctctacgaggtccaggttctggccttcacacgcatcggcgacggcagcccgagccaccctcccatcctggagcggacactagatgatgtcccaggcccccccatgggcatcctgtttccagaggtgagaaccacatctgtgcggctcatctggcagcccccagcagctcccaacggcatcattctggcctaccagatcacacaccgtctcaacgccactacagccaacaccgccacagtggaggtcctggcccccagcgcccgccagtacatggccacaggcctcaagccggagtctgtctacctattccgtatcacagcccaaacccgcaaaggctggggagaggctgctgaggccttggtggtgactacagagaagagagaccggccgcagccccctagcaagcccgtggtacagcaggaagacgtgaaagcacgcagtgtgctgctgtcctgggaaccaggcagcgatgggctctccccagtacgctactacaccatccagacgcgcgagctgcccagcggcaggtgggcgctgcactcggcctccgtgagccacaatgcctccgccttcactgtggacagactcaaaccctttacgtcctacaagttccgagtgaaggcgaccaacgacatcggcgacagcgagttcagcgaggaatcggagtcgctgaccaccctgcaggccgccccagacgaggcacctaccatcctgtcagtgactccacacaccaccacctctgtgctaatccgatggcagcctccatctgaggacaagatcaacggcatcctcttgggcttccggatccggtaccgggagctgctctacgatgggctgaggggcttcactcttcgaggcatcaacaaccctggggccaagtgggctgagctcacctccttgtactccatgcggaacctgacccggcccagcctcacgcagtacgagctggacaatctgagcaagcacaggcgttacgagatccgaatgagcatatacaacgccgtgggtgagggacccttgagcccgccgcaagaggtctttgttggggaggcagtgcccacggcagcaccgcagaacgtggccatccacagtgccacagccacacagctggatgtgacctgggagccaccccctttggacaaccagaatggagacatccaaggatacaagatttatttctgggaagtccaacggaggaacctcacagagagggtgaagactctcttcttggctgagaacagcgtgaaactcaagaacctgacgggctacacagcctacatggtcagcgtggcagccttcaatgctgcgggggatgggccgaggagcaccccgacccggggccagactcagcaagcagcccccagtgccccgggctcggtcaagttcagcgagctgaccactacctcagtgaatgtgtcctgggatgccccacagttccccaacggtcctctggagggctacaggctggtgtacgaaccctgcaccccagtggatggggtcagcaagattgtgacagtggacgtgaaggggaacagcccactgtggctgaaagtgaaggatctggccgagggcatgacgtatcgtttccgaatcaaagccaagaccttcacctatgggcctgagattgaagccaacatcactacgggccctggagaaggtgccccaggaccaccgggagtaccgatcatcgttcgctacagctcagccattgccatccactggtccagcggagatcctggcaaagggcccatcacgcgctacgtaatagaggccaggccttcagatgaggggctctgggacattctcatcaaggatatccccaaggaggtgacttcctacaccttcagcatggacatcctgaagccaggcgtaagctatgacttccgggtcatcgcagtcaacgactacggctttggcactcccagcagcccctcccagtctgtgccagcccagaaagccagccccttttatgaggaatggtggttcttagtggtcattgctcttgtgggcctcatcttcatccttctcctggtcttcgtactcatcatccgaggtcagagcaagaagtactccaagaagacagattcaggagggaataccaagtcgggagcgctcggccacggggagatgctaagcttggatgaaagcagtttccctgctctggagctcaacaaccgtcggctgtccgtaaagaactccttctgcaggaagaacggcttgtacaccaggcccagtccaggtagcctacattactctgatgaagacgtcaccaagtacaacgacctcatcccagctgagagcagcagcctgactgagaagccctcggagatctctgactcccaggggagtgacagcgagtacgaagtggacacgaacacccagaaagcccactcctttgtcaaccattacatcagtgaccccacatattacaactcttggcggcgccaacagaaaggcatctctcgggcccaggcctacagctacacagagagtgattccggcgaacctgaccacgtcactgtccccaacagcaacagcacccagcaaggcagcctcttccggcccaaggccagccggactccaacgccccaaaaccccccgaatccccagagtcagcagagcaccctctaccgtccccccagcagcctcgcccctggctctcgggcacccatagctgggttctcatccttcgtttgacatcaaaagaggagaaagaatggggagaaaaaagagacaccaaaatcttcctttgccgcctcccaaaacgcctgccagaaaacacacaagaaaaccccaccaagacatcgactcaacgtttcacctcccaagtttatttttccagagattccagggccagcaaagccgggttggaggacgggcggagggagaagaaacccacaggcggacttggatacacgtgacctgcaatggcttcacatccttggggtccactttgcagtgtggagggctggagaccagatagtctcacttctgccgaggacagaggggcttggggccctggagagagtgagccataaggcaggtggggctgagggatctgaaagcttctagagatgcagatggcttcacccctcacacttgtgctagatctctgggcttgcgatctttgcccctctgcaaaaaggatgggtgcgctcagaggcgaagcctgcctgctgtctctggctcttcgtggccttgtcaccccccttccctgcctcggcatcccccaagggctcatggccctcgtacaacttcttcaccaagcatttggcttattttggaagaaaaaagaaaaatcaaatggtaaga

SEQ ID NO: 103 - protein, 1812 aa, Mus musculus
IPPPSITWYKDAALVEVGKLTRFKQRSDGGLQISGLLPDDTGMLQCFAHNAAGEAQTSTYLAVTSIAPNITRGPLDSTVIDGMSVVLACETSGAPRPAITWQKGERILASGSVQLPRFTLLESGSLLISPTHDAGTYTCLATNSRGVDEASADLVVWARTRITKPPQDQSVIKGTQASMVCGVTHDPRVTVRYVWEKDGATLAVETNPRIRLDRNGSLHQTWSGDIGTYTCRVLSAGGNDSRNAHLRVRQLPHAPEHPVATLSTVERRAINLTWAKPFDGNSPLMRYVLEMSENNAPWTILLASVDPEATSVMVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPAQEEEVTMVTARPNFQDSIHVGFVSGLKKFTEYFTSVLCFTTPGDGPRSSPQLVRTHEDVPGPVGHLSFNDILDTSLKVSWQEPGEKNGILTGYRISWEEYNRTNTRVTHYLPNVTLEYRVTGLTALTTYTIEVAAMTSKGQGQVSASTISSGVPPELPGAPTNLGISNIGPRSVTLQFRPGYDGKTSISRWVVEAQVGVIGEGEEWLLIYQLGNEPDARSMEVPDLNPFTYYSFRMRQVNIVGTSPPSQPSRKIQTLQAPPDIAPANVTLRTASETSLWLRWMPLPEMEYNGNPESVGYKIKYGRSDGHGKTLSHTVQDRVEREYTIEDLEEWTEYRVQVQAFNAIGSGPWSQAVVGRTRESVPSSGPTNVSATTSSSMLVRWSEIPEADRNGLVLGYKVRYKEKDSDSQPRFWLVEGNSSRSAQLTGLGKYVLYEVQVLAFTRIGDGSPSHPPIRTLDDVPGPPMGILFPEVRTTSVRLIWQPPAAPNGIILAYQITLNATTANTATVEVLAPSARQYMATGLKPESVYLFRITAQTRKGWGEAAEALVVTTEKRDRPQPPSKPVVQQEDVKARSVLLSWEPGSDGLSPVRYYTIQTRELPSGRWALHSASVSHNASAFTVDRLKPFTSYKFRVKATNDIGDSEFSEESESLTTLQAAPDEAPTILSVTPHTTTSVLIRWQPPSEDKINGILLGFRIRYRELLYDGLRGFTLRGINNPGAKWAELTSKMRNLWSLTQYELDNLSKHRRYEIRMSIYNAVGEGPLSPPQEVFVGEAVPTAAPQNVAIHSATATQLDVTWEPPPLDNQNGDIQGYKIYFWEVQRRNLTERVKTLFLAENSVKLKNLTGYTAYMVSVAAFNAAGDGPRSTPTRGQTQQAAPSAPGSVKFSELTTTSVNVSWDAPQFPNGPLEGYRLVYEPCTPVDGVSKIVTVDVKGNSPLWLKVKDLAEGMYFRIKAKTFTYGPEIEANITTGPGEGAPGPPGVPIIVRYSSAIAIHWSSGDPGKGPITRYVIEARPSDEGLWDILIKDIPKEVTSYTFSMDILKPGVSYDFRVIAVNDYGFGTPSSPSQSVPAQKDFYEEWWFLVVIALVGLIFILLLVFVLIIRGQSKKYSKKTDSGGNTKSGALGHGEMLSLDESSFPALELNNRRLSVKNSFCRKNGWSPGSLHYSDEDVTKYNDLIPAESSSLTEKPSEISDSQGSDSEYEVDTNTQKAHSFVNHYISDPTYYNSWRRQQKGISRAQAYSYTESDSGEPDHVTVPNSNSTQQGSLFRPKASRTPTPQNPPNPQSQQSTLYRPPSSLAPGSRAPIAGFSSFV

SEQ ID NO: 104 - DNA, 130244 bp, Homo sapiens
  misc_feature (1)...(130244): n = A,T,C or G
atagcctgactccagggtttaaggtccgagttcaaattctgactctgtctcttcctagttaggtgaccttagacaagttaactaacctctcggagcccatttgagcagttttttccattgtaaaatgtgtgaaatgatgaccaacctctcagggtggttgaacgaactggccgattgaaggatatagggatatgaatggagacagtagcttagggcagggtgctagtggtgaggcagagaatggggtggcccgagcaaggtgtcctccttccctgtggtcatcctgtctgccccgaattttccgtccatagccaccactcccaacctgggagctgggcagtccctgaggctgacctcccgcccctgatcctactgccattgtcccggctgcagacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatgtgagtgcatcgctctgaggggacggggaggggaggggtgtctgggggaggaggtttggggccagataaagtctcccttgagtgtggaggagggcctttgtgcagaagcccctttcagctcctgtgggacacagccaggtaggggacctcccaggggctttcttaggatgcacaggcaaggacttgggaccatgaaacccatgcccggtccccttcctggggaatcccagggcgttgcctccaccatcagctggagaataaatctgcttttcagagcacttaaaaaacccaaacaggcatatacgaaggcgctgtcaccgtggttacaggcccaggactcaggccagtggcgctgggggaccttggagaggctggcgtctcctgggcagccgggaggccctgggcgcgtccgttggcagggtgtttactggtgtgtgagggctgtgtgtgtcttggctgtgcggcggaggtgtggccagggaagccctgggcagagaaacacacaggcctctgagtgttcacaaggccgtctctgtgtgcccctgggattcgggggcagcccacctgtgggcaggaggatggagccaacaccccacacctccgcagaaggcgagcaacaaagcagttcctcccgagatacacccgtctccccgccctcctgagccacccccgggtctggaggcagctggggctctcctctttccaactccagctctcccctgcttccagaagaccaccttctgatctacccaggctgcgtgtacacaggactgagcctgtcctggtctctgtagagagtggaggcgtagatggatggttcctgcctttggggagcattaagtctagttgggggaaggaagcatagtaacaataacaataataataatatcactatcacaggccggacgcggcggctcacacctgtgatcccagcactttgggagactgaggtggactgaccacttgaggtcaggagttgagaccagcctgagcaacgtggcaaaaccctgtctctactaaaaatataaaaattagctgggcatggtggcaggtgcctgtaatcccagctactcaggaggctgaggcaggagaatcgcttgaacctgggagtcagaggttgcagtgagccgagatcgggccactgcactccagcctccagcctccagacaaaaccagactccatctcaaataatgataatatcaccatcatcataatagcagctgccgtttattgaatggctgctatgtcctgaggactgagctaagcacaccacacacatcccctctctttccggacagccacactctgtgaggaagaagatgctctcaatctcgttctccttccagtccgcagagcacctgcagaaaggaggcgttgttgaatgaatgaccctcacaacaacccggtgaggtgctgggtttctccccgttttacaggcaatcaagtgaagttcccaaaagtttaactactttgccaaatctcacacagctggtcagcactggagctgcatccagccctgccaactccggagtcaggttctttaattcttgtattatgtgaaaagtgcctgaaaacaggttcacagactcgatgaaaagatagtgtttgtggggaacaagccctatggagtatctcaacgtagctacctgttgaaatcatttgggagtttggggatacagtcatgtgttgcttaatggcagagatacattctgagaaatgtgtcatttggctgtttcattgttgtgtgaacacacacctagatggtgcagcctactacacacccaggatgtatggtgtagtccattgctcctaggctataaacctgtacagcatgttactgtactgtaggcaattgtaacacaatggtaagtatttgtataaataaacatatctaaatataggaaaggtaccacaaaaatatggtgtaaaagatttttttaatggcacacctgtataaggtagtttcattataatcttatagaaccagcatcatatatgtggtctgtttttgactgaaacattatgcagtgcgtgactgtgtactgatccttgggctctatcctaagactctctgacttaattgaaatgggatggaatttgagcatcagaaattttaaaagctccccaggtggttctaatgtgaagccagggttaagaaccaccatgctagtatgtatcagctacccacagccacagatatgctgcgtaacaaaacagctcagtgggccaggtgcagtggctcatgcctgtaatctcagcactttcagaggccaagctgggcagatcacatgaggtcaggagttcaagaccagcctggccaacctggcaaaatcccatctctactaaaaatacaaaattagccagggatggtggcacatgcctatagtcccagctgctcaggaggctgagacaggagaatcgcttgaacctgggaggcagaggctgcagtgagccaagattgcaccactgcactctagcctgggtgacaagagcaagactccatctcaaaaaaaaagaaaaaaaaaaaaaaccccagctcagtggcttagagcaatacacatttctttttcttgtgagtctgcaggctggtgatttaggctgggcttggctgggtggttcttctggtcttggctgggctctctcacttgtctgggactggctgacttgtctgggtgactggggtgacttggctgtgctgcacaggaacatacacttttccagcttctgctaacatcccatgtgccaaagcaagaacatggcagaactcagaatcaagatgtaggaaaatagactctgttccttgagcagcaggacctgcaaagtcacgggacaaagagtgtggatacagagcagggtgaagaattggagtggcaccccaggttaacaggggactcatgctgtgtgagtcagagtgtgccctcttaggcctaacttaatgctcaataaaaccagcagagaatggttcttagcatggatgtttcttagcgtggatgttgagattttgctgtggaaggggaatgctctccacacaggttttgggacaagtagacgagtcccagccccatcccagctccctttctgaggttatttcccatggcctattgcaagccaatcaattggtagtggctgcctggaacactgtgttgagaaggattctgatgtcccatctagactcattagaatgaatatcatgattgattagcaatgtctgccatggctgcatgaggggtgtgctggcactttcctgctacatttgttgtggtgggtgaaaccctttctacaacctactcccatcatccctttcctaacacctcttcacctccttttctcattccaagcctctgtcctcatcctcttttaattcccacaaccctgtggcaccaggacagaacaccctggcctgcacacacatgcatacctccctggtcacacacacccccagcccctgcacaccaccgcaatattcctaccacctacatgatagaacactctgggggttttatcctggcaattacagcaaattaatattcataagtgagcagaaaaggtccctggcagcaaattccctggtgtctgtgtgtcagagatacacatctgatgagtgctatctgccagaggggtgtgcagggcacagaaggcgctgctatctacagagagccgctctcactggtggggcaagagcagagattagcaccacctcacgcatgccccggtgctcattgttgcaaaggagacaagattcctcataaagatgcatgctgggggctttggacacattctaggataatttatttcatgcataattaaattatcaatgggggctgcagggagctgagaaaaatggcctggattaacaggagcagtggggggaagggagggcagggctgggccaatcagagccatagcaaaagcctagtacattgaaaccagggggtgtggctgaaaaatggaatccagcccctgcccaagagttgaattctgctgtctgtgtcccccaagaattcttcctccagcttctttccatctgggttgcctctggggtgcagtgctgcaggttggaagccctcctgagtgccaggaagagcacccagtacagtacagtacagcatcatcccaggaatgtctatcaacgagatggacattctggagagagccacaagcccagggaccttccttcactgcctttgggggtcgcagagagggcaagtcaaaaggtatctctgcctcctgttccactctgtgtttaagacttgaactcaggccctgggggtcccagtccagggtgcttccctccaggcactagttaaagcagagcccaaaatctcagtgacttcacaccatagaagttgagttcttgcccatttattgttgttgtttttgtttatgtttttgttttgagatggattttcgctcttgatgctcaggctggagtgcaatggcacgatctcagctcactgcaacctctgcctcctgagttcaagcaattctcctgcctcagcctccagtagctgggattacaggcatgcaccaccacatctggctaattttgtatttttagtagatacagggttttaccatgttgatcaggctggtcttgaactcttgacctcaggcgttccacctgcctcagcctcccaaactgctgggatgacaggcatgagccaccgtgcccagccccatttaaagtcctaccatgatgagaggcaggagttttgccatcatcagcacacaaccttccaagttgtcctgctctgccagagagaaagggggcagacatgaggatcgcgcaggaggcgctcatggtccaagcttagcaacggtgcacatcccttcctccatatcccactagttcagcctcactgccccacctggatgcaagcagagatgcaaagtctgtctctggcttcccagccactgcagtccatgacacaagggaagcctgagactgaggtgggcagcggccatctctgccatcttaatatacactctacctaggacagaccatgtcaggcatggcgctcttgacatctggggcctgatcactcttccctgtgagggccttcctgtgcaccacgggatgtgtgcttaacaacacccccggccttgacccctattgttagtggcgctccccgagctggcaaccaaaagttgtccagacattgtcatccctggagggcaaagtcaaccctggttgagaaccactgacccagaaagcttgatcatgatatagacaaaatacagtgaaaggagccttcctgatcaagaaagagatgaaattggaggtgggagccttcttggagaccaaaagggtcctaagacaggtgggtgaactggaacgtgggccaagctgtgcccagtgtgcccactggaggcttgaagctgcttctatgatagtcatggatgtggcgtggctgggggagctgggccggcatggtcccggcacatagtgctcatgaaaatcctgtcagccctgaagctggccatgtcccggtctgcggggtgggaagagacaggtggcgggctgcagggctatcttgggcctaatgaggaaacaacagaagcagcaacaggaatcagaatccttcaacctctgggctggaagaaatctcacagaatacctgcttccacccctgcacagaggaggaaactgaggcccagcaaggaggaagctgcatgccctttagaggctagggccagagctccattccagagctcaccccgtgccccagccagagccctgcacggggaggacccctcctccaactctcagccaccctcacatgctatacctaaggacaagtccctgcaggaaactctcaggtgggaaaatgaccactatccctgtcttattttaagcttttgaaatattttcgcctggctctggccccacctcctattgcctcattagctggaggttaaaaggactctcctgttttttgtttcttgtttttttgtttgtttgtttgttttgtttttttgagatggagtttcgctctgttgctcaggctggagtgcaacggtgcgacctcggctggccgcaacctctgcctcccaggttcaagcgattttcctgcctcagcctcccgagtagctgggattacaggcatgcaccaccaccacacccggctaattttgtatttttagtagagacagggtttctccatattggtcagtatggtctcgaacccccgacctcaggtgatccacctacttcagcctcccaaaatgctgggattacaggcgtgagccactgtgcccagccaagagctctccagaaaaaaaaaaaaaaaaaaaaagaggtgggggggcatcattagggtacccaggaattgggggcaggagggcttggcttcctgcttcccagagctgtgccaagagtgtgattctcagcatgtgaagcaccaaaaccaggagagagtggggcgaaaaccagcacagccgggctgggagagtgctgggctggagaagcattagtggggatgtttatttgagagcctgtttaaaactctgtaacattcacctaatgggaaaatttgaaaagaattcaactggatttgtccttgttaaactaacattaaggatgtttaacagctgtctcaggcccatcgcattaaaatccagagatatacttgacaaactaatggctttgtttgtcattgggagaatgggtggagggaggaagagccggtgtgggtggcgcttctggctccattgcacccacattccatggagcctccagcttcctgcttggacaagccccttttccctgccagaagacctggcctgagaaggggctgcatgatgggatcccagcaaaggaaaccagctgaggtaaacagcccatcaccacaccccaaaacacaccagcctctttttccctcctaaccagcccacctagtcccactcttggttatgagcttcaaagaggtagaaactccagctgggtacagtggctcacacctgtaatcccagtactttgagaggccaaggcaggcagatcacttgaggtcaggagtttgagaccagcctggccaacatagcaaaaccctgtctttactaaaaatataagaattagccgggtgtggtggcatgcacctgtaatcccagctactcaggaggctgaggcaggaaaatcacttgaaccgggaaggcggaggttgcagtaagccaagatcgtaccattgcacttcagcctgggtaacaagagcaaaactctgtctcaaaaaaaaaaaaaagactgggcacagtggctcacgcctgtaatcccaacactttcggaggccaaggcgggcagatcacaaggtcaggagatcgagaccatcctggctaacaaagtgaaaccctgtccctactaaaaatacaaaaaattagccaggggtagtggcgcgcacctgtagtcctagctactcgggaggctgaggcaggagaatcgcttgaacccgggaggcagaggctgcagtgagccaagatcatgccactgtactccagcctgggcaacagatcgagactgtctcaaaaaaaaaagaggtagaaactgatacccagaaaggggactgaagggagacaggacttccagaagttgatgtcaccaggtgacctgtggcctttgagtccatcaatcctgaacagatttaggattagggttaaggcatggactctggaatggccctgcatttctaaattcattagcattcatttgtcatttacttattcattcaccgacattcactaatccatgctgagaacatttcttcagtgtctggatgtacatcatgcagaaataaccacacacagccatggaggctgtgacctgggaaagggcagaattccaaggggatacctggaagccccttgcccagtcttggggtaggggccagggaagcttcctttgggtggcctcggcgtctgggcatgaacgtgctgtctctgggtctggttgacagcatcagcaccgtgtttagcattctctgcaaactaaacgtggcgggatgtaggcagtaagaggttggggagggggtggcaggaggggccctgggaggctggggactgggagatatggtcgggcttcccccttagggtttccactcccactccctggaggttcagagccccttaggcccctgtcagaggaatccttttcctcttcccagagccatcacgctggagaacacccttgtcatcctgtcaacggtggcccctgacgcaggtcgctactatgtgcaggctgttaacgacaaaaacggggataacaagaccagccagcccatcacgctcaccgtggagagtaagtacgcacagggccgggaccgatcttggagcgggccattaaatcttagcaatggtgctccaggggatcattgggaagatggagtggcagaggagggggacagggaagctaggggacggccggggggagccttcccaaggaggacgagacacagcagagccaggggtgcctgggcaggaaaggagcagctgaacgctggagcccgttcccatgacacgcctgagatcctgcatcggtagagaggatgcttagcacaactgttagcagggctaccagggacccagggaggggtggggcagaggaagagcgtgtgcatgtgtgagttgcagccactatcggggctcagatgctgaccaggagggcatgtgggtgattgcagggctgaagcttgtttttacagaaatatactaactgtctctacttggctgtcacataagaagtgctgtctatattgggagccaggtggtccctgctgatgggaagacaggccctctgcccaggcacccacctaaaacacctccatcctcagacacctccagctccctgggcgaaaagggcaaagccctccctagaactcaccacacagtgagacacacacaaaagcgtgattcccttggtgtgctttggcaaagagacgcttgtccagccgagactgaagccagttttctttggagggacgagatgctgggatgttctttctggcctggttctccctactggacgagcccctccctccatactccattcccaagacagagaaggagggaggggtggacagcccaggagcagcgtaggcccaaatcccagagtatgtggggcgaggccagagcttcctcctcagcagcagctgagccatcacacaagctgggggaggcagatgttcacctccctccacatctgtacaactcctgctcccaaagtaagcctcatttatcatccttggtcacgatggtacttgcccaccagcggcaagatgagggtgtggaccagcctggggcctttctgtgctcttattctgatcctagcctctgctgtccatgtccagagggcccaggacattcccaggccttgccatccccattccagggcctttcacacttcagcaggaaccgcttcccattatcccagggatctccttcccctactcagcatccagtctgcctagaaggaaatctgaatgcggggaggagagtttcattctggagactgacccatcggcgtcacaagtatatctggagactgaccgtcagggttgagggtgtaacctctgacatcgagtcagggtctcagtcaagtctcagcagcctgggccccagcccataccctggggctgctgtttctataggagaagggaatttagtcatcaaagagagatgcttctccccatatattttctagtgatcagattccctggagtctcatggaatcccgtcatttggtaagagacaatgtcaaagacacaggagtggttcatggtccaagtcaaagccaggcatcctcctaggtgactcagtttaccctgagacagagtcggggccttcctgtctgttccccttctccggcatccagctcctcctcataggcgttaaactaggctactcttcttgtctgactttgggagtcattcgctctctgctccatcccaaaccacccaaccctccagctggccccagggaggtgggcaggtcacctctgaccccctgtacccacccaagccctgcctagtcacctgcttctcccaccccactgcctcttggcctcctgccatcacacgctgatttatcctgaattcagagcagaatccgctgatttttagctaatttctctttccacaagtgactgcacttgaaaaccctcttcctctctgtgacacaaatccccagcctgcctgcctgcctgcctgcctgcctgccaaccaatttgtgaggagcaattgacgcttcgcccaccaccagcaccagctcccctcattcctctcctgggcctcacccctccgtctgctctcccctccgcaccgcttcctccatccctcctggactccaggaagtccagctttctgcacctctttatagggaccctatgctcttcagaaccagagaaggaaagagcaagtctggtgaccccagaagttgccccctgctcaggataaccctggtgacctcattcggactgtcacagctcctgaaaaccccatgcttgggtggataccggggatcagggctacactgtcgaaaggaaatagaatgtgaaccacatgcgaaattttaaattttccagtagccccatttttttaccaagtaaaaagaaatcgttgacattcattttattactctattttatttaacccaacataacaagaagttatctttttaacatacaatcaatgtaaagaatattaatgggatatcttccattggttttttgcatactaagtctttgaaatccttgtgtattttacgcttatatcacatctcaatctggatgtgaaattttcacccgaaatacgtgatctgtatttagatttcacaaaatttatagctgaaaagtagagtcgtatgcataagttgttccgtacatgcttaaaagtgttctaataactgaattggggatccattcttaattaaatgtaaattagttaaaattaaatcacattaaatcaaagggacaccagccacattgcaggagctcataggcacgtgtggctcatggcccctgcattgggtggttcaggtcacagggcctggataccctggctcctgggcagctggagaacaggcatcccagaagcctgcccaagagaggggagcagctcacacccctgccccaccgctcaccgacctgtggcccaggcgagtcccatggtccctgagcctcagtttccccatctgtaaactggtgcctatggcaaagttgggaggactaaatgaggtggcacaggtgggtcacatggtctctgagcctcagtttccccatctgtaaattggtgcctatggcaaaaatgggaggattcaatgaggtgattcagggaggatggatcacgttagatgtcccttgtcctggctgttacgcaaagcgtctggggcagtgagatccagtgaggccccccgtgtggggagccccgtacacttcctcccaccccagggcccaccctatgccaggagctcaccgggaagacacccctcctctttgctcgggctcacctgtgattttcatggtctggcctttggagccccatttaccccaataacccacttgtgctggggtgaccttcattaacagtaaatctgctccaggactcacttctctgagacccactcaactcccgctgtctcccagggagccacgccatgaaatgcctgaggccttgcccggtaccctgcagggcttaatgtgcgtccccgagcctgcgactcccacctctccatagcctctgagtctgtcacttggactagggctagcagggagagctcttccctgcacaggcaggcaaatctccaggaggggaggctgtcatttattgagcacctactgtgtaccaggcactctgcagtcaccccagaccagcttagctgcccccttcccggcaaccatcacacgctctttcattcattaaccccacgagcattggttcgacttcctctgggacatcaccctccatgaggacagaccctggccatctcgcttggtggagaatctctggtgcctggaacacagcctggcacgtgtcaagcattcacctaggaaagatttgttgagctggggcctgaattcatacaaccctgagaggtagtgactttcatccccatttcccccctgagaagactgaaactcagtaggatgaagtcaccaggatacctgggggcagagctaggctttgagcccaggtcttcctcacccctgggaccctttctcactgtgccagcatccctggccacctcagcccccatcgagccctgcaggctgccacctgggcctgagcacatggccatctctcctccattccttccagagccaacgagccagccctgagccctggggcagccctcgtatttttaaactcagaactcgccttccttgagctctccctgtttacctggctgtgccatgcggcgctctggcttgggctctaactgtctgtctcttacttgtgccccattaatctgagccgtggtacctgcgcgcccccgcatgtgataaacaacttagagcacacttttatggattcagctatatcagcagctttcaatccgatcgctcgttatggcacctacatgaggcttttatattgttgcaattattttgctttatatgcttcctttctttcccccttcattttactttattttttacattttatgcgcattcttcctgggccttttctagcaaggcctggagtcaaggaaggaaaacctgcccagggctgacaaggtggcccagaggggcagtggggccactgtgcaccctgcccctaaccccataaagaacagcctgtcactgtcaccgcagggcccagcatgtcatcatggcctactacctccagaaccttctggaaaggggccaactggatagatttgttgtggagaaaaagtcctcagaggttgtattttcaggagccatggatcaggcatacacagaatattggagtttatgccaatatcgggcctacactgacccatcaagatgaaaatctggcctctactttaaaaaaaaaaactcaaaatataaaaaaaaggaattgctaccacctctattagaagaggagtttggagtgtttctctctctttttttttttccaataaaacccacttacaggaagttcttgttcatttcaatcatcgaccctgggagttggatgatggtaactctagatccattcatttgttcacttaacacacgtatttgagcacttactgtgtgccaggcatccttcttcgtgctggaggagaggtggtcgtcaagaccgcaggagttggccaggcgtggtggctcacacccataatcccagcactttgggaggccgaggcgggtggatcatctgaggtcagaagttcaagaccagcctggccaacatagtgaaaccccgtctctactaaaaatacaaaaattagccggacgtggtggtggcacctgtcatcccagctacttgggaggctgaggcaggagaatcacttgaacctgggaggcagaggttgtggtgagccgagatcgtgccactgcactccagcctgggcaacagagccagactccgtccaaaaaaaaaaaaagactgcatgagtcagctcttggtgccataacaaagcaccacagctgggggcttacaaagcaaatgttctggctcccaccatcctggaggctggaagtcccagattgggaagccagtatggtcagcttctcttctcagcttgcagatgtctgccttccagccgtgtcctcacatggcggagagagagccagctctggcctcttcctctttttataaggacatgaatctgaaatatggaaatatacacacctaacaagtacctggaaacctgctttctgagagtttcatccttaactctttcatttcattcaatgagagaattaaagtattacatgcttttctaagcaaaagttgacaatatgttaagagaacatttttctttttccttgggaccctcattggccctcatgaggcccggccctcgtggcctcatctaatcctaatcacctcccaagggactcctccaaatgccatcactttggaggttaaggctcaacatatgaatgggtgggggacacagctcagtccacagcaaagacccatgaggttcctggtcagggagaattttagtctcttatggcctgcacaacaaagtactaccagctgagtggctcacaacagaaattgagcctttcacagttctggaggccagaagtctgaaaatcaaggtgtcagcagggctatacttctctgaagattctagaggagtctcatttcttgccccttcctggcttccggtggtggccagcaatgcttggcattccttggcttgtggccacatctcttcactctgcctctgtcttcacagagtcttccaggctgtgcatctgtgtctcaatttccctcttcttacaaggacaccagtcgtattggatcttgagcccaccctgatccaatatgacctcaccttaactaattacaaacctgtaatgatcctatatgcaaataaggtcacatttacaggtgccagatgggcatgaattggcgggaggtgtgttgggggagggggccggtgactctgtttgacctcgtacagagagtttgcattctggtggaggacgtggacaatgcagaactaaaccaacaaggtcaacccgggcagagggaaggatttgaagggaatggaacaggacagggtggtggtggggagaggggggtgtggctgctttacaggaggggtggggaaggccgtcaaggtcagcgatgtctctccttggaccctggtgtggtgactcatcaacagaggaagtagagggatcaggtagtccctggggtcagtgtctggaggtctgctctggggctgcccccatggccacctgctccactcggtaaggacaaagacctcccagggcatcagcctctaatgaggctgggcagggataggatttccagcctcgcccccagctaacatctgatctctctccagatgtaggggggcctgcagaccccatcgcacccaccatcatcatcccacctaaaaacaccagcgtggtggccggcacctcagaggttaccttggagtgtgtggccaatgccaggtaggtagtgcatcttccctcgctcccgcacccgtaactccagctgctgctcccaaactgcgggctccagggagagcagccagaagccacatcacctgaggatccaggacaggggaggagggatgcaaggagacctgctggctgttgtcagagggttgctgtgtacaaccagggctggcttgttctctgtagcccaagaagagaaaaccaggccctggatggaacttacagggaaggggacgtcagcctgggacgtacaggactggagggagggtggactcacttctaacccttggaggagcccagagggagtgggtggcctctcaaagcgagccctcttgcatgcagggttgtgcaggagggaagtgtgcatgggaaacgattcacatggtggttaagagtacggctttgggcgcgatggctcatacctgtaatcccagcactttgggaggctgaggcgggcggatcacctgaggtcgggagttcaagaccagcctgaccaacatggagaaactccatctctactgaaaatacaaaaattagccaggtgtggtgtcacatgcctgtcatcccacctactctggaggctgacaggagaatcgtttgaacccaggaggcggaggttacagtgagctgagattgcaccattgcactccagcctggtcaacaagagtgaaactccatctcaaaaaaaaaaaaaaaagagtatgggctttggagtagggcagatcaggggtcaggagccacccgagcccttcccagccatgtgcggccctcacctctcccacacaggaaacaattatgaaacccctgagcctcattatgtgtggctaagtgccttccgtgccctgcatcctgctaagcaccttcccacaagacctctttcctcccaaaacaatgtatggcataggtgtcaccacttcagaacccagagagggcaagtggcctgcccaacgtcacccagctggatgatagctgagttgaaatgcactgccccctctcccccaggcctgtactcactgccgccctctgggcctcagtctccacatctgtaaaatgggaatgatctgagcaccaaccccagcggaaggcgcataggcagcgcgctgacccagcctgacctgacccttcctaagtgcactataaagttaaaccaatgggatgggcagggggttagactgatgatccccctgaggtccccttgacctgaaacttcctggagagggagagcatgtcctgtagcagcattttttttttaagacagggtctcactatgttgcccaggccggtatcaaactcctgggctcaagtgatcctcctgcctcagcctcccaaagtgctggggttacagatgtgagccaccgtgtccagccttttttgttgttgttattatttttggcagcatttctaaaagtatgctcctcccatcccaagtttctcacaggcatggcgtattagcccatttgcattgctataaaggaatacctgagacatggtaatttacaaagaaaagaggtttatttggctcacggctctgctggctgtacaagaaacatggcaccagcatctgcttctggggaggcctcaggaagcttccaatcatggcagaaggagaaaggggagccagcgtgtcttatggcaagagagggaacaagagagaggggaggaggagctaggctcctttaaacaaccagccctcacatgaactaacagagtaagagctcactccatcaccaagtgggtaacaccaagcattgtggatcacaattccacatgagacttggagaggacacacatccaaaccccaggacttgggcaaggccaccagggtgcaactgtgcagtgaaagccctgagaagcccctcgatgaagaaactgcccagcgtcacctcaagctactgtcactcaagccgcagtttcccagacgtatgcggccacagaactccttttccatggggcccttctgaatacccccatggcactagcaggggcccactttggaagatccgtcctcagggacccaccaggtgctaaacaggagtgtctggacagacccaagtctcgggggcttgggggtgcaggggttggtgatggtggaaagccaggccagactcacacccttgctcttctcttgcagttggggaatgggtttttctgtctgtctgtctgtctgtctgtcttgtctgcccttatttccccttttcaaactctgggtgtttcatgtttctgtctgtcacttgccctcaccttcatctcctccgtgtcactgatctgtggtcagatggggcacagcacacagggaagaccagaaaaaagagctgcaagccaggctgctttcctgctttgcctgagctgccaagccctgagttccaagtccatcagcaggccctgttccaagcacttcactggcactaatgcattcatcttggctacaaccccctgggcgggcacagatgcgcccactttatagaagaggaaagtgagacccagagccctgtgggaacttgcccaagatcttgcatctacaaagtggcaggaaggtggcaaacccaggcagcccggctcccaagcccacactccttaccaccccctgccctgcctctcaggcctctgggagtcctcatggctgaacactggccttcccttgccctctgcaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctgggtgagagagggtggggctgctagggctcccctgaggggtaggggcagcacggcgagggtcctccttaagggtgaccccctacagtggctggatcaaagcgagcatggctctgaccccctcccctggtccttcctcctgcagaaccgcctcagtttgtcaaggagccagaaagacacatcactgcggagatggagaaggtggtggacatcccctgtcaggccaaaggtaatgaggtggcaccgctggagggggacaaagaccccagatcttcagcctctcccatcctcattgtggacatttctaaattccagcttcttctcgagaccatgtcactaggcagagagtctgtctggctgtctgagcaggcaccccaggaaacaaacaggccaaattaccataatctcaggctggaaatcaacctttacggtaccaaaacttgagggttacaaatgaacccaacttacagtaatttcaggacaggtgacagacccaaatttcccaaaatttgagagctgtagacaatgacaaattaccgtaatgccagaaccagcagcccccgggtgcatctcacctgagatgtgtcttataagctcagcctgtttcctgggccattttgctccatctcctctgccagctccctccgctattcctacttaaccccccttgaaagagttcctggagaatttctactttccccttccccaccgtccttccttctgattcatttccgccaaaagacagcccgcagccagggtgaaatccgggatgataaagagagaagagcgtgcacagtgggacacgctgagcaaaggggcaaaatgtgtctctgcaggaatgaggactgtgctggaggggatgagtaatgacttcccttctgagactccacaaggggaaggcaaagatccatccattcaggcagcaaatattttttgagggcttaccatgtgccgatagtgtcctcaggagtggggagatacataataaaccaaacagccagatccctgctcgcgtagaatgtaacattctcgggagggagatgggcaagctgataaacaaataaagagaacttatttcatctcatctaaaatgccatgggttgtaagatgccccattattttatggaccactaagaaagaaaaaaggcagccaattaaattatgacatgctgttgattataagacacatcctgatctcggagacgtgaccatgggaaagagagcgcatggtggattggatgaaatgtggcatcacaggctgtcaggatcaaagggtgccgggaagggaaggcaagcaggcttagtggggacagggccgtggggtgctccttggaatagggtgtggccaactcttctggggaagtcttttttttttttttttttttttttttgagactgagtctcactctgttgcccaggctggagtgcagtggcacgatcttggctcactgcaacctctgcctcccgggtacaagtgattctcctgcctcagcctcccaagtagctgggattacaggcatgcatcagcacaccaggataatttttgtatttttagtagagacagggtttcaccatgttggtcaggttgatctcaaactcctgagctcaggtgatccacccgcctcagcctcccaaagtgctgggattacaggcatgagccaccacgcccagcccagctgggggaacttatgaaaacaatgtgccaggctgagagcgaggagaggagcctcctcctttcacctccatgtgcaaagccggtatggggggcttccaagtgccccccagggaacactggaccctctacgtgctcttcgacacagggcgccattcgtttgggaaagcatcccccacttggaggttcccagagcacacatacatgtctgctaagtactgcaataaaaaataagaaattaggccaggtgcagtggctcacacctgtcatcctagcactttgggaggctgaggtgggaggaacgcttgaaaccaagagttctagaccaccctgggcaacctagcaagactccatctctacacaaatagaaataaaaaatagaataaataaattagtttgtccaatccagtttccatgctaaactgattcccggatctttactctgtcccaaagactttgagaattaccactcaaagagcatcttcctcctctccctagacccaaagtggcacctctgagaaggttctagacaccaagattcaccagggaccccctcgcagatttccgggcccggcctcctcccaagcacccctcctaggcggagaggaggcaggaggcaggttgacggtgggcccacgtcttgcccacaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagtaagttgggccttcccttgtgctgcccgtgagcccctcttcccaggacgcagctttcttccaaggtcttccgaggggcctcttgtgcatagcacgttccattaagcagataggatccccaaaggccgcctgctgcccagcagcctgggggcacagccagttaccgctgctgcctctgcagccctgagtccagagccctggaggaaatctctggtccctagaagttctctccaatgtcctggggcccaggttgcgttcacggctttttgagaaaaggagctatgaaaccaaccacgggtaccagctctggcactgcgactatccctgggttcccaggcagggctggagtaaccccattccagaagacctgctcatgtttccaaagaagaaaactggtgtttttctcttagttctcctgctcgcaaatccctttctgcccttggagtctctgtcaggggttgtcatagttgccctggccgcttcccagagctgtttttagcaatcaaaggtgataactgtgggccgggcacagtggctcacacctgtaatcccagcacttcgggaggtcgaggggggtggatcacttgagcccaggagtttgagaccagcctgagcaacatggcgaaacctcgtctaccaaaaatacaaaaaattagccaggcagggtggcacacacctgtactcccaggtactagggatgctgaagtgagaggaccactcaggcccaggaggcagaggccaagatggcgccactgcactccagcctgggtgacagagtgagaccctgtctcaaaaaaacaaaagaaaaaagatgatactgtgagtggcccataagctcaaaggtctgtgtaaatgcaaagcactggtgggctcctcaggaagaatggggatgttcaggggtctccttgagctccacggtgttcatcacccagacccacagaggccgcggacagggcagctgtggggcagagagcttgtaggtgtgccccaaaggtggctaccaaggggctgccgtcttgcttctggcttccaagtgcaggtgaacttagctctgttcccacgcccatctggcgagctccttccttgagggctgggatggggcaaggagagtgcaaagccaggaggctgccccaaccctaaacggtggccatggccgaatggagctcctggggcagggccacttagaaagtggcagaagtccccctcttggctgtggctgtttttcttttaagaagccagagccttcctttcacttttggcttgtaaaccccaacaaccttgtcagggaggatgggagctgcctcctggggtcttcagtttcccccaaatgcaggcctgagaatccaagcagtgtggggactggtgtcacctgggtccttccacagggcaggtggcataggggagtcctcatgacccctccgggcttcttccaaacactggggctccatcaagatgcctacatccttcctcgtggagggcccctcaccatggcagggggaggatgagggcctggccctcggtgggcttggaggcccctggccctctggcttgggggacatctcccagggtgtggctaaaaggccccacttctctgtttgcaggcatcgcccctaacatcaccagaggccccctggacagcacggtgatcgatggcatgtcagtggtgctagcatgtgagacctcgggggcgccccgaccagctatcacttggcagaaaggtagatggaacacaccttcagagagtgtggctgggtgatagcctagaagagtcttcagaactaggctctggagccagccaggttgggttccccacgtacacttgtgaaggtcatacactgtacaacccaagagagcatctctcggccgggcgcggtggctcatgcctataatcccagcatcttgggaggttgaggtgggcagatcaccctgaggtcaggaattcaagaccagcctggcccaaagtggtgaaacccggtctctactaaaaataccaaaattagccgggcatggtggcagttgcctgtaatcccagctacttggggaaggggctgagataggagaatcgcttgaacctgggaggtggagcttgcagtgagccaagattgtgccactgcactccagcctgggagacagagcgagactccgtctcaaaaaaaaaaagagcatccttcacatcccagccttgccaggctcaaggtccagctcttcatcttccaagacctgccatcctggtgagttactaactcactctgagcctcaggttccccatctgtaaactggtgacaataatatatataccccagggtgatgtgaagactagactatagcgtgcatgtgagggtcctgcattatgcctgggagtccgaaagcccaggaaacgataggtgcttgatgatgaatattattctagtggtggctgctgccagtctcctaccccaggcagctcagagggctccagatggcggaaccagcaaagcccaagccacctccctaaggccatctgccctgtgtgcttcctcttcacctctgtgtgtgcacactcaccttcacaactctcccctgcacacacacacatatgcacacacacgcatgtgcacacacatgcacacacatacatgcacacgtacatacacatgtgcacacatatgcacacacatgtacatacacatgtgcacacacacgtacaaacacagttgctccttcacaccggcaagccccagctcagaggtgcctcctccaaggactcaccctgccccagcccccagccctcccctccagccctacctccttcactccccaccttctcatgcatttggtcatcggcttatttacctagctcatggcctgtctccccacaaagtcaggggtgtcggttttgtccactgccgtctcccaggacctagaacagagtctggcacacggtaggcactcaataaacatttgtggggataataggggcacacctaggcacgtgcttacacatggaaataaacacatccacccagcacactcagttcactgtgcctgcacgcatgtacaaacggacatgcgacccccagatggacacatggagattcccttccttacgggggtggggggttctttaaaatagacatagtcacaaagacctgcattcccaggctcactcctgcaggtgcacttgcactctctctttctccccctctttctctggccaggaccctcccaggctgggccccaggctccctgggtccccctgcagaaggaggtctgtcctgaccagggctgctgctgggggacagcgtgtccctctctaccccacccccactccaggcagctcccgtcacttcccttcactctcttgaaggtgactctccccagaagcatcctgccgcaggatgcccgtcatcaccttgtcagagctgtccccccgccagctcccccaacccgggtgccagctgcctctgagggctgtgccgggctactgctcaccgtcatcaggaaactgcgcccccttctctgttgaagggcacgtggtgtggcgggcacaggagcatcaggggacctgggctctaggctgcccgctctgagaccctgtgccctcgtgtccgtccctaagccagaaagctctccaggtctctcagcccccaccccagccccaccgccatctgtcctcattccttccagcatttccagagccaggggcctgtggggggaccatgctgccctggagcggccagggaagggcagggtgtgcccttgggggctacaggctgacccccaccctgttttgccctcaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttggggtgagtgtgcagagccacagggctttatacatttgtgtgtgcgtgtgtacatccctgtaggtgctgaggactcaggacagctacggggcacaggctcataccaccagtgtctccatccccagtgtctgtcccagtcagggcccttctcatcagagggacagtgacaaagtggttcagaggccagggactaggaagattctgccggtgatgctatgcttggccgacttgagagaacattgaagttataggagagctgccttcatatattttagggcagaaatcggcaaatattttcaagaaagggccagatcataaatattttaagctgtgtgggccagacggtctctgtcacaacgactcaactagcttccgttttatctagaaagcagccacagacggtatgtcatccaatgggcgtggctatgttccagtaagggtttatttagccaaaaaggccacctgccggatttggcccccagcctgtagttagccgacccctgctgtaagagagcttctcaagccacttccaactttggatccacacccagcatacctgtgggccacttgtctgggctgagcccaggggtcctggtgcatgaagcactagactggaaatcagaaagccctatttttaccctggctggaccactgatatgctgaaaatatggtcctgatcgtccttagagtttggtctctccatcccatacatggtttgtgagagcaaaatttaatgagccccaactatgacgtggcttccaagaattaaagtaccagggagctcattgttctttttaaccatttgggggctttcatatggtatccacccagagtccagccacacagcccccacacctcttctcaccatgctgtctccgctgtatctttcagctcggacccgcatcaccaagcccccccaggatcagagtgtcatcaagggcacccaggcctccatggtgtgcggagtgacccacgacccccgagtaaccatcaggtactggctctgctgttgactccaggcaagaggggagggggagcctctggcaatagcttgtagctgggcgagtgtccacattagggaggtaacagctgcagagccacgccttctcctgggcagtggcatttccagagctgagtgcagggctgagaggtagggggtatgaaataaacacccgggaactgagctaccctgaattgagttaagccagtttccaaggtgggaggaaaagaggaaggggtgcagaaagatgaagtaagaggaatggaggagggggtgagggaggggaaaggaagaggcttgtgggttagtgagcatggaagggaaggagctgctgtctctggccctggacgccactgctagtgtcccccagcccaccccaagtctttggccctctggcctctgaatgggcagcagaggggtctgggcaggcggatatgggatcagctataggggtggggcaggagatgacccctggggggaccctgcaagagaagcacatgtgggaaactgagcctccaaaccgaggtcaccccaccatcttccatggccaagccgggaccttggcaagggacttggcttccaggtaactcagtcccgcctctgtggaagccactaaaagggctgggaggaagcagccaagaaaggtataaaagccgggacccctcccaagcacctgaaccaaaccctacccccacccccaaggctttggaagctaaaaccaggaggagattgtccctgccttctcttccttgagctccagaatgctgagggaaatgcaactgcttccttagaaataaatattccctgcgtgttgcttctctattttatgagcaatatcactgtcaaagcaactggcaccgaggctagaaggggccggcgctcctgcactgggagaaatggcctcctcctcatgccgaaggcagctgcgtcctggggcgccatctggtggccactggacctatgacagtctgtacagccacccccaaatgagactccggggagcccaggttggtacaaggggctccaggcttttggccaacactgattctcagagaacatatcagcggccccagtttgagaaacacctcatgaagtgttgaccacttaaggcagtcatcacatgacgctagcacaaatgcaaaaatgtacgtagatgtattaatagttagaagatttttgactgagattccagaatatgcttatttctgggtttaatagatttttcttaaaaaattaacataccaactgtaaaaaaggtcctgggagagaacccacatagaatactgctgtgtatctcgggcccattcattgtgtagtagctatacttttagcattcattaatagggaaattctgaaattcagtatactttaaatcagactttatttataaaaaagatgacttacttataaaaagtgtcaacttatttgagaaagacatacattgtattcattctctagacagttactgatgcataatgggattcgggggtctcttgcaaagtaacctgcagacccactctgtaggcccttccagtgaactgcaggtcagaaatccctgtaccaggttactgaagggaggtcctcgccttaaacggaattaaccatctaggaccatcttttcatcaaagggatgattctggggagcagaatcatccctttatcccccccaaaattggcaaagtctatgcccaaggccaccccagcagctcccaccccagtctgtcttccttggactggggggacggggacatcccttctaccctccgtcttgaggtagatcttggggatggggtgagacccagacctcagcaattttaagaagctccccaggtgattctaatgtgtcaccaggattgaaaaccctgttctatctgcaaaacacagcagggttccctaagcagactattaggtgggtgcaaacgtaactgcggtttttgcctttgaaaggaatggtcaaaactgcaattacttttgcaccaacctaatagaaaggatctcaacaaccaaaccagactaaagtggtgccgctgaatcctgagtgacacgtcctcagagcaaagccaggtgcaggggtgagggcctgggcgggtgcaggtttctagcatgaaaacctccaaaatagttctagaaaaaaacactctggccaggcgccgtgcctcacgcccataatcccagcactttgagaggccgaggcgggtggatcatgaagtcaggagatggagaccatcctgtccaacatggtgaaaccccgtctctactaaaaatacaaaaaaaattagctcagcctcccaaagtgctaggattacaggcgtgagccactgcgcccagctggattttggccattctaatagctgtgctgtgatatctcgttgttgttttaatttgcatttccctaatgacatatgatgtacagcatcttttcatttgcctgttggtcttctgtgtaccttctttggtgaggcatctgtcaatgactattttttaatcagattgttttcttattgctgagttttaagagttctttgtagattttggatagcagtgctttatcaaagatatcgtttacaaatattttcttctagtgtgtggcttctctttttattctcttgaaagtgtctatcaaagagcagcaatgtttaatttaatgaaatccagcttatctgttctttctttcatggattgtgccttgggtgtcgtatttaaaaagtcattgccaaacccaaggtcatctagatgttctcctgtattatcttctaggagttttatagctttgcattttacatttagctctgggatccaatttgagttaatttttgtgaagggtgtaagatctgtgtctagattttttttttttttttttttgcatgtggatgtcaaggttttccagcactgtttgttgaaaagacttcttttttatttttatctttgtttttgttttgtaattgatttgttggagaaaccaggttctagaagacagaggtcagcaatctttgctgtaaaggaccaaaaagtaaacattttaggctttaagagagccatatggtcttgtcatgactactcaactctgtttatagtgccaaagcagccatatgtaaacaggcactaagtaaacagatgggcatgtctgtgttctaataaaactttatttacacagacaggcagcaggccatagtttgttgatcctgctatggaatattcaacactctggattggcctggctgctgtctcacagtgttgttaacctgttcttctatcctctgtatttataattcaatttcagtaactgctaattagattcatgttcaattgttttggcacaaatacttcacaggcagtgatctctgcttcctaaagcaccacattctgaagcaaagaatgtctgcttgccataggctatttcttttttttctttttttttatgagatggagtctcgctctgtcacccaggctggagtgcagtggcaccatctcggcacactgcaagctctgcctcccgggttcacgccattctcctgcctcagcctcccgagtagctgggactacaggctcccgccaccacgcccggctaattttttgtatttttagtagggacagggtttcaccgtgttagcaggatggtctcaatctcctgacctcatgatccgccagcctcggcctcccaaagtgctaggattacaggcatgagccaccgcgcccggcccccataggctatttcttacatgggaattactctctgcaactaaatttgcttttaagtaaaattctgcccatcctgtgagtgctggcaagtcctttctaaataaagggatgaattgaaggtgattactgttgttgatttgtaaataggtattaaaagacttaaaaattaactcaacgatttcactgctgagaatttgtccttgaggaaatgatttggaatggttgtaaacattttgccataaggaccacagctttaactataatattagaaaccaaggagctaaactggatgtccaacattatgggatcggttaaattacaaaacagctgtactgacacatgtgcatccaataaaaaatcatggtgtggaaatatcacatcaaaaagagtttatgatatttttattgagtcaaaaagcagctttaaaaacaggatgactggtcaggcgtggtggctcaagcctgtaatcccagcactttgggcggcagaggcaggcggatcacctgaggtcaggagttcgagaccagcttggccaacatggcaaagccccgtctctactaaaaatacagaaaaaaaaaaaaaaaaaaaaaaaaaaaagcccagcatggtggtgcaggcctgtaatcccagctaccagggaggctgaggcaggagaattgcttgaacccgggaggcggaggttgcagtgagccaagatcgcaccactgcactccagcctgggcaacagagtgagattctgtctcaaaataaaataaaataaaatataaaaataggatggctgaatagattgctgtataccattcatgtaaatatactgtatcatttaaaatatgtaacaaaggctaactgttactgaccgcttgccgtggttcaggcacttctctattttatattagcttgcacaatcctcacagcagtgctatgaggtgggtggtgttagtttcctcatattacaggtgaggcaactgaggcctagcaaggttaaataaactcacccaaggccaggcgtggtggctcacacctgtaatcccagcactttgggaggctgaggcaggtggatcacttgaggtcaggagttagagaccagcctgaccaacatggtgaaaccccatctctactaaaaatacaaaattagtcgggcgtggtggtgctcgcctatagtcctagcaactcgggaggctgagccacgaaaatcacttgaacctgggaggtggaggttgcagtgagtcaagaccgcaccacggcactccagcctgggcgacagagccagactctgtctaaaataaataaattcattaataaattagctcacccaagatcacaaagctggaaagtagcaaagccagcatttggcctgagagtctgactcctgaatgcagcagtgctgcagtgcactgcctatccgggcggggaagaagggtctggaagatatgcacacattcaaatgttaatcgtggttccctagtatcagaaaacttttgagttttctttttcttttcctttctttttttatttttcttacccgtactttttacttttctgttggttctgcttctgttttttgggggggctttttgtgtgtttttgagatggagttttgctgtgtcgcccaggctggagtgcagtggcaccatctcggctccccgcaacctccacttcccgggttcaagtgattctcctgcctcagcctcaagagtagctgggattacaggcactggccaccacgcccggcaaatttctgtatttttagtagagacagggttttgccatgttggccagactggtctcaaactcctgacctcaggtgatacacccacctcggcctcccaaagtgctgggattaccggtgtgagccatgcacccagcctggttctgcttttgaaacttaggttaaaaatattacagattcactctccctagttatctgacattatgtaaacccagatagtcctgggagccagcagctcaggcccccaccctgtaccccagctgaacggggctatttgcaaagcatctcagccaccaccgggttcctcacacttgtactgagaaccaaggccaacctcgcctggggtcattgtgtggcatcctgccctccagggctggcactccctgtatgttgatgacaatgataatggttctatttcctcaagaacaaattcagagaagatattttttattgtcaagcactgatgcgtgtgtaatttctcaagccccatttgtattgactgaccgaagctaaagggatttttttggacactatagtcaatttgtcacactgatgcattgatataatgattcccctcataaaactaattcagaaatgtgactatgaggaaacttgcattccttttttcagctgtaatctttcagcctcttcagaagaatacctttcactggctgttttgcaagcgcttctggccagaagcaacaacgctttgacccaacctgaactgaaggtgtaacgaccaataatgactgaatgcgttcgctctcccactctcctgcaccctccccgcaggaacgatgggcttccagactgcttggccttcaacagtgtcccgctccccgatcccagtgtcctgcctggctgttgcctgcagttgtcctctgcccagctttggagctattttctcgggacaagcttcaggctaggcccactcccaaggtaccttcctctccctctgtacttacgggttcttcttacttttaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggtaagggcagccctcccaggccccggcagaggcggtccaggcaatagcaactggcatgctcagagccagccgagtccctttttcagatccccaggccacgtgtgacctgaactgttcagctttgctcaggacatacccccagcatccttccaggcctttctctcagctctgttaggccctccgtcaagagcaggggggtgtgaggatggctttagcaggagggctctggttccagagagaaaaatctccaggtagatggcccgaaggccacattttacgtctaagcatgcggtatcatggaagctcaaggcctacacaacctgtgtccacagcgcccccgtcacctgcctgcagaccacatagggatgcctgaccacgtgtctcttttccaggcaactgccccacgcgcccgagcacccagtggccactctcagcaccgtggaaaggcgagccatcaacctgacgtggaccaagccctttgatggcaacagccccctgatccgctacattctggagatgtcggagaacagtaagcttcccgtggtcacctccaacacctcccgcccaagcttggacttaggagtcagccctgggctggggtcccagctctcctgcttcctagttctgggcctttgagcagatccttccctctggcagcctcagcgttcccatctctgaaggaaacacaggcatctgcctgtcaggccctgttacagttgaaagagatgactcacaaaaggtgcttaactcagggcctggcacagcagaagccgcaaagaaaatggccagtatttatttattatttatttatttatgtattccccaagtcaaatgagcaggcataattcgcgttgcattttatttatttattatctatttatttatttatttatttattcatttttgagacggagtttcacacttgtcacccaggctggagtgcaatggtgccatctcggctcactgcaacctctgcctcccgggttcaggtgattctcctgtctcagcctccgaagtagttgggattacaggcatacatcaccatgcccagctaattttgtatttttagtagagatgggatttcaccatattggtcaggctggtctcaaacccctgacctcaggtgatctgcccgcctcagcctcccaaagtgctgggattacagacatgagccaccacacccagcctgaatggcattttaaacacagcttgcctagagctcatcaatttgtggggggtagtgggggagacaaatgcatctcagttcccataagcccttactttcctccggcaccctccaccgtctcctccccagggtcgtgtgagctaatgggacctagaaaaatggcatggcgggccactcctgcaccaagctggggaggctctctcttgccagccccagtgaagctggaccctgctgggagtggggagtaagaagcatgcttcatcccacccaagatacccacttctgccccactcactgtccctgcagatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagaggtgagggcactggcgctctacaggggcgtcgccaggactccaacaggcaggggctgcagccgaaaccgatgtggcagattctggctcagctcctcctggccccctctaggcttccgcctctgtagaaggggagagcaatcctgatgagtgcctcaccaggatgttgcaaaggttaaatggggtgctctgagtagggcactggggaacgcggtgagcaccaaccaaatgtagtcatcccagttactgggagctgtgcaagcaaaaaggctcacctccttccactccacatccgcatgggctgctgtcattgttaaatggatgcaaaattccagagatacaggatctacacagatctccatatccatgtcttgcacgacgccaggccctgctagggttcccgcaaagcttttataaaatgatggaaattgctgggcacggtggctcacacctgtaatcccagcacgtcaggaggctgaggcgggcggatcacctgaggtcaggagttcgaaaccagcctggccaacatagcaaaacccagtctctactaaaatatgaaaattagctgggtgtggtggtgggcgcctgtaatcccagctactcgggaggctgaggcacaataatcccttgaatcagggaggcaaaggttgcagtgagtcgagatccagcctggatgacagagcaagactgtctcaaaaaaaaaaaaaaaaaaaaaaagatggaaattgaataaaagctacagatgcttcatataaaaacatcacacggtgatacccatctatgtagaaggagaattctatcctctccagctccgtagaacaagcagccacctctagcaagaaagatgtcatgggagaggtcagaacaaccgtgatacaaatcacgtgcgcaaagccttgcacttggctctttgaaagacgcctggggcttaaatcaatcatggtggttttgccacagttgcaatgagcttgggtctctctggcttgtactaaggtagcaccactggggtcaaacaatctcacgggagggagcagtggcaggtggcagcccgtgtggagagcagttacagggggatttacatactcactgtttactgagcagctaccgtgtgccatgccacgtttggaccactggagggaggacagggaatgaacagacatagccccagtgcatctggagatacacaatcccaacaacagagaggctgaaagtgtaggggaagctaccctgcaacttctcctgccctgcggctgcaccgcatcacactgactcaccttcctaatgtaccttcatgcaaaccgccctgagtcaccaagaaaaaggccaaatcctcacgcttgtaatcccagcactttgggaggctgaggggggcggatcacttgaggtcaggagttcgagaccagcctggccaacatggtgaaaccccatctctactaaaaatacaaaaattagccaggcatggcggcacgtgcctgtaatcccagctattcaggaggctgagacaggagaattgcttgaacccgggagacggaggttgcagtgaggtgaaatcgtgccaccgcactccagcctgggggacaagagtgaaatctttcctcaaaaacaaaaaagaaaaaggccaaatcacccttaccccagcctctacaaaaacacaggagcgggccaggtgcagtggctcatgcctgtaatcccagcactttgggaggcagaggcaggtggatcacctaaggtcaggagttcaaaaccagcctggccaacatgatgaaaccccgtctctactaaaaatataaaaattagccagccctggtggcaggcacccataatcccgctactcttgaggctgaggcaggagaattgcttgaacccgggaggcagaggttgcagtgaggtgagatcatgccactgcattccagcctgggcgaaagagcaaaactctctcaaataaaacacgggagcgagcagcatgcttaggaaagctatccatcaaaaagcaaaaacataaacaaaaagggaaagtcatccatcaaaaataattaacttttgtttggagtggacacgtgtccgtgatgtgaaaagtacacttaggcagaacacagcatcccccagcaatgccagagaaagacgtgctgtcgcgcttggctccccgaggcagggtgggtgtccttggctctctccctcacacgccatgcccgccctgctcctgcctggggctcagctggccagcaaaggaggcctagttaaggtacaccagcagctgaccagtgggatgtgaccaacatttctgcttatagaacacttggacactcatgacctcatcagccccaacagcagcttccttgacaaataggaaactgaaacttacatccctcaacggcaccaaaaacatgtacattaattttttttttttttttgagacagggtctctgtttcccaggctgtagttccgtgatgcaaacacagctcactgcagcctcaacctcctgggctcaagccatcctcccacctcagtctcccaggtatttgggattacaggtgcaagtcaccaggagggagtttttttgggttttttttgttgttttttttggtagagacagggtcttgccatgttgcccaggctggttttgaactctggccctcaagcaatcctcttgcctcagcctcccaaagtgctgggattacaggcatgagccacagcatctggccttatagtttttaaaagacatatacatatatccacatatacacagagactatatatgtagtatcatttgagcctcaactagtctcataaggcaggcaagtagagctttattataattcttttatagaacaagctcagagaagtcaggtaacttgcccagatgcacacagcagttgtaccgaattatccagagtcagagcaggccagggttcagccttctcatatcccattcaactcctgtgtttgaccccaagactaagagcattggtgttttgtgatccagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtgggtgtccaccctggggacaggagcccagtcccaaggggaaaggcatgggggaagatcgggagtggactggaaaacagtgcaaattcatggcaggcccttcgccatctaggaaggactaggtaacaagaaatgcctactcagtagtaggaaggatttaggttggacacctagtagaacttccagtggcaagacccctggacaccagcgaggaatgcttgagaggggaggctatatgggctgacataggaacaggcctacaaggagacaggagaagaaagaagtaactttccaaggggcaacgctctgggaagccgcgaatattccatcacaggccagaattctcttgacccgtgagtggagaaaccagctggccgaagaattgatggaaaagtgaaagttctttctttggttattactggaaatgaagcccagttatacagacccttatctttgcatttgactgagggactactcttctagtaacctaaatgggagtcattaagggtcactaaaatgtggtattcataagttcaaattcataagttatctgaggttactgagaactctcattgatattctagattctggctacaaaatgctatgcaacttcgtgtgtctcattcctgcatgtacacaccctcacaggggtttaactgctccactattggttaattttgttgtgggtttttcactaatcctgaagggcggtggttctcaaagtgtggtcccagcacccatggcatcagcctaacctgagaactggtcagaaatgcaaattatcaagtctctccaagacctaccaaaccagaaactttaaggataggcttagaaacctttgcttttaaaaaaatctttcaggccgggcgtggtgtttcacgcctgtaatcccagcaatttgggaggccaaggcgggtggatcacggggtcaggagattgagacaatcctggccaatatggtgaaaccccatcttcactaaaaatacaaaaattacctgggcatggtggcacacacccgtagtcccagctactcaggaggctgaggcaggagaatcacttgaacccaggaggcagaggttgcagtgagccaagatcgcaccactgcactccagcctgggcgagactccatctaaaaacaaaaaaaaaaaaaaaaaactcatctaggagactttgatgcatcttcaggtttagagaagcagtgttttagggcattgtaatgcatcagaatactttgaggtccttaattttccaataattagatgctgaattatatatgcatcgtgtttctcaaatgaatgacccatcctttgtgtctgacccccaaaatttgcttgtacacatttacttctttagtgctgtgagttctttttgccagtggaggtagaaatgggtcgagtaggtagcccaggtgtttcattccacctgggcgagtaactttcagaagagggagccttgtatcctagaggaggaaagaaaatgagcccaggcttcagggacagctctccagtccatgacccctccaaggctgagacctgcaagttctgccctgggacctctcagtgcccctggttagcaatcctcccccatcaaatagaatagtccagacacatcccctagacctctgctacccagtaaggtaaccattagctagctctggttacttaaattacagttgacccttgaacagtgtgggggctaggggtgctcaccccctcacggttgataatccatgtataatttattttcttttttttttttttgagacagggtctcactccattgcccaggctggagtgcagtggcgtactctcagctcactgcaacctccacctcctgggctcaagtgatcctcctgcctcagactcccgagtagctgggactacaggcatgtgccaccacatccggctaatttttttttttttttagtagagacaagatttcatctttttggccaggctggtctcgaactcctgacctcaagtgatccacctgcctgggcctcccaaagcactgggattataggtacgagccaccatgcccggcccaatccacatataatttttgactccccaaaaacttaaatactaatagcctactgctagccagaagccacacctataaccagtcgattaacacgtatatttttatgcatttatgatataactttttcttaattttttcaatgtttctaggccatgtgattcatctgcgagttttttcaaattgtcacaaatctctaaaactttttctgatatgtttatttttaaaactctgtgtagctgggcatggtggctcacgcctataatcccagcactttgggaggctgaggcaggtggatcacgaggtcaggagttcgagaccagcctggccagcatagtgaaaccccatctctactaaaaatacaaaaaataagccaggcatgggagcgcatgcctgtagtcccagctacttgggaggctgaggcaggagaattgcttgaacctggcaggtggaggttgcagtgagccaagatcatgccatagcactccagcctgggtgaaagagcgagactccatctaaaaaaataaaataaaataatagttctgtgtgtacgccaacctgtacagttccaacctgtgttgttcaagggtcaactataagcaaaactaaaacaaattctaattcaggccaggtatagtggctcatgctataatcccagcactttgggaggctgaagtgaggtaggcagatcacctgaggtcaggagttcgagaccatcctggccaacatggtgaaaccctgtctctactaaaaatacaaaaattagccagtgtggtggcacatgcctgtaatcccagctactcagggaggctgaggcaggagaatcacttgaatctgggaggcagaggttgcagtgagccgagattgcgccactgcgctccagcctgggtgacagaacaagactccgtctcaaaaaaaaaaaaaaaaaaaaaaattgaattcatttcttcggttgcactaaccacatttcaagtgctcagcagctgcatgtgctggcgggcaccctgtcggacagcacaggtgcagagcacttccgccaccaccggaagtcctattggacagcgctgctctggacaatttcctgggtacgaggccaaggaagctgactctgactccactgtgcctcgcctcttcccctcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggaggtaggtagagactgtggtctcagaccaggcgcggtggctcatgcgtgtaatcctagcactttgggacgccaagacgggaggattgctcaagcccaggagttttaagccagcctgggcaacatagggagactccatctctacaaaaagtgaaaaaaattatctgggtgtggtggcatgctacatgctacagtggcacagctactcaggaggctatggcaggtggatcgcttgggcccaggagtttgaggctaacctaggcaacatagtgagaccctgtctctacaaaaaatgaacagaactagctcggtgtggtggtacatgcctgtggtcccagctactcgggaggtccccaaggctggagcctggggaagttaaggctgcaatgagctgagatcgtgccactgcacttcagcctaggtgacaaagtgagactctgtctcaaaaaaaaaaaaaaaaaaaagtgaaatgaaatgaaaagagactatggcctcagaggagcaggtgcttccccttctcccagtcccatgcctgttgggttctgtgcctgtccaggcccgagagccttggctgtgtggcctgttctcaccaggcccctactattgcaccctggggctggaatcaccaccccaggccaatctaccccacagggtgggaggactgaggggaagaggaagaggaggctggcttggacatggtgaagggcagaggctccaggcatatggggaccttctgtgaatttcatgttaagtagatcatgaaacagcttacttttagcattccacctgaaaaccatgccagagcatttttcatccgcacccctcttatttaccagtaccctgtgaggtgggtcaggcaagtttttttaaacgcaaactaatccagagagaatatgaaggcctcttaagtctacacagcgagggaggagttggggtggggtaggggggtgcaaggcagaggctatagcccccacccctgcgttttctctactgaactgggcaagagagactgactgggccccctccaccccaccccgttctctcatctcctctagttcccacggtccctccgggcaatgtgcacgcggaagccaccaattccacgaccatccgcttcacctggaacgcccccagcccccagttcatcaacggcatcaaccagggctacaaggtacatgaggcatctcctcacccaagaggaggccctaagatcttctggagggggtggggagaggggacagagtgggcaggaggaaatcccccctctgtttctgaagtcattggctcgagtcaagctagggacacacattagaggaaaagagttccaggccttccccaaggctacatgtgggccacaggaagtgcagacactgccctgactgacactcagtgctacggtccttcccagcgagactgggttatacacaaaacccaggttatttcaggctcagaaacacctggtgtaggggccgggcacagtggctcacatctgtaatccccaatttgggaggctgaggcgggcagctcacctgaggtcagaagttcaagaccagcctggccaacatggtgaaactccgtctctactaaaaatagaaaaattagctgggcttggtggcaggggcgcctgtaatcccagctactcgggaggctgaggcaggagaatcacttgaacctgggaggcggaggttgcagtgagccgagattgcagccattgcactacaccctgggccacagaatgaaactctgtcccaaaaaaaaaaaaagaagagagagagaaaaaaaagaaaaagaaacacctggtatagccatggccccatgagaaaaatccaccattcacttcttaccgtggctcttgtgggcttcatgctcaaacgtatccccaggctgtactcgactccacgtagtgtgtggttaatggcacaggattaggactcagacagacttggtggttaaagtcccagctttgcctcttgctggcaacctgcgcatgttctttaatatgtctcagcttctgtccttcaatcaatatttattgagcagctactctatgcactgctcgcaccgctgaataactaaaataaactcagttttctcatttgcaaatgaagatgataatacctgcttcttggagttgtgtgaggattaagtgagataatatttctaatttgttcagcacaatgacaaacacatgataaccacttggaaagtgattttagtggtcgtagaaatgcatttgggctgctataaccaagtaccacagactggattgcttaaagcaacagtccccaaactttttggcaccagggaccagtttcatggaagacaatttttccatggattggagtgggaggagggatggtttcgggatgattcaagcacatgacattattgtgcactttatttctgttactatcacattgtagtatataatgaaataactatacaactcaccacaatgtagaatccatgggagccctgagcttgttttcctgcaactagatggtccgatctgggggtgatgggagacagtgacagatcatcaggcattagattctcataaggagtatgcaacctagatccctcacatccacagttcacagcagggttcacgctcctgtgagaatcgaatgctgccactgatgggaggtggagtttaggtggtaatgtgagcactggggagcagctgtaagtacagatgaagcttcactttcttgcctgccgctcacctcctgctgtgcagcctggttcctaacagaccacagactggtacctggtggtccgtgggggattggggaaccctggcttaaacaacagaaatttatttttgcacagttctggggattagaagtacgggattactgtgtgggcagggttggtttcctctgaggcctctctccttgacttctaggtgtctgtcttcactctgtatctgtgtccaaagagatcttggctcactgcaacctccacctcccgtgttcaagcaattctcttgcctcagcctcccgagtagctgggactgtaggcatgtgccaccatgtctggctaatttttttgtattttcaatagagatggggtttcaccatgttggccaggctggtctcagactcccaacctcaagtaattcgactgcctcggcctcccagagtgctgggattactggcatgagccaccgcgcctggcctaaatgtcctcttcttatagggacctcagtcacattggattagggcccacactaatgacctcatttaactacctctttaacaattctgtctccaaatacagtcacattctggggtgctaggggttagaatttaaacatacagattttgcagacacaactcagcccataacagataataatagtaataatagcagtagaccaggcatggtggctcatgctgtaatccttgtactttgggagtctgaggtgggtggattacctgaggttgggagttcaagaccagcctggccaacatggtgaaatcccatctctactaaaaatatatatatatacacacatatatatatacacacacacacatatatatatgtatatgtatatgttccaggatatatgtatatatgtatatgtgtatatgcatatacatatatgtatatgtgtgtatgtgcatatacatatatgtgtatatacatatatacgtatatatacatatacacatacacatatatacgtatacatatatacgtatacatatatacgtatatatacatatacatatatacgtatatatacatatacgtatatacatatatatacgtatatatacatatacgtatatctacatatatatgtgtgtatatatatacgtagatatatatatacgtatatatatatatacacaaacacacaaaaattaactgggcatggtggcgcatgcctgtagtcccagctactcgggagactgaggcaggggaattgcttgaacctggaaggcggaagttgcagtgagctgagattctgccactacactccagcgagactctgaccaaaaaaaaaaaaaaatagcagtaataatagtagtagtagtacatttgctctccttccaactgagctaaaggtcaggacttctcagtcctcccatcctggaacacagacctcagagcccaggcccggttctctcgtgtcattccacgtgggccccgtgcctgtcctccccacggaggactaaagacagagcacagcatgggggatccacactatgttttaaaggggtaggacctgcccccagcaacgtggggcagacggaaggatgccgtccactccctccagatgtgggaggggaggcagagcatttgaggggaggccagctgtgaagcggagagcactgcaggccctgagcttcagtccagggaacgcatgacctcgaggtgaccactgacacatcccgaaggttcctgcacccctctgcactgtgcttgccacaactaagattaattctaggactcgctgccttagcggttcttcctccaaagtgggggaggctggacaagaagggactgggatgaaataatgaagaggagtttctgctagtgttgcaagcaaacaaaggagggatggtccagaactggaaatgacccagcttcactccggccttggccctctcaatcccaggaaggcagtgaacccaaggtcgagcagagctttgcagggcagggagcagcagctgaattcttggagcactcgctgccggaaaactctcctaattgggaccctggggggaggcagaggaaggaaggggaggccggcattgctgaagagcagaggagctgaactgggaacaattagcttcttgctaccaattctaagcacaagttttattctacatatgggagggctgagctacaaacttttaaggcaaacagctcccccgagggccaggaaggccagcccatggccaggacaattagggcagtggcccatggtgacccagagcaagaggaggtggcagaggccactgaattcccaggtccagtcagtgcccagcccccagtagctactcgataaaggtcagcaggagtgaattgcccagatgttttgagcacagaaactggtggaggagtaaggagacctcacacttacagggccctttctctgggccaggcagtacactaaatgcttcgctcacatttatctttcatgcaagcagcacagggactctaagaagcagcattatcggccaggggtggtggctcatgcctggaatcctagcactttgggaggtcgaggcaggagatcacttgaggtcgagagtttgaaaacagcctggccaatatggtgaaacctcgtctctactgaaaatacaaaaattagccaggtgtggtgacacacatctctaatcccagctacagacataggaggccgaggcaggagaatcgcttgaacccaggaggcggacattgcagtgagctgagatcacgccacttcgctccagtcagggagacagagctagactctgtctcaaaacaaacaaaccaaacaaaaacaaaaaggaatattatcatcacaccattttacagagaaagaaactgaggcaccagagggaagttacttgttcaaggtcaaacacagtgtcaaggtcatgcaaagctcagattcaaaccagagccttcacttttccttacattaaaaagaaatgtcaggctgggcaccgtggctcacgcctggaatcgcaacactttgggaggccaagacagggggatctcttgagcccaggagtttgagaccagcctgggcaatatggcaagactccatctttacacacacaaaaaagttagtcaggtgtggtgttgagtgcctgtgatcacagctactcaggaggctaagacggggaggattgtttgagaccacgattcaaggctacagtgagctgaaatcacgtcactgcactccagcccgagtgacagagtgagaccctgtgtcaaaaaaagaaagagagagagagacagagacagacagacagacacagagagagagagagaatgtattatttttaattgtagataacattttcaataccaatgaataaaagcagcagagatttttttcctctgcttctttagccttcagcatatcacaaggagaaaaaagcagtgtttgtcccttgtatacctccaataagaatgagcatttttccccttttgtgttttttttttcttccttttttttgagatggagttttgctcttattgcccgggctggaatgcaatggcgcaatctcagctcaccgcaacctctgcctcccgggttcaagcgattcttgtgcctcagcctcccaagtagctgggattacaggggcatgtgccaccatgctcagctaatttttttttttttaagacagagtcttgctcggtcacccaggttggatcttggctcactgcaacctccgcctcctgggctcaagtgattctcctacctcagcctcccgagtagctggaactacaggcatatgccaccatgcccggctcatttttgtatttttagtagacatggggtttcaccacgttgaccaggctggtctcaaactcctgacctcaaatgatccacccaccttggcctcccaaagtgctggcattataggcgtgagccaccacacccggctgcccccttttaattgtgaaaattttcaaacatccacccaagtagaggaaagactgcagtgaacacctgtatccccattcccagctttaacaatgcccaactcccagccaggtatgttccatctctgccccaaccctctgcctttcccttggaacattttgaagcaaattccaggcattgtatcagttcatccatgaatgtttctggaaagaaacagtatagatgagatctctatttaaaataaaaccacagtaaccgcattatcattatgatagctaaaaatatcagcaggccctgtaatatcatcagatatccagtcagccttcaaattctcttgattgccgcataatctgttactcgtggttttatttgcttcaggatctaaatgaagttcacacaattgcagtcagttgaggggttttttttaggtctcagtcgatctatagattctttctctctctctctttctctctccctttctctttcttgtaatttatttgggaagaaacttagtcatttgtccaacagaattttccacagtctggatttcgctgattgcatccctgtggggtcattcaatgcattcctccaaacaatatagttacaatgaattgtaacttaaagctagaggctaatctgattcaggtttgattttttgttatttgaaatattttacttcggggtgtgatggctcacgcctgtaatcccaacactttgggaggccaaggcaggtggatcacgaggtcaggagatcgagaccatcctggctaacacggtgaaaccccgtctctactaaaaatataaaaaaaaaaaaatagccaggcgcagtggcaggcacctgtagtcccagctactcgggaggctgaggcaggagaatggcgtgaacccgggaggcagaggttgccgtgagctgagatcacaccactgcactccagcctgggtgacagagcgagactccatctcaaaaaaaaaaaaaaaaattagccaggtgtagtggtacatgcctgtaatctcagctactcgggaggctgaggcagaagaattgcttgaattcttgaggcaggggttgcagtgagcagagatcacaccattgtactccagtctaggcaacagagccagactctgtctcaaaaaaaaaaaaaaaaaaaaaaggaaatattttacttcctagatggtgttatgtattttgatcagaaagcacaaagtccggctgtctctcttactgtgaagtcaaccactgacagtcatctatgagctatcatttcaataagggttataatatggggataggcaaatattatcatttcttcttgacttagtagctgaaatgctttcaaaaacaagaattttccctttatcaactttttggttacctgaagtttcagtttatctaggaaaagcagggtaagcatttaattattttcccttacttaccaaatttttcgtacaatgaattggttctggccaggcatggtgtatcacacctgtaatcccaacactttgggaggatgaggcagaggcttgcttgaggccaggagttcaagaccagcctaggcaatatagtgagactcccccgcccccgccatctctatttctaaaaaacagaaaaaataaagactaaattgattccttattgtcttatcaggtaacagatgagcttgggttggagggggacgtctttctgttttgttttgggtttggtagtattattagataaccaaggattttttttgttttgttttttgttttacaaatctgacatgtttcaatccattaccattattatgcttcttaaatggtactgggtgctgccagttcagtggtacaaatggacccatcattggcctcttcgacttgatggtgagccctcttgacgtggccccagtagtctctgatagcttccttgcaatttggtatgacaagatgttccagactattatatatacattcccctcactgtgccaggcatcggccatttctttaaggggctcttgttgctttcagtgagaaatgatagttagataccacagttttagcacttgcattgcatttattccagaaatggttgttgtttctaggccctgttaatggctagctaaacaatattttttaagatactatagatactcacactttcaattccatttcatgatgacagactctttaataatctcattggtcttttgtccatactgaaaatccagttcctacaataccagcattttacccacctacgttattcccacaaacacacacaacactttcagaatagtcatatccacactatgattactgaacgtagtttccaattattgccattcttcttgttcctgaggtatatccctctagggatggacttcgcactgcattgctaagtcttttgaagtcatttctctctgtaattttaccacagctcaatactctattagttcatttgcttcattgtggttttgatttttagggattgattttttaatttaattttattctataattacgttgaatatttacataataaagtcaaatccacaaagcaaattcagagaaaatcagcttcaatccttgtcctctcactcccctataggtctgattgctttctgttttcttggtttggttttttcttccatttttttaatataaacaagtacaggccaggcgcggtggctcacgcctgtaattccagcactttggaaggccgaggcgggcagatcatttgagatcaggagttcaagaccaccatggccaacatagtgaaatcccatctccattaaaaatacaaaaaaaaaaattagctgggcgtgatggcaggtgcctataatcccagctattcaggaggctgaggcaagagaatcgtttgaactggggaggcagagattgcagtgagcggagatctcgccactgcaccctagcctaggcaacagagcgagactccatctcaaaaaaaaaaaaaaagagtgtagtaggcccttcttagccatggattccacatctgtggattcagccaatctcataaggttctgaaaatattcagacaaaaatgcatctatattaaacatgcacagagttttttgtcattattcccccaaacaatacagtataacaactatttacatagcatttatattgtgttatgtattacaataatctaaaggtgatttaagatatataagaggaggggccgggcacggtggctcatgcctgtaatcccagcactttgggaggccaaggcaggcggatcacgaggtcaggaaatcgagaccatcctggctaacacagtgaaaccccgtttctactaaaaatgcaaaaaaaaaattagccgggcgtggtggcaggcgcctgtagtcccagcaactcgggaggctgaggcaggagaatggcgtgaacccgagaggcggagcttgcagtgagcggagatcgcgccactgcactccagcctgggcgacagagcgagactctgtctcaaaaaaaaaaaaaagatatataagaggaggtgtgtaggttacatgcaaatactacacctttttatatcaggtacttgagcagctgtggcttttggtatctgcgggcggtcctggaaccaatcccacatgaataccaatgatttgctgtacatgcatacataaatgtgtatgctctgcttttaaaataagtgacaatgtactttccacattctagagcttnnnnnnnnnnnnnnnnnnnnnnnnnnnnnnnnnnnnnnnnnnnnnnnnnnnnnnnnnnnnnncccaggctggagtgcagtgtcgcaatcttggctcgctgcaacctctgccttccagtttcaagcaattctcctgcctcggcctccagagtagctgggattacaggcgccagccaccatgtgcggctaatttttgtatttttagtagagacggggtttcacatgttagccaagctggtctcgaactcctgacctcgtgattcgcccacattggcctcccaaagtgctgggattacaggcgtgagccactgtgcccggtcccctatattattatcactatttagaatgtatattggaggtcagtccataaaagtatagagagacatcccttgttccttttgacacctgtatcctctgctatcatatggatctcccatagtttaatcaagcagcccccaggtgatgacattttggttgtttctagtcttactataactaccctttctgtggtgaatggttttgtgcatatatctttttttttttttttttctgagatggagtttcgctcttgttgcccaggctggagtacagcagcgtgatctcggctcactgcaacctccacctccaggttcaagcaattctcctgcctcagcctcccaggtagctaggattataggcacccgccaccacgcctggctaattttttgtatttttagtagagacggggtttcatcatgttggctaggctgtcctcgaactcctaacctcaggtgaccacccaccctggcctcccaaagtgctgggattataggcatgagccaccgcactcgacctctttttttgttttcacagtataactttggactagattcctagaaatgagattgttgagtcaaagggaaaatgtgtaaatacttttgctacaattgccaaatacccctcattcaatttatttcttgatcttttaatttttaaacctaaaatatgtgattcaaaaaaccaaaataaagtaaaaaatagtaaacatatagtggaaggcctccatcccaccctagtctcccacctgcctggttgtgctgtgcccaactccaaaactctcctcactccaggtggccaccgttgttggtttctcacatctccttccaagttgttttttgggagtctgtgcgtgtgcaaagagatagagggagagagacagagagacaggatttctccgactttttctttttttttcttttttttttttgaggcagagtctcactctgtcacccaggctggagtgcagtggcgccatctcggctcactgcaacctccacctcccaggttcaagcaattctcctgcttcacctcgcaagtagctgggattacaggcatgcgccaccacccctggctaatttttgtattattagcagagacagggtttcaccatgttggccaggctggtctcaaactcctgacctcaggtaatccacccgccttggcctccccaattgctgggattacaggcgtaagccaccacgcccagcctaacttttattttctaactttagtagctagatgccatatacatcatcctacaccttcaaccctgtagagtactgcctccaccagggacaggagacatttcacctgctcctccctgaaacccagcaaggcagctgtttctatcccctagaatagcctgaggctcagagtggtcaagtgactttccgtgagtcccacagtaagtgacagagctgggttcaggttcaagtgtgccagctgcaaggctgccctcccccgacaccctccatcagcagcactgctgctcagttacaaggcttgcctccctgggcctctgctctctaagggggaatttcatatcccaggaactcaggtctaatgctcgttccccagaacacacccgagccttctcaggggagccccgtctacttagaacctgagactaaggacctagtatggtaaatcaacactgaaactgactaacaaggagaaggcacagagatgtcctaaagaacactcatctcagcagctctgtgtacctttgagagacagaggtcatcatgaaaggtctcagggtccacaaactgagccagctcttagtaggtccatgtgcaagctccttaaccttcctgaacctcagtttccttttctgtaatagcataggacaatgatttccatctgctcctcatcgtgatgattaaataaggccaggcacacggtaagagttcaacaggtggaagccctgttgtgtgttgagctgagcactgaagttccatcccacggctgcccagagcccaatccctttagggcaatgaaggacacaaaaggcaattttactgtctctctccctggacctgaggcagggaggcctcctatccccaagcctcctcctctccacgtgcagctggagaaggacaagtggctcacatcccagagtaaatattttgaaacagccacaggaacccatgaccctgctgccatcttggatccaggcgtcaagctgtaggataatgaagtcaagagcgtgactccacaaaccacactgccattaccctgtgcacttcctctgggtcatttttgtgggtaaggcccggtgatattgttttaaggcacatgtaaagacaccctttttcctttatttaaaaaaaatggtagagcttataattggcctaagcccaggaaaataatatttacccagattttatacttgctggggaacacaccacacaattaattctaacagcataattaatttgaatgtacattaattaaattaaattaaaacattaaacttgtttcttaatctactccaaagaagttcggcaacataattgctatgaaacaagataatcgaaatacggaggatatttaacacacttattaaatgccacttagtatttctgtttagtattttgagggtctaattagtgtctaattaacttgctataggctatcttttcacaataccaattaaatttcaaaacatcctttataaatacacagccatgaaaaggagaagattaagcattgttataggcatgagttaaccgggagacattggcgtggtattgttttatatctataaatacccgtgcttattaaaactcatcaagtgttgcttttcaccattaattgctatttaatcaacttcaaataaatgaggaaatctctgaaaccagctgtcattattggagacagatgaagggcctagaaacaggagcgtgaggtgagagcaggaggcgagacaggcgggagggggcgggggccaggtgtgatctgcagagggcagatgagcaagaacttgagggatttccagatgggactttcttgccgatgccccgcctctacttgatatttaagatggaaatcccaacttagaaggagtgtaagaggataatagttacccacaaactgaagttcccagctctgtaggaagtaacccttggagagctccaaagacgaagctgccccagctcacatggggcaagatgtaggagctcagggcttggaatcccagaaccagcttccccctacctgtgtgagcctctttgagcctcagtttcctcatctgtaaaatacagggttgggctgggcacagcggctcatgcctgtaatcccagcactttgggaggccgaggcgggcggatcacttgagatcaggagttcgagaccagcctggccaacatggtgaaacccccatctctactaaaaatacaaaaattagccgggcatggtggtgcatgtctgtaatcccatctactctggaggctgagacaggagaatcacttgaacccgggaggcagaggttgcagtgagcctagatcttgccactgtactgcagcctgggcgacaaagtaagactctgtctcaaaaaataaaaataaataaataaataataaaataaaatacagggctgggccgagcatagtggcttacacctataatcccagcactttgggaggctgaggtgggaggactgctttagcccaggaggttgaggctgcagtgagctgtgatcatgccgctgtactccagcctggacagcatagtgagaccccatctcaaaaaaggaatacagggccggcttcatgggtgtgccacctgtgcagtcgtccagggccccacgtttggaaggaccccacacttagttaaatgctctgatgctatcatcttaaaattcttagtcgtttttgaacaagggctaaatttttcattttgcactgagcctgcaaattatgcagctgttcctggtgaaatgcctccctcctgggtctctgtgagaattgagtacgaggcgattcctgggaagcacccagcacggtgctttgcataaagtcagtggctcaagaagtggagaagcgccccaaagtgaaccccagtaccccgcaggttccctgcactgcctgtcccttccctcggaggaggcaccacagggactccggtccccggacaccatctgttgattggcccagcctgtgggagagggcttggcctcctctggaaccttcctgctgccctgtgtgacttgctcgcctctccgcagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatggtaggcaccccccagccctgctctttctgcccccccccgcccaaggccaggctgggcgccccaggcagaagggtggcccaggcttgtctcccaggctgagatacccccagattaccacaggctatctcacagatggtggtctctctctggctctaactggccttggggggtgggggttccttttggggtgcagtgcctgggcccgtgggacacctgagcttcagtgagatcctggacacatcgctgaaggtcagctggcaagagccgggagagaaaaatggcatcctcacaggtaggcactgcagtgtttctgaaccagagggcaggacagggctgggaaaggtcagagctggtccatcccctgcctttgagctacttttcacccaaactcttgaagccaacccatgctttcttagaaaccactcacaggaggctcttggcacctccacttcataacacatcccagagtctgcagccccacaccttctgccacagatctcagtggctgccatgatgactcactatgtcccctgcaattccctaaagtgctggcatcccactgaggcgacacctgagacccagggcatgatgccaacagctcccacctcccttggccccattgctcccagcgtggatctaattgccagcctagtggagaagtgagaagtggagtagtgggtcaggccaacttgtgatcacagccaagctcatgccaacatggcggctctccccagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccaggtaagtgcccactctcaaggcaggactctttgagttctcctgagcagcgtcccattcaagaggccccttgtcggctgggcgtggtggctcatgcctgtagtcccagcaccttgggaggctgaggcaggcgtatcacttgaggtcaggagttcgagaccagcctggccaacgtggtaaaaccctactaaaaatacaaaaattagccagctgtggtggtgcatgcttgtgatcccagttagttgggaggctgaggatggaagatcgcttgaacccaggaggtagaggttgcagcgagccgagatcacaccactgcactccagtctgggtgacagggccacatcgcgtctcaaaaaaaaaaataaaaagaggccccttgtctttcaggaataccagcgttcttcccacaggctctccccttcccttgtgctgtgtgggtctgggtcccctcagagcaggcggaatccctgggatcccaggtctctggacaggggctcccctggctccctgctgcatcctcccacagctctcagaaaagcagaggccccctgccttgtctcatttccccaccagtccctcccttcacccatttctcaccagattccacaccaggcaatggtatctgtgattcaggggaaaatttcccactgtcgcccagagggtccaccttggattccagcgtgtggaagggttggttgggaggtggcagagcacggtggggctactcctaggcctggcacagagagcaagccgaggtccactctcagctctgcttctgccaagccctacaaccttgagcaagttctgtgtcccctctgtgcctcagtttccccatctgtatatatgggaagttggaccagataaccatgtggtcccatccagatcagtcaggcagtgcttgtttgacctgccagcatccctccacctgctgcgtagatggctgggctgcctgagtctcagccaaagcccagtgataattacagccatgctggcaaataggtatgtagtgttcacggggcatggtgctgggagctttgctcacgttgactcatttaatcctcacaacaaccctgagggaggtgttgctattatcctcttcattaccaaggaggacatggaggcacagagagttggataacttgtgcaaagacacacagcctgtaagtagtggagttagatttaaactcattctgactccagaatctgtgttctttctgttgttcctgagctccaagagccccaggattcctggccggaaaataagcttccccctgtccccacccatcctctcaccttcctgagctgtaattaggcgtaggaggtgtgcaggggtctgggcggatggaagggaggatcggtcccgtttggtttctttctcagcacagcttggttttaatgcagctttcagctgccttatgattacctcactcacatccagaactgccaggaagaaggcggcatcccggcccctgtttcctggccctgagagcctcctctcagccctaggagatcccctttgacccccaactctgtctcagcctcctggcatgaacatggttctccgtaagacacaggaacaaagactgtgggtggagtggggccgtggctgtgcttctcctcagacatttccaggaaaagcgtgacacacagccccctccatgcccaacagtcccgttcaacatggggggccattctcaccggatctccttccccaccctgttctccttttccagaactcccagggccccccaccaacctgggcatttccaacatcggcccccgctctgtgaccttgcagttcaggccaggctacgatgggaaaacctccatctcccgctggctggtggaagcccaggtagggcaggcctggggcctgaccagcagcccccgccagggcaccccgtgcccttgagtgcaaaatcttatgtgtatttcggcctgtgtgaattttcatgtgcagctctcaatggcccattatactccaaatgctcacacttgccaatgttgtctccaactccccctgcccctcacctgtgtacatggaaaaacacacacacactacagtcccctcctgggtcggggggtgcctagaaaaatacccagttgctggaatataaaaatatccgccttggctgtaccctggaatcatcaggggagcgttcagaagcgccaacacctgtgcccctaccccagaaactctgattctgatttagctgatttgaggggcagcctgggtctctggaagtacccggggtgttcaagagaatcacctgggctgcttgttaaaagcacagattcctgggcagcactcgagggattctgtaagtagtggagttagatttaaactcattctgactccagaatccaggaatatattgatcacaagcatcctgagagattctaaggcaggagggttgagtcacacttgcagtcatgtttaggggcctggaaagatggtagccccatatggtgccctccagatgagccctgggttctgaaccaacttcttccctggcagggcttgtactggggctcggagcaccccgtgtgggccctgtaggctggacaggcctaagatcctgcccttttccaggtaggcgtggttggggagggagaggagtggttgctgatccaccagctctccaatgagcccgatgcccgctccatggaggtgcccgacctcaaccccttcacctgctacaggtaatgagactggcccggggagaaggcagcagcctcagggctgggggtgggtgggggctatggcccagaccaggacagggttgagagttgggtgagctgcccttaccatcttgctcatctctccccaaccccagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatggtaaggctccctcgagggcaggggtgggacctctccatgagcttctggtcattgcctcctagaaggtgcacatcagaattcctacagctcctttctcctctctttctgttttctgatgagatgcctgataatcaacatcttagcccaacgaacaaatgcccccccgcccgccgatgagaggaaggagctcaaaaatactgtttactgagcatcgccaagtggcaagcattttaaattttcatcccatttgattctcccaataatcttacaaaggatacatgatcatcccaatttacagctaagaaaactgaggctcagagaggttaagaacttgcccacagccacacagctcccaagcggcgggtctggggttcaagtgccactgtggcattcagagagtgtccccagatccgggctgtgtgttgagggtcctgaccgtgggccatcctgcacgaggtagtgacagtaacacaccgaggcttcctctcctaccaggcgctgttctgacaacaagcctgtgacagcagagtgatcctggtcccccttttgcagatgaggaaaccggggcagaagagaggtcagatcactcgcccaaggtctcccgtatcctcccacgtgctttcatgaacagcagggctgaggtcccaacccggggaatctttacccgcaagtccacagccctaaccatcgggcacactgccgtctcatcctctggagaacaggccacttctccccaccaggccctctggaacatcgtttcccagcacgtgtcccacagagcagcaatcccaggaggcgtgtggagcaaacaagaattcttagacaaataaatgtgggaacagcaccacataccacagctccatagagaatccaggaacactagcatagcaggagccctcttgaccctgcttccccaggcccatctgaccacacaaaccctttgtttccacgtaagatctcactcattgtgcaaaacacaacttgcaaacacaccacactgtgaagtcattattgccgttcctgtgcgcggacagcttgatgctagcggccatgaaagcgcttggcgccgtcagtcctcgataaatatgagttattgattgcagttcccttcccagagtggctggtgcctgagcagagctgcagagctgtctcggcccacctcagtgccccgtgcacagtgtgactatacccacctcctgcctctttgctcccaggcatccccaccccaggctggctccctgcttccttcctgaatctcactttaaggtttgcagctactaaaaggttagagcctgatgccgagggcagggactgcatgggggaatagaaaggcagctgccatgtggcacagggccctagacacttctcaggcccacgcttaatggtgcgtggtccattacctttcctcagcaggtaaaggaacttgcacttaagccccatctccggctctcaggaccatcgattgctatcttaatggtctttggtcggcttcactaagtgtctgcaggagggaggaagcgtgtagtgagcaggggaggttggggccgaaggtgaggagtggggtaaagtgggtcagcctagggtgagcctgtggaccaagggccctccagagcccctggggaagcagaactgggggaggtgagggctggagatgcccccaccccagctctgtgcccttcagagtagtggaggccaggccctgggctcccctccctgtgtgcacacctccactctcaccagcactgcccatggtcatccacacaaccttaagctggtgaccacagccccatcagcctagtcctaaggccccaaagaaatctgacttttcttttctgtgagactcaaacaagaaggaggaggctggttgggcgtggtggcttgtaatcccagcactttgggaggccgaggcgagcagatgacttgagctgaggagtttgagatcaacatggcgaaacctcgtctctacaaaacttagcaggcatagtggcacacgcctatagtcccagcaagagattgcttgagcccaggaggtagaggttgcagtgagctgagacagcaccatggcactgcagcctgagagacagagccagaccctgtcttaaaaaaaaaaaagaaaagaaaaaggaggctgaaaatgcagcaggagaggctgaggtttgctggacagaaggacttcctgactggcaggtgccccactcatcctgctctctgcccatgctcactcaaaggcaggcatgagctgagaccaggtgcggtaggcaattaagtgtgtgctggcagcctgagtgacagaggtaagcagcagagacagcagagccaaaggtggcggtgctatcggtgtgtcagacacacagcctttgtggctcctgactcccttggcagggtaatagatttgtcacatacacaataaagaaaggatgctgcttctctgtcctccctgcaggaagataagagcccatcagaaacacagtcacacaacctaagccacactcgggtgagagagcctcatgtggacactgaccgggtgacagtgggatggatagccctgaaggcgccctggaggagagggtagcagggcagttcctccctgcacagtggggggcctggctcatagcagctttgccacccctgccccgctgcagcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcaggtaccaacccctcacacccagccaccctgctgcctgtcccctccttggtctctatgccctcagggtcatccaagcgcgtgccaggctgaaggtgttgttcaaaaacagcctgagctcatttcctctgcttatgctcaatgtcacaatgatgttgccgcctctcccagcacctgccacttctctgcaactgtgcctgctattcccatattcccaaggggggcgggggtatccctgcctctggaggacagctgggtaggctccaccattcatactgcccactctcctgccctcagctttaaccctgaaacccagtggtgcctgaaagaccacagtggaggggtcgaggaaagggttagctctcaggacattccagaatcactaccggaagctcctgggggcctgcccaggggtgacccacagaatgtgagcccagcattcaggcaactctcatccatccacacatggttcactgctctgtggctttttcctggcaccctttaaatgacagacagctctcctgggccaccctggtccctctgccagccctctctgctgtgctagcaggaaatgcaagctcatctaatcctaacctgagcagagaatcctgtgaggaggctcatctgaaaccggaaacggcatctgcagcattccaaaaccaaaggccatcttagtgggattgtttgcagtttggggaccatgtgtgccacgtttcttccatagagaggcaacatcgagctggcccctccctcggccccctgtcctggtccacttcccttgcacagtcaacgttgggtcctgagtgccttctctccactccctttcccccacagttccctcttccggccccaccaatgtgtctgcactggccaccacctccagcagcatgctggtgcgctggagcgaggtccccgaggctgatcgcaacgggctcgtgctgggctataaggtgagtcccgggatcccaggaggtggggtccctacactggcccctccagcctctccatccaaggggccttgtccttatcaccctctaggtctctgcctcctagagtggatacaggggatctgcctggcgtcctagccaatggtcaccatggcaaccatgagtcatcccttgtgggtgaggaggcacccagaaaggacccagggcctagggctgctccatctctcccgggaggccacgctggatgcccccagcctcactcagctctgttggacccagttttgcttttcattatcttttagaattccttttaaagctgtgcctagccacatggtccagccctggtctggaagttgggagatgtgtgacacacagctgctcatcctggggatgagactcgggaaaagtgtagatgggtgagatgcaggcctgaggccctcaccctgtgctgggccctgacaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatggtgagtccgtatcccagcaagcttggggaaggctgggaggagccgcccttcctcctgcccatctggccttgcccttctggggtcaggctctgccccacagggagccatggcctcagatgcctccggtagggatgggtcacccagagctaccagccccactgcaggggatgctaattacagcctgtgtatccctgaggacaatgcggaggcagtttgacgtctgattcagtctcttggtctctctgcaaaacaagcatacagaatagggacttgcacccgttttaatttacttttcttttttttttttttttttttttgatagagtatcactctgtcacccaggctggagtgcagtggtgcgatcttggcccactacaacctccgcctcccaggttcaaaccattctcttgcctcagcctcctgagcagctgggattacaggcgctggccaccacacccagctgattgttgtatttttagtagagctggggtttcaccatgttggccaggctggtctcgaactcctgacctcaggcaatccacccacctcagcctcccaacatgctgcaattacagatgtgagccactgcacccggccagttttactttatttttcaactggagcaggttcactttgagtaaaggtctgtgaaagtatttttcctggacgcacgaacctcctggtcctgtttgcaaaagaatgtcaccagtgggctgcaggcattcatccctgtagcaaaactccccatcagaagctcaccaatgcatcccttgccccctcctatctccccgcacacgcccccacctactgcccaccacagacatttgcaggaaccggaccagagtgcagaaggaagcccaaataccatatgtttgcatatgctaacattattcatcaagctaatgaaccgttaaatatgttctatcctcctgccttgacagatatacccttacaacgatctggaaggccaggttcaagtttagaaatctcaggctgggcgtggtggctcacgcctgtaatcctagcactttaggcagccaaggcaggcagaccacttgaggtcaggagttcaagaccagcctggccaacatggtaaaaccctgtctctaccaaaaatataaaaattagccgggtgtggtggcacacgcctgtagtctcagctactgggaggctgaggcaggagaatcgcttgaacccgggaggcggagcttgcagtgagctgagattacgccactgcactccagcctgggcaacagagcgagactcggtattaaaaaaaaaaaaaaagtttggaaatctcagacatcttattctgttctgcagtgcggcaacacaggaagagtgcccctccccagctaccctcccccaccccctgccccattctctcctcaccctgtcctttgacccactccattcaatcttcatctccacacctgcaaaatagctaccgcttggccttccctggagccaggggtgcatagcctaccctcaggagggtggatgtggggacgaggcccatgcagcctctggaagcgtgcttaggcctctctgggcagggaattccggggtcccaggattccagagcaaggtctagagagagagaggagtggtgcaggctgggggtgggcatttcccattaccccacggccacttcaccccatgggtggaaggaagtcagaacaggaccttctgaagcactgacgcatccatccagggcccacgcgcccagctctgagggcagcccggttctggggcgtgtatacagacaatgagcagaggaagctggagcctcaggtcgctgccaaatgatgcctattttgagggcagaaagcccccttggttccacgttcttgcccctggctcctaacacagtgtcaggcacagggcagtactccacagaaattcactgagctgggcggccccttccccctccaccctgccaggctgctctgcccgagctgggctcatccccagctgagcggcagcctcatgggtcggcctcctctcctttgccccctccagtcccaggaccacccatgggcatcctgttcccagaggtgcggaccacgtctgtgcggctgatctggcagccccctgccgcccccaatggcatcattcttggtaagcctttgcccttcccgtgccccggctgcaggaagaaggaagaggcatgagctgcaaaggaggccacttcgttaccagcttgagggagagtaggtccagggagcctccacatcccctctagaatgggatctgggtgttagtcctcctgctagaaattccagtgtgtaagattatcttccggagggcaagatcagagttgaagtcccttaagagtcatgggttggctttgcgtccccaaatgtccccaggcccccagcctgccggccatctggtaaacctcggacgctgttccttagcatggccaagtgagggcacgctggcaggctcagcacagctggaaaagagtctcaaggcgcacaggagggaggctacagatgggaagcttcatctcacatttagagttcccccaatacacacacccagggttccggtcggcagctgcgtgaacttgagcaagtctactcccctctgcggcctcagtgccctcacctttaaaatgggggcttggactacctgtacctgtcccagggttctcagtcctgacctcacgcaccacctgccctagagcaatgccacatccccaagacagagtgggggcaggaaggacaagtgcattagcccagaaagacctgggctgggattccagctctgtcacttaccagcaggtggtctggcctctccgggcctcagtttcttcacttggggctgttacgggggtcacagacactgtgcatagagtgcctctccatgccacccacagtccaccctccccaggtggcagctgaagactggagagtgacccagagacctcaggcagacagaccacagccaaagggaccacggcaaggtggccatgtacagacacagctgtggctttggacggaacaacccttcccggggccctaggagcggcttgccttgcttgccataatagccatgtgcttccttcccacagcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagaggtgactgcccacgggggccagggaaggcttgggggcagctgagggggggccagccagtgctctgagctgttcctagtggatggctggtatgagctgcagtgccctggatgagaatggaaggtgggctccaatctctgaagtcaaagtcagcaaggggtctaatagactcccagagatgagccgcaagttcacacccaaggaccctactctggtctggtcttctaaagggaaagtttgtggccaggcttagtggctcacgcctgtaatcccagcactttgggaggccaaggcgggtggatcacttgaggtcaggagtttgagaccagcctagccaacatggtgaaaccccgtctctactaaaaatacaaaaattagccagcgtggtggcacacacctgtaatcccagctactcaggaagctgagacacgagaatcacttgaacctgggggacggaggttgcagtgagccaagatcgcaccactgcactccagcctgggtgacagaacaagactctgtctaaattaattaattaattaagggagggttagtgaccatcttccctctcccctccccactcgcagccctggccttgtcaacacagatgggcgcaggatcagggctgcagcctggagccccggctgccactgcactgctgccctgagctggcaccttgcctgatcttggactccccaaaagcaagcctgggaccccgactggcctgatagggatatattagaaactactctcaacctgggccacatagtgagacaccatctctacagaacatagaaatattagctataggccgggcatggtggctcacacctgtaatcctagcactttgggaggccgaggcaggtggatcacctgaggtcgggagttcaaggccgtcctggccaacgtggtgaaacctcgtccctactaaaaatacaaaaattagctgggcatggtggcacatgtcagtaaccccagctacttggaaggctgaggcaaaagaatcgcttgaacctgcgaggcggaggtcacagtgagctgagatcacaccactgcactccagcctgggctacagagcaagaccgtctcaaaaaaaaaaaaaaaaaaagaaaggaatatcagccaggtgtggtggtgtacatctgtagtcccagccattcaagaggccgaggtagaaggattgcttgaatcaaggagtttgaggctgtagtgagctatgatcgtgccactgcactccagcctgggaaacagatacagaccctgactgtgttttaaataacgaaagaaaaaggaaggaggggaaggggaaggggaaggggaagggaggagaggtttaaccttaaactagtgctattttctcctgagcacgaaaccctcttgcctaaggccctgggtttcaggaagaaccacggctgatgctttagagaaagatcaagggttggggcatgcaagcagcaggaacatgtctggtgcacgggaggacgacagacgcaggtgactaaaactgctgtcacctccctccaggtgtggggccannnnnnnnnnnnnnnnnnnnggtcgtgaatgctcgcctctcccaggagagagccaagagagagagcaaacctgactaatcacagccgcatggagccagggtagcgcgagagcaaccacgcggcagcgcgtgcccactaataggttcgccatagaggggcgaataccgcaacggcgcaaagacctaaatgcggtgcacaaaacgtgcaagccatctcatcagaagcctctcacggatgaccgacgcgctcgtcacagtatgaaacaagcgcggatgacagcccgaaataaacacagagggaaggaagggagggaaggaagaagaaaatgtactcaggaaaaaccattagtacagtgcttctcaactggggacttctttggccacaggggacattggacatgtctggagacattttggttgtcacagtgtgggagtgctactggcatcaagtgggtggaggccagggacactgctgagcatcctgcattgcataggatgcccccgccacagagtcatctgttctgaattccagtactgctgaggtttgagaagccctgcagaaggggcggggcagcgaggctggggagagaaggaagccaagctagggcctggaatgaagcagcgcttctcgtagggaaacaacctcatcctgctcaatcagggacagcgcagggcccggctcagcctcgtttcaggcaggagcaaaggagctgggtgggtgtttgtccctcctcaccgtcaatccttgcttagggctgccctgaggagctgtaagttcccaggccctggggctctaggagcctgagggtgggcctctaaccaggagaggggtgctggctgtacccaggtgtgagaacctgcaaggatcctgcgtgcatggaattgggatgggaaggggatgccaggcctgagcccagatcacctcctttcctccctcgagaaagtccagccccctccaccatggcctggcccactcacctgctcctccccctctgccacctcccagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggtaaggctcgggtccatgccagcatccccactgcccctctccccgccgggaccagcggtgctcctccactgggtagggggccttctgaaaacacctccagcctgcccccagctctcctcctacatgcaccacccaggcggcccccgcgtccactctcaccctcgcaaatcagctctatcctgctcttcctcactctgttccctctggaactctgttaggttgcctcttaattatctatttctggagcctagaagtccccctttagtgaagtgcctgtcatccttcattagtgattcttccagccgggcggtatcttcctctccagctttaataggggagtggagcgtcactccgaaattctagcttcaatttaattccgagtgggttgaattttttatattccagttgatgtgaccgggagttttgagcaatactttcttccccacctctcccaccccccataaatctaaaagagagacgtttgctcccagaggaaataaggcttatagagatgaagtactgcttaactcttgagaacctcagctcctccctaatttactacatttaaaaaagagaggccaggagcggtggcttacgcccggaatcccagcactttgggaggccgaggcgggaggatcacttgaggtcaggagtttgaaaccagtctggccaacatggtgaaaacctgtctctactaaaatacaaaaattagccaggtgtggtagcacatgcctgtaatcccagctattcaggaggctgaggcacaagaatcgcttgaacgcgggaggcggaggttgcagtgagccaagatcgcaccactgcactccagcctgggcaacagagtgagactctgtctcaacaacaacaaaaaaagactccatctcaaacaaaaaaaaagaaagagatggcagtttgttgggggcaggggaggagtttgttccgagtggaggtattggtgcttttgtgactgcatggttctgcgaagtggggaagctgcagacatttccttctcgggatgctatggcttacaactggggctaaaggcaccccaagctggcatggtctggaggacctggtctaggtgcttgggacccctggggccgggtcccagtttgtcctctttgcagcaaagctcctttctgagcctcagtgtgcccttctgtgtagtaggctggcaccctgccccctttcccgagcagggccagatcagggagactccttggtgggggcatggggcgaggcctttaaggagcaccttggctcattggccctgatttctccctacaggctgaagcccttcacgtcctacaagttccgagtgaaggcgaccaatgacattggcgacagcgagttcagcgaggagtcggagtcactgaccaccctgcaggctggtcagtaccccttccccagcagtctctctctcagcccactggctgcttcctgggcatggggcattttcttacggggggaggggcctccaaagatgagagaggcgtgggacccactgggcccttcagctcccggggtagggtctcagggaggtttgggccagagacacttttgccaagggctcagggtcccaggcccagcctggcctgtggcgtattcctcctgtcccacaagctgccagtgagcgggacaggagttctcagcagcagcagaagtggtctatggctctgaggagcagagcggagggggctctgggacccttgggtttgggctgagtcagctcacagtccctccctccctcccctttacaccagccctttgttctgcagaaatcgggccagcaggcatggagggcgatgcgatctggacctgccccgcagtccagtattagcagaatctggtctcagtgggctcctggggaacttgaagctgcggcccccagaacccacctgtctgcttctctccacagcccccgatgaagcacccaccatcctctccgtgacgccccacaccaccacctccgtgctaatccgatggcaggtatggcccagcgggcaggaaacctccgtgaagacccagacgagctctgctctgggactggaaagccagcagtccccaccagggctgcgtggagcccccaagttctctgcccccagagcgcctgggaagccatgagaaatccaggcatgtgcatgtcacagaacattctatacaccgtgtgcccacacatacacactcccataacacgcctcattacactctctagatagtcacatcaggcaggtgctgtcatcctcttctgcagacaaccactgagactcagggaggggacccgaatggccccaggtcacatagccagtgagtggcagggccaggtgtattagccttaggcctgctgagtccttgggctgaaaagtgcttgtggctctcagggcccccagagtctccatgaagccccactggtcggtgaagggattccttgcagagacctatgcccgtcatcatcactgtgcaagtagagagaaatgccccccttcgtccataccccttccagatgcccactcttcagtgggcactgcctgctctgccatggcctggggaagaccatgggcaaacctcagcgaccaggctgctcatgggtcctgccccgcggagccctcctgtgccctctgaagttcagccttgcctcagcaggtcacccacatgagagggacccctggcaaaaccccatctctactaaaagttaaaagcactgaactcccatcaccacttctccagatcaaaggggcaggcactccccttcagccatctgccactccacaaagggaaagcccttgaagacaaagccaggagggtccccccagcctgagacacacagctcaaggagaggacgctcccgtagataaacatgacttagtgcacctgtgaccgggacgaggctggagcaacgtggcagagggagggggcagggaggtgcccatggcagccggggaaaccattaaggagctaacaaagcctgagctgtttcagcaggtttttggttttttggggtttttgttttgttttgttttgagacacagtcttgcgctgttgcccaggctggagtacagtggttcaatcttggctcactgcaacctccgcctcccagcttcacacgattctctttcctcagccttccaagcaagactacaggcacatgccaccacacccagctaatttttatatttttagtagagacggggtttcgccatgttggccaggctggtcagaccattcttcataagcagtatcattaagaagtagtttccaccttctcccgaagccggttctgcagctaagctgtagacgggagaggaagcaaaggagaacttgatgaaggggtgaggggcacactcacccttgcatgtactaagagtaggagagggctcagcttgcaggaaacaccaggaagtgttatccagatgctaaggcagggaccagcaggcctggggaggctggtgatcaggtgagggcagctcttgaagacaaaggaggtgaacaaggagcggctctaggaaaacagctgtgtgctccaggccccaatgatgctctgtgatcttgggcaagttccttaacatctctgagcctcagtttcctgcttggataaaaggcgattactgattcctgcccttccctccttctagggaatgctgcagggatgaaatggcctcatcagaagtgctttgtaaatttaaaatgcccaatattatcttgatttcttttcctggttaaaacatagtccctgctctgtggctgcaggaggcatgatgagagagcgtggggaggggtgggtggtggtccaggtgccctccccatgcctactcccttcctgcagccgccagcagaggacaagatcaatggcatcctcctgggcttccggatccgataccgggagctgctctatgaaggactgaggggcttcacgcttcgaggcatcaacaacccaggggccacatgggctgagcttacctgtgagtgacacttgggagccagaggaatgggtgggatgggggcggtcaccctcaccttcccgctctggagctctcagcttcctggaaccactctaacctgaaaccttgcctccctcctccatgtgtgcctctccctcctcccatcccattcattcatttactgaatatttactgagcaccttctatgggccccgagtcactgtggggcacaccaatgatcaagacagacagggtccctgccctcttggagttgcaggctggaggaggagccaggcgagctgggaaggaaacattctaggaggacctaaagccagggacaggcaaggcttccccggcaccagcactggcgctaacacggaaggatgatgccaagttaaccaggacaaagggacggggacagcccggtgcatgagaaggagcacccttcccttgagggaccagaagcctcacctggtcacacccctagagcagtagtcctggccccctctttttcctgggggaagccactgccctgcctgtcccctggagcaaaggaaggaaagaggggagcccaggtggaaatgtcagggagagccgatgcccagaagaccacggcaagggaaagacgtgtttggacttttgtgttaggagccactttggtggcatgaggatgatggcttggccatggtgggaggatggagagccagaggcaggcgcccagatagaggctgttgcagtcacgtggcaagagagcaggaggttggaaccgaggcacagactcggggtggaccgaggccagtatgggagatgatatgtgatgggcgcagatgctccaggacttgaggtttttttgttttttgggtttttttagacagagtctcgctctgttgcccaggctggagtgtaatggtgccatctcagctcactgcaacctccgcttcctgggttcaagtgactcttgtgtctcagcctcccaagtagctaggactccaggcgtgtgccaccacgcccagctaatgttgtcgttgttgttgttgttgttgttagtagagacggggtttcaccatgtcggccaggctgctcttgaactcctgaccttaagtggcctgcccgctttggcctcccagagtgctgggattacaggcgcgagccactgtacctggcctgtttttgatttttcaaagtaaatcagccactcgcatcataattatttagtattccgcattggcggacagttaggtgcatttacgacagttaagggctttggagaaaatgctgcaaagtggtgcaaccgataaaacacgttacagcacagcaggtagcaacgataattagaacaccttggtacataacgaaagaaaaaactgaggttttcccagtggctcaaaactgatgttcatctacacctttggcttgtttgggtctgaagtgcttgcgttcacctaagatttggactcagaccactagagatttttataaagagcctccttccctaaatatcctctatccacccacctgggactccatgactgattcgtagtagaagacggcagcaggcaggggtaccccagaggactgggtactcaggtgggtgtgggacactcacccaaacagactagcaggagaggggtcagtttaagagcctcttcttttttttttttttttgaaatggagttttcactcttgttgcctaagctggagtgcaatggcaccatcttagctcactgcaacctccgcctcccaggttcaagcgattctcctgcctgaggcctcctgagtagctgggattaacggcgcacactaccacgcccagctaattttttgtaattttagtagaaacggggtttcaccatgttagccaggctggtctcgaactcctgacctcaggtgatccacctgcctcggccttccgaagtgctgggattacaggcatgagtcactgcgcccggcttttgttttttgttttttgtttttttgttttttgttttttgagacagagtcttgctctgtcacccaggctagagtacagtggcatgatctcagctctgctgcccaggttcaagcgattctcctgccccagcctcccaagtagctggacctacaggcgtgcaccactatgcccagctaatttttgtgtttttagtagagaccgggtttcactgtgttggccaggctcgtctcgaactcctgacctcaggtggtctcgaactcctgacctcaggtgatccacccaccttggcttcccaaagtgctgagattacaggcatgagccactgcgcccggcccagcctcttcattttcacgtttcctcccttagttctctcaagccttttgtgccttgtcttctagtgagttagcagacaacaaaatgatgagcatgtagcaaaggaatattaatagaaaaactctgaagtagctgatccaacagcttgcgtttttggtggactttttttccttctttttttttttgcccatatgtgcttgtggttgtgattttatattgcctgtgtataatacagtcatatttcctagtagtaaaattgtttctggttcatatgaggaaattaacgactccagtatttcatgctggtttccaggagctctgccctgaaacaaggaagagaattggggtgagagggtcccccagagatgtccctagagatgctgggctacaaagagctcacatcaccttgggccagtgcacaccagggtggggcagactgtccagggagcctccaccttcccctgcccccacaaccctgttatcctggcccgtaactcagcattggaaatttggaaacactcttcctgtctgttcacgccgtcagccccgcctggccggggtttctttgtggggtggggatgtgtgagcactaacctcctctgtctgctgtctccctctgcgcccccgccccggcacccccaccccatagccatgtactccatgcggaacctgagccggcccagcctcacgcagtacgagctggacagtaagtctccttgcatggtggcttcatcgcgggcccaggcctcgcaggggattgggagtggggcctccttgagagacctgatcacaggttgagggggtgtgcccaccccagggggcttaagaaacgggactaccctgaacacaagtgataaccctaaacacacggaaaagtaggccgatgacagggaaagtctccttcaagcctgccctctgttgggtgtgggctggaaaagggaagtctgtaaccctgtgctcggctgggtcgggggacagtgacagcggggccgcagcagaagctgttggacgctgctgggtaggtgggcaggtgtccacgtggttgctgccccatctagtcccatcgaaggcacttctcggcccagctgggtcttacagtctggccccacacctggagggaggtgacagcagttttagtcacctgcgtccgtcgtcctcccgtgcaccagacatgttcctgctgcttgcatgccccaacccttgatctttctctaaagcatcagccgtggttcttcctgaaacccagggccttaggcaagagggtttcgtgctcaggagaaaatagcactagtttaaggctaaattctcttcctccttcctccgtcaaccaatgaccaacccaggctgcatagacagctaggcaagggtgacacccctctcacaaccctgttaaagggtagacctacccaggggaaggaagcaggggcagggaacccagagagaagagtggagagggtgggagaaactttcagctacgggggacagtgactgcgcccgtttcttgcagctgcgtcccattcccaagttctgccaggcattctcagccaagcacctcaaacttggcagaaacatcaggtttcttagtccagaattcacatccaatgcgcccctcccccctggagctgagccccgctgtgtaaagagttggtggatggggactctgggcatctgtcacggtggggaaagaggacaggctgggggtagggggtgaccctatgtccaggcatgcccaggacagctttggtttacactggttgtcccggtgtaaatattcatagtggttttcagtctcaaaagtgtccagttgaacaataaaatgtacggccaccctaggccaagaggccaaccagcattgccctatgtccagattggcacagagcgtcccctgggggccccgcctctcacctcctccttcatgcaccttcacagagggggctagaatggcgggggtgcctcattcctccccctgcagcctccaccctccctggggacaccttcccagcaatgacggtgacctcagtgtgcttcccctcccccactctcccccacagacctgaacaagcacaggcggtacgagatacggatgagcgtgtacaacgctgtgggtgaggggccctccagccccccgcaggaggtctttgttggggaggcaggtgagcagcgcccgccctgtccggccccagcatgcctttcccagccccacccagttcagctggaagaaacgggatctgggctccccatcccgcccagcccacctcccctcccaggtttactcgcatgctcactgcctaccctgcacgccctccagtgcccacagcagcacctcgtaacgtggtcgtccacggcgccacggccacacagctggacgtgacttgggagccacctccgctggacagccagaatggagacatccaggggtacaaggtagggtgccctcgggcagagcaaaggggtgcacggatgagaagccaggtcggaggctggggagtgagtgatatgtgggaggcaggcaggtccccaggccctccattcatccagccagctcctcggcccttcaggctctgtggtacacctgccaccttggctgtttggacccagttcgcagaaatatttgtacagctgaagctgaaccacatccatcccctccagcttcctgagggcaggctgagcttaggtgcaagaaactctagccatccctaggctcgtaccatctctgagcagcacacacatccctccccaccagcccccaaccccatacataacttaagaccctccaaggggcttttggccccataattacaatattgatattaatcagatagccagttagcaaagcatcactgcctagtatttggaaatctctgtttaaaaatcatttctaggctgggcgcggtggctcacacctttaatcccagcgctttgggaggccgaggcgggcagatcacctgaggtcaggagttcgagaccagcctggccaacatggtgaaaccccatctctactaaaaatacaaaaattagccgggcatggtggcaggcaccggtaatcccagctattcgagaggctgaggcaggagaatcgcttgaacccaggaggcagaggttgcagtgagccgagattgtaccactgcactccagcctgagcaatagagtgagactctgtctcaaaaaaaaaaaaattaaaattaaaaatcatttctagggctgtgtgtggtggctcacacctgtaattcccgcactttaggaggccaaggtgggcggatcacttgagctcaggagttacagaacagcctgggcaacatagtgagaccctgactctacaaaaaaaaatacagaaattagccaggtgtggtggcatgcgcctatagtcccagctacttgggaggctgaggtgggaggattgcttgagccaggggggcagagtttgcagtaggccatgatggagccattgcactccagccaggtaacagagcaagacactgtctcaaaaaagaaaaaaatcatttctagatttaggatgatgtcctgtgctataaggggattcaatttctccctaatattcacaaagccctttggaactcttgaatcttcatgaaaggcccacgaagctgggaggatatgggtttttatgcccaaatgaggaaactgagttccaatttagttgacctggtaagatcacaaaaacagcaggcaggccgggtgcggtggctcacacctgtaatcccaacactttgggaggccaaggcgggcagatcacctgaggtcgggagttcgagaccagcctgaccaacatggtgaaaccccatctctactaaaaatacaaaattagccgggtgtggtggcgcatgcctgtaatcccagctactcgggaggctgaggcaggagaatcacttgaacttgggagagggaggttgcagtgagccgagattgcaccattgcactccagccaagaggtctcaaaaaaaaaaaaaaagcaggcagcagagtcagattccaagtctggcagctctcaccccccgaggggtgaaaagtaagcactaaccaaccacatgagcactaggggaagtagatttaaaaaggaacatgggccaggtgtggtggcctacacatgtaatcccagcactttgggaggccgaggcagatggatcacctgaggtcaggagatcgagaccagcctgaccaacatggtgaaaccccatctctactaaaaatacaaaaattatccaggcgtggtggcgggtgcctgtaatcccagctatttgggaggctgaggcaggagaatcgtttgaacccaggagacagaggttgcagtgagccaagaccgtgtcactgcactccagcctggacaacagagcaagactctgtctccaaaaaaaaaaaaagaaaaaaaaaaaaggaatgtgtctgtctggttggaagagctggaacacataacccttagctgtgtctgcctcccgcaccagtgtccagttgactctcattcttggcggctggttgttactccagagaagagccccagtgccatggcttaagtggggagtaggagagacgcaaggcacctcatcccacaggtggggagtaggagagacacaaggcacctcatcccacaggtgggaggagtgtcagcaaaggggaagagcttacccaagtcacacagctcattaatacaggtagtcccgatttaggatggaatccagcataagagtctcattccatctggggtgaaggaggaggaaggaaggaggaaaggcatgttgccaaggaagccctaaagatggatgacacccctcaaggcattgcccaggagcaccagctgggaaaactaaatattgcccccctagcatatgcctcccatgggaaaagaaaggggccagggcagcgccagcagcagtgtggcagccaccagactgtcgaggcttgtaagtggtgagttaatagacagacccaggaaaatgtgtaggtgcacaacaccatacagaatacagcagaggcctacatgctccagaaaacatgacccgtacctgagcggcaactgtggatgtgaacggagaaagtgctacctcctggacctgtgataaccaaggtactgacatcaacacgcacgaacatcagtgacgcattaacttcatcaacccatgagcacaccgaagctgatactgcattccagtcagactgcacccaactggtgcgtggcaggcacattcatgcacgttctgagagctccagtctttcagttggtcaatgacacgtgtttattgagcagttattgtgtgcccagcattgtgagcttagatgttagggagggaaggccaacacggggcaaaataaataataccgccaggtggtggtaaatgaagcaggttaggggagagccaggtccacgaggaggtttgaatttttttttttttttttgacacggagtcttgctctgccgccaggctgaagtgcagtggtgcaatctcagctcactgcaacccccacctcccaggttcaagcgattctccttcctccgcctcccaagtagctgggattacaggtgcctgccaccatgcccagctaatttttgtgtttttagtagagacggggtttcaccatgttggccaggatggtctcaatctcttgacttcgtgatccacccacctcggcctcccaaagtgctgggattacaggagtgagccagcgcatccagcctgaaattttattttattttattttagtttattttatttctttctttcttttttttcctgagatggagtcttgttctgtcacccaggctgaagtgcagtggtgcgatcttggctcactgcaacctctgcctcccaggttcaagtgattctcccacctcagcctcctgagtagctgggattacaggtgcctgccaccatgcccagctaatttttgtatttttagtagagacagggtttcaccatgttggccaagcttgtctcgagctcctgaccccaggtgatccgccctcggtctcccaaattgctgagattacaggcgtgagccactgtgcccagccagggtttgaaattttaaatgggttgttaagggctgggctcagtggctcacaactgtaatcctggcgctttgaaaggccgaggtgggtggattgcttgactccaggagtccaagaccagcctgggcaacatggtaaaagcctgtctctacaaaaagaaaacaacaacaaaattagccgggtgtggtggcacatgcctgtagtcccagccaacggggtgggaggtgggaggagtgcctgagcccggccgagtgagggtgcagtgagccattgttgcaccactgcactccagcctgggcaacagatcaagacttgtctcaaaaaaaaaaaaaaaaaaaaaaaaaaaaaaggttgttaggaaaggacttaatgagaaggtgatatttgagcaaaaacctgaaggagaacagggcacaaatcacatggatccagaaagagaggaaaaaagagcaaaggtctcagggtagacaggtacttggggtatacggagagccttgtgtgtccccagagtgagttccagggagcgcaatgggagatgggaaagccggggctggagcacctggggtccttcggggctttggctgtcactcttgagtgaagtcctctgagtggaggactgggaccttcagagggtcccgctggctgctgtgctgagcagagtctgaaatggggaaagcccagaagctatggggaggcatctgaactatccgggtgggccatgaagggggctcagatcaggtgagagcagagtgagaagtggccactctcagttagtcccaacagcagagctggtagaatttgctaacaaatcaggctgggcacagtggctcacacctgtaatcccagcactttgggagcccaaggcgggcagatcacttgaggtcaggagttcgagaccagcctggccaacatgacgaaaccgcatctctactaaaaatacaaaaattagctgggtatggtagcgcatgcttgtaattccagctactggggaggctgaggcaaaagaatcccttgaacccagaaggcagaggttgcagtgcaccaagatcacgccactgtactccagcctgggcaacagagcgagaccccatctcaaaaaaaaaaaaaattaccgacaaatcgaacatggaatgggagaaaagggaggcaacaaggacagccccagggtccacaggatgatggagcaggaaaagacaaagctggtgaaggaggaggctagggaaatctggagtctggttccagatgtgtttggtttgagacgtctgttggacattcgaggggagacagaacagagtcagagatgcatgtctggagttcaagagagaaggatcaaaccagagatgtgaattatagagtcctcggcatatagatggtactgaaagctagagattagacaaggaaagataaagaacaaaagaagtctacaaattgagccctgaaaccaaaaactgagtgatgtctcagagctcatgggaagaacatgcttccagaaggagggagaacctctggaatgggagaaatatttgcaaaccatacatatgaccaggggttagtagccaaaatatgtaaggaactcatacaacaaaagtgaaagaaaatggggcaaaggacccaaatggacatttctcaaaagaagatacataggctgggcacggtggctcatgcctgtaatcccagcactttgggaagccaaggtaggcagatcacctgaggtcagtagttcgagaccagcctggccaacatggtgaaaccccgtctctactaaaaatacaaaaattagctggccatggcggcaggcacctggctgaggcaggagaatcgcttgaacccaggaggtggaggttgcagtgaacccatatcatgccactgcagtctagcctgggtgacagagcaagactccaactcaaaaaaaaagaaaaaagaagatatataaatggtcaacaggtatctaagaaggtgttcaacatcgctcagcatcagggaaatgcaaatcaaaaccacagtgagatatcccatcacacctgcaaggatggctgttatcaaaaagtctagagataagtggtggtaagcgtatggggaaaagggaacctttgcacgctgttggtgggaacgtatatcagtacagccattatggataacggtatggaagttccgcagaaaattaaaaatagaactccaatgatccagcaatcccactactgggtatttatccaaaggaattgaaatgaggctcttgaagagctatctgcaggcccatgttaatttcagcatcattcacagtagccaagatgtggaaatagcctgagtgtctgtgaatggatgaatgaatgaagaaaatgtggtttatacacagtggaataccatccagccttgaaggaaatcctgctgtttgcaacaacacggatgaacctgcaggatattatgccaaatgaaatgtaccaagcacagaaagacaaatactgcatgacctcgcgtatatgtggaatctaaaataatcaaactcataggaacagagagtagaacagcggttgccagaggctgagggagtgagggaaatagggagaaggtcccaggatacagcgtttcggtgaagcaggctgaatacgatctagatctaatgtacaacatggtgatgatagttaatgataccgtattgtacacttgaaatttgctcagaaggttctcaccacaaaaagatgatgaacatgttaattagcttgattgtggtaatcatttcataatgcatgtgtatatcagaacaccatgttgtataccttaaacacatacagttttttggggtttttttgttttttgatttttttgtttgtttgtttttttcgagacagagtctcactctgtcacccaggctggagtgcagtggtgtgatctccactcactgcaacctctgcctcctaggttcaagggattgtcctgtctcagcctcccgagtagctgggattacaggcacccaccaccatgcccggctatatatagatcttagattgtcaattatacctcaataaagctgaaaaaagaaatgaaagggcagagaattgggcatagtaaatggcaggttcgtgattataatggtgcactcccatgcttgcccctgtccacataaggcatttattcatccagcagatattgattgaggaccatggatgtgccagccatgattctaggtgtttgggtcccaagggggccacatggaccgagatgcctgcccgctggagcctgcattctggcagactcctggttacccatcaatgtgccccatgcagctcagcagtgtgccccatgggaaccaggatctgggctcagtccctttatgtcctttgcacgcgtgtcagtccctctcactgtgaatcatcagctaacaaaggtccgcagaatgcagcgctcacaaacaagatgcacctgccggagtgcctggtttgtgaagacagctgtccctgggttctaggccccgacccactcctcacccaagagcatgactgcagccattggcccttcctctcctccacctccccagtggatagctcccacgggcagggcagaaaagcattctgagatatgtttcctctttttatgccttttcctgacctcactttttttttttttaacggactctcgctccgttgcccaggctggagtgcagtggtgctatctcagctcactgcagcctccacctctcgggttcaagtgattctcctgcctcagcctcctgagtagctgggattacaggcatccgccaccatgcccggctaatttttgtatttttagtagagatagagtttcgccatgttggccaggctggtctcaaactcctgacctcaggtgatccacctgcctcagccttccaaagtgctgggattacaggtgtgagccaccgcacctggcctgacctcacattttcttccagttgtcacccatttctttggcccctttacagcagaattcctcaaaagaatcttctgtactcactccctccgattcctctgctctctttctcccttgaactcgctccaaataggttctcatccccgccaccccaccgaagctcttcctgccaaagttgttaataattcccatgttgctcatatcgagtcaaaccacaggcttatcctgcctgactcagcagctgtgtttgacacatggatctctccttcctctcaaaatgcttgctttcctcagcttccctcgctagctcttcctccccaccaaccactgaatgctggaggcccccagggatcaatccacagccctcttctctacctaagagaatccattcattctcccagtgtgcactcacggaagaccacctgtgtgctaataatggcaaacttttagcatcagccatgacctttccaaatccaacaggaactttgttaactgttgtacccccattagtatgaatgcatgagtgaatgaatgatttcatacatgactgcctctgctttcattcatctatccatatgagaagaatctgcttttcgttatttttatgttattttagagatggagtcttgttctgttgcccaggctggagtgcagtggtgtgatctcagctcactgcaaccttcacctcccgggttccagccatcctcctgcctcagcctcccaagtagctggaactgcaggtgcacaccaccactcctggctaatttttgtgtttttagtagagacaggggtcttgccatgttgcccaggctggtcttgaactcatgggcacaggcgattcccctctctcagcttcccaagtgctaggattacaggtgtgagccgctgcacccggccctctccccctttctaaaaaagaaatcactacaaaagaaatccccatctctacgaaagaaatagccaggtgtggtagcactcatgtagtcagagctacctggggggctgaggcgggaggattgcttgaacctggaggtcaaggttacagtgagccaagatcatgccactgcaccccagtctgcgtgacaaaatgagaccctgtcttgaaataaaataaaataaaataaaatgggagagagggccgggcacagtggctcacacctgtaatctcagcactttgggaagccaaggtggttggatcgcttgagcccaggagttcaagaccagcctgggaaacatggcaagaccccgtctctacaaaaaattaaaaacttagctgggtgtggtggtgcacacctgtagtcctggccactcaggaggctgaggtgggaggatggcttgagcccaggtggttgaggctgcagtgagctgtgatcgtgccactgcactccagcctgggcaacagagtgaggcctgtctcaaataaaaaaataataataaagggggagagggattggagaaaagcaaggatttcatggtaacaagatgtcctaactgccacccatacatgccagtggggacacttttattagctctttctcactttatgggcttcctccagggaaatgagaaattgaaaagccggtgacatgcagaaacctcattggccagcagggggcgccaaatgacctccaattttgcacgtggctgggcccagctggccgctatctggatggcctcagtcctggaactagcagaagtgttaacctgtgctacagaggaaatgattgaaaacaatggctgggcttggtggttcgcgcctgtaaccccagcactttgggaggccgaggcgggcggatcacaaggtcaggagatctagaccatcctggctaacacggtgaaatcccgtctctactaaaaatccaaaaattagccgggcgtggtggcgggtgcctgtgtcccagctactcgggaggctgaggcaggagaatggcgtgaacccgtgaggcggagcaagatcgcaccacagcactccagcctgtgtgacagtgcgagactccatctcaaaaaacagaaaggaagagaaaacaccagggagcatctgttgtgttcctggcctaaagccttctgcagccacggggttccttaggaaactggccaagtacctgggtgaaacccttagaacctgcacccctcacacggaccccaggaagtacgtgtccttaacctcactgaatgtacgacaaaactgcagctctgggaagtcagctggccaggtcccgctgctgtatgcggtgcagctgggattcagcctcccgctgcccgccgtcttggccgaggccttcctctgcagcgggccttgttcctgttaaccagcagctgctggtgcagcgggcccggggtggccctgagactctgcttccctcaccagctcccaggtgacatgaggccaccagcacttgcaccacactctgtctggatagactccacactgccttatctccccagctcagcctcccgtaggacggatttgctttattcctccaggaactgtactaagtgctgacgtgccagcgctatggtaaatcctccaggcatggcgggaaacacagacacttgggggccatgccctggagtttactgtctggcagagaccagggtcttggctgtgaaaaggaaggttccagaaaggtttctaaaacagttcttaaattctttttttttttttttgagatggagtcttgctctgtcacccaggctggagtacagtggcgtgatctcagctcactgcaacctccacctcccaggttcaagtgattttcctgcctcagcctccagagtagctgggactacaggcacttgccaccatgcccggctgatttttttgtatttctagtagaaacggggattcaccatgttggccaggctagtcttgaactcctggcctcaagtgatccacccacctctgcctcccaaagtgctgggattacaggtgtgagccaccgcacccggcctcttaaagacttctccgctgtttcccaggtgactcacagcaatgaaggtgtctctgagactacaggtcagcagggacaggagggactctcattgcccctgtccccctcactcccacatccttctgttcccacagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcaggtgggagagggggccctgaggaggggaggggtaggtcggccacggggggttgcaagaggacctacctggcatccgggctcttggcaggcatgggggcagctgccttatccgcctgaggatctggtcgtggtacccaggtccccagagacaccctcccaagtgggagagcccattctcagaaaagagaagctgtccccataaagccttgagaaacccccacacctcatccctgtcctccccaccgtttgccccgccttgcagacggacagtcagcacccccagcccctcccagccagcctacttctgctccctgccttcttcccacctgccttccctctgtctctctggctttgttcattccacaaatactgagtgtcttatgagcccgtgccatgctagatgctagggacacaacagtgagaccagcaaggtccccaccctagtgcgggggacagatcataagcaagttgatgaagtaaatgcagacgggggtcagcacaggtgacctaagagtgaggcaggagtgggtggatggctctggataggctcacccacaaagccctccctgaggaggtgagatttgaatgagaagaggccggcaggggccaggcatggtggctcacgcctgtaatcccagcactttgggaagccaaggcaggtggatcacctgaggtcaggagtttaagaccagcctggccaacatggtgacaccctgtctctactaaaaatataaaaaattatccaggcatggtggtacgtgcctgtaatcccagctacttgggaggctgaggcaggagaatcacttgaacccgggaggtggaggttgcagtgagccgagattgtgctactgctgcactctagcctgggtgacagagtaagactctgtcccaaaaaaaaaaaagacaagaggccagccatgagatgctctcaggaggtggcagagggtgctgggggctccaggcagagggaaccgcaggtgctaaggcctaggggctggagaggaacccgggaacgcagagaaagccaggtggcttgcaggaaaatggggcgagagctcaggctgggggattgggattgggattaattataagtacaatggaccacacatggtatctcacacctgtaatcccagcactttgggaggccgaggtgggtggatcatttgaggtcaggagttcaagaccagcctggccaacatgatgaaaccctatctgtacttaaaaaactacaaaaattagctgggcatggtggtgcacccttctccaatcccagctactcaggaggctgaggcaggagaatcgcttgaacctgggaggtggaggttgcagtgagctgagattgtaccactgcactccagcctgggtgacagagcaataatctgtcttaaaaaataaaaaaatttaaaaagtatgctgggaagccatgggagggcttgagcagttgagcaacagggtctggtttacatttagagaaaagtgctccggctgctgtgcagaagatggcctggtggaggggagagagtagaggcagggaggggagatcgggaggctgaagggtggcgggtgcagaggagagggcgctggtgagaatcctgctgcctgtgtgcagagcgagcctggtagtcaggcactgtcacacttaaccctcccagaagccccgtggacaggcagggcaggcagcaccctcatctcacgatgagccggggtcacccaggaagttatactacttgtccagggttgcccagctggtcactggggcagcagaggctggaacccaggatttctgagagaaccaagtgttctgtcctcgtggactggaatactggccttttgccccggcctcccttgagcatcttgttcaacctgctgcttcctatgctgtcagtgacatgtggcttttaaagagctgcagagggcacacctgtggcatcagttcctcattatgaccctctctggggacaagccctggctccagggaaccctttccctccactacccccagggtctgacggtggccagaatgagcgtgagctgctgaatatacaagtctgtccgtccgcctcctgtcccggccactcttttgtcagtgccatctgccagatgcgaaccccagggaacccgaggcttccgtcactgcggcagcaggacaacatgttctgtcccacgtccctgtagcacaggggaggcaggaagggccccctgagctcacctccctccttcaaagacactcgctgactctgcctcctggggctggagccggaagcaggtccggattagctccagcgtggtggggaggcagcgccggacaataatagcctggtcatcctccctgggccagctggggatgccgcagattgggacgcttcctgcccttcctctgtcctccccatcaggggagcccccacccccatgattttggggttgccacagggttcttggtccgagaaaacatttctcccagagggtctgactgtccttggcgtggctccccctgactgcgtggggcctctgtgacaagccctggagccccaggaggagaggaaggccatctccgtctgctgtggttctggtgtcttctttgtttagcgcctaccgaatattctgaggcccagacacccccaccttctccacgaaagccaaaagacgaaccccgcaaagccaggaaatggccttgccccacgatgaccccgggggtgtgacagcttgtcccacgctcatagcccgggctcagagccacttagcagggagaagcctgaattctgcaacttgagggaaaaatcgagttctctttcttcccagttcttaggactctgatactggaaagttgagagaggagaggaagggggcctgatggcctccagtgacccctcctgcccgccctttctgccgagccccacgctcttgttcctcccgggctcagacccaatactcccgctagctccttggagctgaacccgaggctttgaacttccacagaagaaggaaacaaaaaccctttgctgtctcccgcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggtgagtggaccccccagcacagctccccagccccccactttgcaaaagctcgctctcatctcagcgcccatcacagccactacacatgagtgagattcggtgagagtctccccatcttataaacacggaaactgagtcccagacaagggaaagggcatttccaaggtaaaacaacagcaagttgagggcagagttggaagagagatccaggtctcctaacttccaggcagagaatcgttaaatatattcttccccctttggtcaacggaaacagggaggaaaggaagggaaacctgagtggacagggctctgttgagaccataaagaaggggggcagccaaggacggtggctcacgcctgtaatgacagcactttgggaggctgaggcgggtggatcacctgaggtcaggagttccaagaccagcctggccaacatggtgaaaccccgtctctactgaaaatacaaaaattagccgggtgtggtggtgggtacctgtagtctcagctactcgggaagctgaggcaggagaatcgcttgaacccggcaggcagaggttgcagtaagccgggatcacgccactgcactccagcctgggcgacagagctagattccatctcaaaaggaaaaaagaaaagaaaaagaagaggggagcccctgagggtcctactttgccctttcccaaaccttagggttctcagctttactgtgggttagtccttctttagctttggtgggagtcaggaaccccttggagaatctgatgagaatctgaccaaagcttcagagcctctccccaggaagatacacaagaccaaggaggtccctgcaccccccactgctatctgcggaccccagatcaagagccctgctctgcaaatgacctcgctcttgtccttaaccctgttcatctgactggtcttctgaccccttcctccgggccccagctgggaacctgcccatttctgggctcctaggctgggctgcgcagcccctgacaatgggcatctggtacctgccagctttctacccctggtaacatgccaagaaatccctgccattttgttatgaacaaccatcctatgaggatgggatttaggcaggaaggaaactgcgttcctcactgcctgggactagtcccagccaggtgctgggggtgtggctgacctctggagccacccctctcactctcaccccctccaatcacggagcctggcaagaacaaggggcagagacctgggaacatcgttgtgaccagcagttctcggtgagcctagggaacaatggccctcagtcttccctgctaccacctgggtgccagcagctcgttctgcaaaggggagctgtgtgttagaacaccaggggggagccaggccccagcaggagatccagtcaggtgcagggccggagtggggcagaggacagcagtccccgagacaaggtacagggggccagcacaagccctcttcacaggggcctcaacctggcctgtccaggaccctctcaacttgaggatgtgagctctttgccttccaattccacagtctggtgggatctggactgtgtggctcaactccacacccctacacattcccatcttcccataatagttcagttaataagtacagcaagacaaggccccgcctggacagcccagtgtccacaccccagttcatcctgggttcaggtcaatagcaaaccagcctcacaaaagcccagcagcccccactgtcctgtagggaaaaccaaggtccaggcagatgagggctttgttcagaattgtcaaggagcaggtagccagagtccctgttcctggtcccagggtcatttcattctttcaggaagcccctctgagcctacattgttccatcatttagtaatccacttagcggccgggtgcagtggctcacacctgcaatcccagcacttcgggaggccgaggcggtggatcacctgagttcaggagttcgagaccagcctgaccaacgtggcaaaatcctgtctctactaaaaatacaaaattagctgggtgtggtagtggacgcctactcgggaggctgaggcaggagaatcgcttgaacccaggaggcggaggtttcagtgagctgagatcgcgccattgcactccagcctgggcaacaatagtgaaaatccacctcaaaacgataatattagtaatccacttagtcaataaataggtcaggcacctacatgctctgttattttacttaaagctcatagcatccctgcctaagatgctgtggacaccctcactcggcagaacaaactgaagccaagttaagggacatgccggggccggcgccatcactgggtctgagcccagcctattggctgcaaggcctgtctttcactggtgactggcgtgctcgatggacatgggaaatgacactaaccccggctcccagggaggctggcagtcaggagtatttggattcgcgaagcacagagtgcaaacccccacctcctgaaagctggctcaagcgtcccctctagttgctgtgatttggggtgctgaggcatcctcacttttgccctaaaaagcttggtggactgggcatagtggttcatgcctataatcccagcactttgagaggccaaggtgggaggatcacttgaggccaggagttcgcgaccagcctgggcaacataatgagaccctgtctctacaaaaatttaaaaattagccaggcatgatggtgcacacctacagtcttagctacttggaaggctgaaagtggcaggacggcttgaacccaggaggtcgaggctacagtgagccatgattgtgcctgagcaacagagcaagaccttgtcttaaaaaaaaaaaaaaaattgtggcagatataggtgctggagggccatgtgagctcctggctgaaccccagaggtggagctggagtggggctcaggtggaggacctggtcaaaagtgtgtccccgcaactctgggcttttggtatttttatggaagcacttcctgaaaaaggatataattctagtcccatgggatgctgcataagggaatagcaatggagccgaaacatatttggggtgcagaggttacattaaacaggatggcgagtgttctcttttctgtagatgctgatgatggaccctgtggctactcagtagacacagacagtagtagcttttcccaaacatactgaaccatggagccgttctccctgagaacagcaggcaggaccgtgctgtgagaaacacagcatgggcaatgtggttgtgtgggctgggggtgcatttcagcctgacctcaaggagtgaggcccctacccagggtcccggggcccaggccacggccgcttccccttccccatggcctccagtgccctcggtgggccctgtgcccagtccccacttgctgtgcctcccccaggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtaggagagcaacggaccaggcatgtcttccacacggcggttcagcgtccccagtcagaaggggcccccggtgtcaagagctgtgctggaccctggaaacagagtggaggacagagctcactctttcccctggtgcccagtgacccctccccccgctccctcctcccgggctccacgctttgattaatgtgtcctcaggttcctcaagccacaaaccctggagcagcgccccctcctctcccacttaggcccagcccacaggcctggcctggccactgcgcctgcttcgttctttctctccctgctaattgcatggcctcctttacttccgtcctggaaggatgcagcctggcaggtgcccctgcctttcgcccagccagagccatcttcccacgcccctgaaccacccctaccctccaggcagcggttctcagagcagggcgcactaaaatgcacgttcccagggtggatgctccgaggggttgatttcctggggctgaggtgggacctggcagtctgcacttagacaaaagcccctggaggccgtgacaaagtggcaccttgagaaacacctgatggagcaggtcacctattcacagccagggccctgcctcccccacctcaccacccaccccctccgcagaacgcccttttgtgtgtaactgcccgcccctcaccccaggaagtcttccttaatctcctgtattgtttctgttgttgttgtttgggctttttttttttttttctggagacagagtctcgctctgtcatccaggctggagtgcagtggtgcaatctcagttcactgcaacctccacctcccgggttcaagcaattctcaagcttcagcctcccaagtagctgggattacaggtgatttctaccacgaccagctaatttttgtatttttagtagagacagggtttggccaggctggtctccaactcctgacctcaagtgatccacctgctgcagtctcccaaagtgctgggattacaggcatgagccactgtgcccaatcgcctcctttaaatgtcctcttcacctcccttcccctcccacccctcatccccccaggcatttgccatggtcaaggtttagccctccaaagtccctgttactggtcagtgtagaatgtcctgtcctgaacacaaaagtcacctcccagaccactctgctgcctccctccctaagaaggggtacagcccatcctggacttcccctaaaatcccatctcctcctctgcccacccccttcagccaagaatggcgcaggcctcccctccccagcagtcccaattagcctgactcaggaagagagtcttcccctaatggcttagtctggctgcgcttcactttttctttctggccagtcactttctattccccacagtctggttctgcaaagaagccctgtagctctagggcaaactcaggacaaagcctgcaggaggcagcccaggagccacccagccgctgtcctttcatctgcctccagccccgccccgcgctgcctctcacctgagccagcttcctgggaaacaaaagtaggagagagagctggcaagcaactgaggaccaagcgttggcagtggcctggggacaggagagggctgtgcggaggacaggctgttctatcctgaggcttgaagtgtcccaggctgagaggtggggaggtgggaggagataaagggcagagggttcagagaaggtagtggagggcactctgagaaagaaagaaccagccgggtgtgggggttcacgcctgtaatcccaacattttgggaggtggaggcgggtggattgcctgagcccaggagttcaagaccagcctgggcaatacagcaaaaccccatctctacaaaaataaaattatccaggcatactggtgaatacctgaagtcccagctactcaggaggctgtcgtgggagaatcgtttgagcccaggaggtggaggctgcagtgagctgtgatcgtgcccctgcactcccgcctgggcaacagagtgagaacgtgtctcaaaaaaagaaataaagaagccatcctcccacatggtgtgggtgcagggggcggtctgcaggcggggaacatgcagccaggcagtggctggactcgctggaagctcctggccccggagaaggtgcaggctctgtcctcagccctgagtactgtcctgtgcaggatgagtacagggtcctgagggctgcctgccctaccatactccctcaggcgtgtccaccccacctgaccccgcagttactctgcccttgtgctgcagacaggctgctccatagggaaggaaggaaatggtgccctccaatgctgtggggtgggcataggggccaggcggggctgccaggctgtgtgagcgatggggtgggcatagtggccgggtggggttgccaggctgtgtaaggagggcctgctggccctccagggccctgggggagcatcagtgtgatgctagactctgctccacagagaccccccaccaacaaaccaggtggccacccactcatgcactggttccctccctcatcccctaagcacagaggaagcacctactgtgtacccagctctgggggtacagagccccacctttggtggggagcaggattggaggtgacagcatgtggggtcgggattctggacgggcacccccaagagaaggggctcagagccccttgcagacagatacctggctcactcctctcattgctggagtcacctcctctcatctgctccagctcctagggccggctccctcactggcccacatcccaggctgctcctgacgtaccttcattccaggagcgcggcatggggcccagtccttcctccctcctcctagcagcacaggccccaaggcctcctggggcataaaccccctctccccttgtctaacctaataggaaatgcagttggggttgggggattttaggcaggaatgagggagggcggacatcatatcacctaccaggagggagaaactggactcttcagccccgctccgaccaaccccctcctctcatgggcccactctgccatcatcgcacccacctctattccccaccatccaggacacagccttcaagccttaccttccaaaaggcccttatagagggggaaacggaggcactggaaggctatgtgaattgatcaaaatcacccatctaacacgttctgggctggaacccaggtctcctggctctactccagggacctttctggaccattccatttgtcttctgccctgggatttggaatatggagcataggggtagcccagggggacaacagtccatcctggcaggcccagcctgagatgcactctcaggccgcgacatttgcagggcttcctggcggctctctgtccagggttggttttgtcacccagtgttcctcctcgagcccagggtgacgggctgggtggctgttctgggttccatacatccctcgcctctgtgtgctgtctgcaggtgccccaggaccgcctggcgtgcccatcatcgtgcggtacagctctgccatcgccattcactggtccagcggagacccgggcaaagggcccatcacccgctacgtcatcgaggccagaccttcaggtgcgccccgccctgctgggctgagaccccacagctcattatctcccttcttcctgggtccctccacttggggcacttgcctctgtcctccgcctgagaaggcgcttgtgctactacaggtgaagtcacctggccctgttgaggagtgggaaactgggttggggggctcctagagctggactcctagctaagtaacccccaggaggcccccagagaacggctgttagtgctaactgaggaccagcttgggttgaggattgctcaggaagccggaagcctgagcacgtggctcacgtgggtcacacaccgaatcctccacacgaccccactgatgggtgccccataactaagaagaccctggctgcctctcgaagccctgtctctgccatcatggctgtctcagtggctgctataatcgtaccagcctctcctgtcaagcctgaaattgaatcacaagaacttccaaagccatcaggagatgagtgacagataagtcagtcggggggctgctccccactgctccggtttcacccatcctgacacccgcttgctgggctctgcttactctcaggagcttgcagccactgccagctccctgcgttgctaggtttccaagttaatcagaggtgccagagtcagcaagagcaggaggcctgttctctgtatcccatggatccgcggttaggtgattaaaattgagaaggaaaacaagattttgttgctctagcccaaatagcaaataacaatcataatgggacgccaccaggcatctcggtagctagtacttctaatggggaatatggaaacatcccagtgatgaattgttaatacttcgaggtagctgggcactaatcatcccaatagcagagagttaataattctagtagctcctggaagacattaccaccgctcctgccttaatcacatgctaataatcgcagttgcatatagcgaatacatctagctgctcagatctgctgcgtggccggaggatgcatgcggggctggctctctccccactccagatggtccctccctggccctctggtgccggctgctgagttggccaggagaccactacgtgcttctcccaaccagggcctgcacctgtttattccacccaagttggccagttggggtgccaggctgtggaatgttggcccctgactctggctctgttgattctcagtgtttcctgggaggcccagcgtgggactctggtgttccaagtttgtgggctgtgacttggtccacactggtggaatcaagacctgagcataaaaggaaggaccaagccagggccctgtgagaaaccaggactcggagcagggccagggccagagagcagaggacaggatcagtaaccaggcacagggaggagggaggagagggggcaaggggcatggtggtctgtccctaaggctgtttgagagcaggctgctgttatggggtgagcatctctcccctccatgccccctgccccttcttctgtgctccccttctcatcttcaggatggcatagcccttgtcatacatttgcccttgaattgcttgtgcttcgtgctaggcaggataaactaaatacaccccctttctataagccaggagctgccaggcgctgcagacccagggagaggttcgcccagggatttgcagccccaggaacccgtcctgcacatcagccaactcccggggctggcggctagagccccagcgtgacattccagcagcttctggcctggcccggttgactcagccccaccctttgtccctgtgtggggtggaacaaggggggttaaacagcaggcaggagatcccagcttctggaaggcagcagcaggggcctcaacgatcccagcccatccagcaaacacaggtccaacacctgactgcgctgggcagggaagttcggtgccagaaatgaggtggccccaggcagtaacaccagctctgctgctgacagcgtaggaccttgggaagatgagtgaagcttcctccaggccttggtgtcctcatctgtaaaatggggacagtagttcatccctctcgccattgctgtggatttgaaaaggaaagcacgtagacccaggatgcttgacagaggcgtaagtgccagctgttgtcaccgtcatcatcatcattatgatatcattcaaagatgagtgagagaattcagaggcatgtgaggaaaatggatttgtaccccagtactaaaatttcaaggcatgaagttccgaaactgggcagctaatgctatgaaaaggccagggaggaaaggttccatttatttattcaataaatgctgagaaggtgcctgtgctgggtgctggactaaggatgacttaagacgaattagtcatgatccttgcccttgagggatttcacagccagcaaaggggaaagagagaaagagagatattaaacaaaaagatgggtcaggcacggtggctcacgcctgtaatcccagcactttgggaggccaaggcaggcggatcacgaggtcaggagatcgagaccatcctcgccaatatggtgaaaccccatctctactaaaaataaaaaataaaaaataaaatagctgggcttggtggcgtgtgcctgtaatcccagctactccggaggctaaggcaggagaacccggaagccggaggttgcagtgagccaagatcgtgtcacggcactccagcctgggtgacagagtgagactctgtctctaaataaataaataaataagttagccgggcgtggtggcgggtgcctataatcccagctactcaagaggctgaggtaggaggagaatctcttgaatgggaggcggaggttgcagtgagccgagatcatgccatcacactccagcctgggcgacagagtgagactccgtctaaaaaaaaaaaaaaaaaaaaatatatatatatatatggaggtgtaggaggcagaggctcaaaaacaagtaagaccaacagtgaggccgaggttcgggaccccggagccttctgcaaggacagctctgatgtagactgggtccccatggccttccccaaattggaaggatccacactggaagtggggagacagccccctcagcagttcccaccactgggtccaaaattcagacaggacgccagggtgtcgaggcgcctctgctgcagtgctcgacttacacggctgggtctatgagaaagtatggtgaggaaaacaaaaccatcagccctggggaagggcggccttgaactgggcacacctctggcgggagagcagcttcaaccagagggtgcagaagcagaacggcgagaagaacgggccctgcatgtgagactggaggtgcttggttggggcaggctaggggaagttaaggccttttagtccctggtggcagcggcctggaagacccactgttggccactgggtgacctccctggagcaggccagacagagaggacctgcgagctggcctcactgacgtccttctactgtgaagaggggtctggctaggcccagggtggcttggatacctcagtttccaaatcagccccgcactgccaccagcaggaagacgcaccctctctcagggccaggctgaccccatcagccccacccagagcatgcagccagggcccctcctggccttcccaccaacatgatggatgccccaaggctatgtcaggggcttgcctcgtccctgacccaggcagcacccgcaccgctctgactgaacagcatgaaggtgaattatgtcccacgagggcaaggcccagagagccacggataaagaggggaaggggatctgagggaagcgcaggtgcaaaggacagaggtggctgacgccagcacagggtggagaacagacaggaaacccaaatttttcctgttggctgagcgcggtggctcacacctgtaatcccagcactttgagaggctgagatgtgaggatcgcttgagcccaggaggttgaggctgcagtgagccaagagcacaccactgcactctagccttggcaaccgagcgagaccctatctcaaaacaatttttttaaaaccaaatctttcctgcagctgttactaaaaagaaaagaaaaagaccgggcatggtggctcacacgtgtaatcctctttgggaggccaaggcaggcagatcacctgaggtcaggagttcaagaccagcctggccaacatgatgaaaccctgtctctactaaaaaatacaaaatttagctgggcgtggtggagtaagcctgtaatcccagctatccgggaggctgaggtaggaaaatagcttgaacctgggaggcggaggttgtggtgagctgagatggcaccactgcactccagcctggatgacagagtgagactccatctcaaaaaaaaaaaaaaaaaaaaaattggccaggcacagtggctcacacctgtaatcccagcactttgggaggctgaggtaggcagatcacctgaggtcgagagttcgagaccagcctgaccaacatggagaaaccccgtctctactaaaaatacaaaattagtcaggcatggtggatttggaaagctgaggcaggagaatcgcttgaactcgggaggcagaggttgctgtgagccgagatcctgccattgcactccagcctgggcaacaagagcgaaactctgtctcgaaacaaagaaaaaagaaaaatagcgctcttatttttgtctcctgccaccattgtgtatgttttgaattaggaaagggggttagttaagtaaagaagggtattcccatatgataatgtcttaggcagtcacttaaaatcatgtttccaaccatttttaatgaagtggaagacagaatccatagtgttctgcttgcacaagtgctaattccttgagcctgtttctctggacggtggttctgtcattggttgtgacagtactttctgcacagtacgtatcttttaatgtagtacagatattttaataaaaagaataaaagagatgctccaaaaggtgtctttttttttttgagactgagtcttgctctgctgcccaggccagaatgcagtggcgtgatctcagctcactgcaacttccatctcccagcttcaagcaattccctgcctcagcttccccagtagctgggattacaggcatgtgccaccacaccagactaatttttgtatttttagtagagacagggtttcaccatgttggctaggctggtctcgaactcctaacctcaggtgatccacccacctcggcctctcaaagtgctggaattacaggcatgagccaccgtgcttggcccgaaagttgtctttttaagaaacttcaagggaggaccaaggcctgcgattcagtgtggagcagggaggatccaacaggcccagccctcagggagcatagtcagaacggggctgggagcgggatttggggcttcccctcacctcccagggcctccatctctgtgctcctgcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccaggtaccggcctgggggctgagggagtgggggagccccacagcagagcctgggggctgacactgggcagggcggaaggaggagaggcaccagggcaccaggagcatggggcgggaacaaaaacacattgtcccctcggggctgtgaagaggcaagtgctggtgcccaggcctgggtcagccctcaagaccagaggaaactagggatcttcatctttggggctccctttcaaggaactccagaagccctgggtaggggcagagcagagggcccaagatgcaaacttccatgcactcatcacccaggacattcatgggcaccaggccataaactatctttccatggaaacctccagccccaacgtggcagggtcagcagcctgcagagcagcagagacacaggtgggccttaggcctgacctagtgcctgggtgcagcagggtcaccacccctcccattttcctcccctcattcttcctatctggcatgtcttggagcgcacaaagggctctgctatctaaacccttgacccaaaatgttatcactaaccaccctgaatacaaaggccccttcccccaagcagaagcacaactcaaaggaacccagcctcctccccctgccacacattgcccacattgaagaaccaaatcttctcctttacccacattgataaaaccaaatcctgggacagaagtgcttcaaggccgaaacagagagcccatctcttgtccacacagcatgggtagtcctggctgggtgcagaaagcacagtctaggggttttgagaaaagggagctctacctggaagagacatcctaaagaccctctcaccacactctggtttttcttcagatcgtgtaaatctttcaccttttactaaagaacccctgtgtccatcctcccaattccccctgccttctgctaccagcaaaaatttcactccaaactaaacctcaggaaaagctctctcatcctcctgcaggtcagagaagcacctttccccacacagatttaggtatgcttatcaagatagctcctagacaagtacaaaagaaaaaaagaaaaggggccgggaacggtggctcacgtctgtaatcccaacactttgggaggccgaggcaggtggatcacctgaggtcaggagttagagaccagcctggccaacatggtgaaaccccgtgtctactaaaaatacaaagattagccgggtgtggtggcaggtacctgtaatcccagttacttggaaggctgaggcaggagaattgcttgaacccgggaagtggaggttgcagtgagtcaagatcatgccattgcactccagcctgggaaataagagtgaaactccgtctcaaaaaaaaaaaaagggggaaaagtagctaacacactgccactctcccctcctatgtccctggcagacatcactaatcaatcttagcactctttcctattgagccaggtagccatctcagaactcatctgacatcagccctccaggcagccctttaccgactgatcagagcggatacttgaggtgaaactgtccttacagaggttctgcctcattcggagggtacagaccctgccttcccatagattgtagcagttagtagggtcccaactggagcaggagatttggagggaggagggggctgagcaccctatatacctgaccatctgtgctccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcgggtgagtgagctggcaccagccatgctggctggacttgacttttatgtatctcctttttggccagaacaggggtgatcaggtccctctcctggctcctggcagcgcacctgctctggtgggtggggcagcctagggtttctacacacaatctcaatctcttattttggtctcaactctaccaagagaaagaggggataacccagccaggtggagagtggtatgggagaggggaggccacacagtctaaagggtgtcaatctcccgccgacttcagggaacagtgccaagtctggagccctaggccacagcgagatgatgagcttggatgaaagcagcttccctgccctggaactcaacaacaggcggctctccgtcaagaactctttctgccgaaagaacggcctgtacaccaggtactgggccctctgcgtgggtggggggccaggcccagcagtgcccgggtggggggccaggcccagcagtgcccaggtggggagaatgctggggaaggccatagagcagggagtgcccacctggccataccttgtcctgggaaacaccattcaagccccagggctgggaacgatcagcagaaagacacagtggggcccaagcaggacaactagggtcccagtccccaccatgcccaatcacagcctggggggtgagggcgcactggggagaaatttacaaggaggtagctactaagagttcctgacagtgacagtggaatgcaaataactggcaaaatttttcaaaccaacctactgatgttcggagccaactgccagggaaacagccctgcagatcgtcactggccccaaaggcaagacaggcccagccaacgcagaccgagcaaaaacaccttagcgaaggacgcctgagcacccgcattatcgctatgccctcctgtcttcctccccatttgggaaaccctctcccccaggtccttatttatacctattaaaggacaacctcctatccccatcagcctcaaagggcagcatctgaaagcagcccatgaggacaggacaaggctcgtggcgcaagcacagctcctattttcttctgacttctttctaaccccagccccctcctaggccctactccctgtggccatcgggctgcccatttccaagggcaggagcagctgctggggcccacctgaccctcccctgatgtgtggcggttttctgttcccctgagctcaagaaagactgggccagagggctcctgtctccagcctcagccctattggcattcccagctcattggaggcggcagtcaggaggagtccagcctctctcaggagctcacaaagcttccctctgtctctgtcttagagggacgaagctatgtgtgtgttcatctagaggatggagggaggagctcccaaagccgagctcttatcctctgccaaatccagccttccaaagaaagagctgtttgaggcccccacagcaggcccagccaggcccagcatggccatagcagccccgccaggctggctccggggccctgctacatgtaacaagggggcatttcacacgtggcctcaccttcccctgcccttcccagcctctcctacccacagtgcacacacatccaggcccctgtgtgcccccaaagccactgtgtgtacacaaaaatcccgtttgcaccaaagcagccccaggatgtggggtcctgaacccagccacagtgacatcccccctacattcaccctgcatgttgccatgacagcattagccggtcaccccatttttccctctttgtcctcctccagattcctacctcccaggcccgggcccctggaaggcagacccaggaaggaggaggagcacagggtggcagggatccgtgttccccaggcccccactgtggtctccctaggccaggggaggccgctctgagtgagtgcacctctcagccccactcccccgctctctccaggtctccccccaggcccagcccaggcagcctgcactactcggatgaggatgtcaccaaatacaacgacctcatccctgcagagagcagcagcctgacggagaagccctcagaaatctccgactctcaggtgagggcaggagggccaggtgtcctgcagggggcagggagcagcgcctcccagagtggggcagtgaacgtagatgggctttcttcctttccttcaaggggcagcaaatattaaggggcccaagaaaccaccctgaagtcatatatgggccatttgtcccctcccaagttctgctcaaagtttgcggccagtgccaatggggtcccgggaaccttgatcatagggggtaccccgaagaagacggccctctctacgttcaggggtcaccccacaggcttagttactcattagggctgtcctgcaagagagcacgctgaaggtgcggagagggagactctggggagaaggttgacacacagccctgcattccaggccagagacctggaaaaatgctcagcttcactactcacgcatcaaaacagcttcagaaacaaagggctgggtgccctggagccccgaggatgagaagcagtgtagaccagggagacattaagctttggaggtttggacctgagtgtgaatcctagctttgctgctcgtgacctgggatgtcctgggtgtgccaagtaacctttctaagcctcagtttccccatctgtggaacaggcaggggtgatactaggctctgtccgaggctgtggggaggatctgctgagttagacactggtgaactcagtgtagagccaggcacacggcaaccattccgtaaatgtcagcttttatatgaagagggggtcggtgcctctggaagacacagagcttcagagagcggccattaggtgggtcacgtggggacactgtcccaggctgtgtggggaaggggctgtgtgtattccaaccatgcagccttacagcttcccaccctcaccctctgcctcagccaagcccagtggttattgaggaaagggccacgaaaggccactgcatcccacgccctggacctttctgcccaggcctgggagaggaagtgaaggaagaggtgccagcagggagctgggctgctggctgtgcaggaggtgccaggaagcctgggatcacgctgtgggccccgtgggctgagggcctcccactcactgctgttttgttcagctccagggttactgatgggcttggcagagctgagaaggctggacctaactccctagctcaaagctggcagggacagagacccccaacttagcatggcttacccaggaacttattgtgggggacaaaacccacgtgatccaagttatgagtttttttgttgttaagccagggtcttgctctggagtgcagtggcgcaatctccacttactgagacctctgcctcctgggttcaagtgattctcgtgcctcagcctccagagtagctgggattacaggcatgtgccaccacccctcactaatttttgtattttagtagagatggggtttcactatgttggccaggctggtctcaaatgcctgacctcaagtgttcccccgcctcagcctcccaaagtgctgggattacaggtgtgaaccactgtgctggccccactgtggtccttatgaggctcctaaataagtcagtgctgctgccactcagccacgtgagaagcagctcggctaccaatcagcatctgcaatgcggagcccccaccattgcgaccttcaagtgggggctgatggggatgccactggtagttctcctgcctgtgacagtttgtgcaagggtacgtccctgaggatcagcagctgcacaggccagggcccctcggtttcagccgccaggaaaaatgactgcctctcttttcaaggacaccccttcccccaggtctttggagagtgggttttgcatacgccacctggtttatattctgagacagaccacccaaaacccactctccaaaattggcagaaatctgcccagtcgttttcctgtgatatggcaataaacaaagcgtcagtttgacttataaacaaacacatatgatgtgatgtgagaaaggctataattcagctgggggtgatgggctagaggagagaggggctggctctcccgtagagggcccagggtgcaggagaagggggcaccaggcagagggcaggatgcacacaaagactggagatttaaaggcctgtttgatggaactttaacactgcagcctggctggacggcaacttcattttcaaaagaagagcccaagttttgtacaaaaaaaaaaaatgtatatacttagcacacaagtaaatctcaatggaaaagaaattccgagccaatggcacacaccatctaatcttgatcttcagttcttgcagtatcatggacagcctcttcaagtgcgttgaaatcaaattaagcacactttaaaaaggagaaacacagagcaaatcatgttttctttttctttttttttttttttcttgagacggagtttcgccctcgttgcctaggctggagtatgatggtgcgcgatctcagctcactgcaacctccacctcccgggttcaaacaattctcctgcctcagcctcccaagtggctgggattacacgcgtgtgccaccatgcccagttaattttgtatttttagtagagatggggtttcaccatgttggtcaggctggtctagaactcctgacctcaagtgatccacccacctcggcctcacaaaatgctgggatcacaggtgtgagccacagcacccagccgtgaatcatattttctgtactatttattatgcaccgatttataatagcaaacatttatgaagtgttcagtagaagccaggaaggattctaaggattgttcgtgaatgacaccacctaagcttcagagtcctctaggaagcactggtggcattaaggccatttgcaagtaaagatgatgaaaaagagagttgggaaggcccccacccctgacaacaagcccaaaatgcatcccgcccccattctccctattgacatctgccctgcataccagcacaggtaagactctgtgtggtacgtgggaggagtaagtgatgggtttgctctctatgaagctcattcattcattccttgatgcatttactcaacagctatttgttctgtacccacaaaatggaatcagacgctatataggaacgatggctacagtagtgggcaagacagactctaatgaatgttgcgttataatatgttatgatttactagggaagaccatacgtgtataaataaccacgttttcatttctcattcaaatattatggaaccacagcaacctgaggaagaaagtggtgaacaaaagtctttctctttttttttcttttttttttgaaatgaagtctcgctcttgtcccccaggctggagtgcaatggcttgatctcagctcactgcaatctctgcctcccaggttcaagcgattctcctgcctcagcctcccgaatagctgggattacaggcacctaccaccacaccaagctaatttttgtatttttagtaaagacgggatttcaccatgttggccaggctggtctcaaactcctgacctcaggtgatccgcccacctcggcctcccaaagtgctaggattacaggcgtgagccaccgcacccggccaagtctttctgtttctttcctgcgatgcagaggcagataaagcaccataaggagaccacttcccctggaggctcagagagggctgcctgaaggaggtgtcatttatttgagctgggcctcaaagtgtgaacagcactgggtcatgcctagaagggaagcgtgcaggtttgcagctggctggagcagggttatgttctgccgtcaccattctactgaacggctctgaccttttgcctgtgtttgcctcttttccatcagattgggccatgagtccaacaggctcagctgagacctcgttgatagcctgaccatcccccagatcctcgcagcccaaagttgtgccaaacaagaaacgctgtggggcagagacaggccggggagaggcaaagctacatactgtgtgccaagccctgtgctttgtatattctcatttaacatctagctgtcctgccatgcaagtgaaactatccccatttaacagctggggaaactgaggttcacagaagtgaggcagtatgcccttggtcacagagctcagaagtacaagcaactgggattcaaatctagagccagcttgcttggagggtcatgcctactgcagcctggcctcgtgcagctgcccagcacggagaggagattgaaggaaagaggccttcactgcctccaaccccaccccagtgacctcccttgagcctcctgaccacagacatctctgacagccggttgtgggtgtggggggagggatacacattggctgtcactttacctataagggcacaggtggcacatatgacattgcttctgagctgacatttttcaaaggacattcttgggagatttccagctatcttaacacagggagcccagagcctcgacaaaattgtgcctccaggggcacaattctgaggttcttcagagacacacaggagacacatcacccctaccccacctttaatccagaggctgcagcccctgcagagagaccctggctggccccccgggtagaggcatccaggggacaggcggaacaccccgcacagatgcgctgccggcttcaggctagagtcagtgcagagcccctgggaccgtggatgagggaggggctcctgcttccagtctcccacggagtttcacaaggtgacttctctgtcatctagggcaacacattcctcccagacttcatgagattcaacaagataagggtcccctgcctgaccccaaggtctcaacaccatccctaaggctgagtctggtgccagatcctttgggctggagatgaacaaaaaagcaaaagggctttgctttgcttcctcttttctccaggggtcctgcctccttctggccctccctccccactcccatcaccaggcctggagtctgtgctccccctccgcagaccccagtaattgctgattgagtggctttgaggagctgttaagagaccagggagacgaagcagtcacttgattgcctggcggcctggcaggacagcccctgaaaggccccctttgtgctgggccggtccctgggaagctgcattcaattaccgaggcccgtgagaattgaaagctgcaataggagcccctggtctccccctcgctttcttctcttctcgccctacccccactccgaaaagaaacagatgttcagggagatggaggcgggagcagcagtcgctgatgcaaagccctcctgccttggctttggaaggcggagcgggggaagaggcagaccagactctcgcctgcctggcccctcccgcagcgcgggctctgtttggctccctgctctcccttctagtgccttccatccccgagatgctgcccatagagtgcctgggatcagtaggcattctgcagatagtagctggtaggacggggatggtctagatgagtgggctttgggatctgggcccctaggagggctagagaatcccactccccaccttgcttccagtccggacatgcccctgtcttggagtcgggggttagtgggtggggtatcagctaaccttctactcccattccagctgcctgagcactgagtcagcctccccggcttcctggccccttctaatccctcccaggggagctttgaggcttctcactccatctcttccctttcccacccaggcccaccctcactgtccccattgataataccttttacagcattctctcctgggttagctcatttcaccctgtgaactatggaactctacccattttacagacaaggacactgaggctgagagagcctgagtgatggcttcctctgctggtaagagccagaacttccccgtgccacaagctcctccccccagagactcgtttcactgtgggatggtcccacagtcacccaggggttccttcctctgcaaagctggggcctggggctagccaaaattctagaacccctggagctgatgctaacaactgttcaagtcagttagtgggtggaaagaccgaacctgtagggaaaactgggggacatccctgtctggtcccccgcattcacagaccctcactgttcctgggcgggatggacccccagcctcctgcctcacagatccccgctgctccaggccagcctcactcggcccagcatcaggtgcccccgctcggcatatggagtctccctggcctgcctgtgccccctctttgttctcctgggcgggcagctgggcagtaggcacagaaaggggcttgtattgtgctgcattgcgtcatggggcagaccgagcccagggactttccattgtcttgggcagccggctgtgcctgccaagaggattgaggtcctggcgggggagtgtctgctgcaggggtggtaaggagagtggctggggttgtagaggggtgaggagagggaggggaggggccagagaacataaattagcagatggactagggagtatttaattcctgctgggagtcggggtggggggtttggggggagctctcgttcccatcctgtggtctccaggcaggagtgcaggagtgtaggagttaagaggtgtgtgggctttagaaaatcaggcagattggagttcaagcccggccggatcacttccccagcaaaaccctcacccttcctgtactttatgtgcccgtcagtacccaggcagcgtcggtgctcaggtagcaataggagctgccgcacagaggtgtgaaaactaaatacagttatgcatgtcagcgtttcagactgtctggcagagggcctgctccattagcggggatcattatagttctattcattgtagctacatccctcgagatgtatccccatgttatgaaggactccgagttcctgagaacaagccgtgcatctcatttcccaaagcccagaccctctggacaaaggtccccactccattttctttacctgtaaagcaggacacagctccccatcccaaacttgtctggattgggctaactggcttttatgttctacttggattgctgtgattcgctaactgcccccaggcaggggcattagctgggcaggactgaggaggcctgggtggggtcctctgagctgcagtgcactgatcgtgtgctgtgcgctaaaatcggagcacttctcttccagagagttctgagggggggcccatctgttgtcttattagctctcaaaacattgctgggagctcagggtaggggaaggggtgcaccatgtttttagctccacaattcagattttactttccaaccgagattgattcttgtttggggctgatgtccccaatagatagatgaagcctgtgcctaggacatcaaagtgtcaaaaaaaaaaaaaaaaagtcaggaataatttaatatttttatctttaaaagtaaaaaagaacttcaggctgggtgtggtgtaattatgcctgtaatcccaacactgggaggccgaggcaggagcatagtttaggcccaggagtttgagaccagcctaggcaacaaagagagacccctgtctcttaaaaaaaaaaaaaaaaacagaccagccacggtggctcacacctgtaatcccagcactttgggacgccgaggtgggcagatcacctgaggttgggagttcgaggccagcttgaccaacatggcgaaaccccatctctactaaaaatacaaaaattagccagatgtggtggcacatgcctgtaatcccagctactcaggaggctgaggcaggagaatcacttgaacccgggaggcagaagccaagatcgtgccactgcactcaagcctggacgacaagagcaaaactccatctcaaaaaaaaaaaaaaaaaaaaaaaaaaaaactttaaggttttcattacatgaaaattctgaactttggtttagatttttctcatgcttagtttgtaaccaagtgttgtttttatgttggatcacacgtggacaggcacaggcatttttcactgtccagagcctctaaaggtcttaattaggctctggctttgtccccagtcacaaagtaaagcagaagctggaccaagatggtaacttagtaggttgtggttgaacctcaaaaacatgacactgtgtcagagaagccagacacaaaagaccacatattatatgatcccatttataggaaagtcccaaataagttaatccctggagacagaaaacagattagtggttgccaggggcatggatatagggagtgaccggtaggggcagagatagggagtgactgcttcctgggtacaaggttttactttggggtgatggaaatgattcagggctggatagaagtggtggttgcacaacactgcgacggtcctaatgcactgagtcatagactttagaatggttcactttcggttatgtgaacctcacttcaattgaaaacaaaggtagactgggcacggtggcccacgcctgaatcccagcactttgagaggccaaggcgggtggatcacctgaggtcaggagttcaagaccaacctggccaacatggtgaaaccccatctctactaaaaatacaaaaaattagccaggcatggtggcaggtgcctgtaatttcaactactccagaagctgaggcaggagaatcacttgaaccgggtaggtggaggttgcagtgagcccagattgcaccattgcatccagcctgggcaacaagagtgaaactgcgtatcaaaaaaaaaagaaagaaagaaaagaaaacaaaggtaaggtaaagtagctcacgcctgtaatcccagcactttaggagaccaaggcaggaggatcacttaagtccaggagttctagaccagcctgggcaacataaggagagctcatcacaagagaaaaatttttttaagttagtggggcgtggtggcatgcacccatagtcctggctactcagaaggctgacatgggaggatagcttgagcttaggaggttgaggctacagagaggatcacaccactgtgctccagcctgggcaacagagtgattccctgtgccccttccactccccgccccccaaaaaaaagaataaaaaggaaagaaaatttgccagggatagtggctgacacctgtaatcccagtactttgggagggtgaagcgggtggatcacttgaggtcaggagttcaagaccagcctagctaacatggtgaaacccctaaacataccaaaaaaattagccaggcgtggtggcacatgtctgtcatcccagctactcaggaggctgaggcaggagaattgcttgaaccagggagtcagaggttggagtgagccaagatcatgcccatgtactccagcctggcaacagcgagattctgtctcaaaaaaaaaaaacaaaaacaaaaacaaaaaaaaactcaggtcttctgattctatcaggtatctcccagctctgggccaaccccatagtagatccttccggttccggatctgctgtgaaggaagcagcaggcgggcacaaacgggcaccagacccccttggcagtgagggggctgggaggcccacagtccaagtcttgaaagaggcagagcagagttttgaaccagaatgccctgtgccttccggccccaaccacaatggcctgtccctacggggccactgacacaccctgattctctgtcctcccagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcgctgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacacatacacatacacaatctgctccaaggagtgttctgcaaaaagccacatccagtggccaggatcttcccgtccacttggtacttacggatgccagggtttagggagaagcctttctatctaactccatacattgtccaaggccctctgtgccctcagccagccctgtaaggccagcccaacacctgccccaccgctgagatgggtggcagatggcccacaggggcctgtctgattcagcgtgagccccttcgtggagcagggctccctctgtgcactgtgtacaggcgctgctggccctgcccaagagatgatgctctgttggggtgggtgagcagagttcaaggaagcccaagtaggagatttgggaaacatgccaaggtaagagagagcctggaccactctcctacagccccaagtcagtcactgtgctaatggtgaccgggaagggaagtcagggtctggggcccaaagaacgggcacacccagccatgagtttttcctgaagcacttgacccctgggaaatgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatggcagcacatctgcagctgccggcctgtgatcgtgccgcacagctttcttttctttcctctcatcttttttttttttttttttttaaataacttcatccctttccctctctgctgagcatttaaccatttaaggaagttcccagtttgcattagggaattatttaagcccagcccagtgacggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagacacctggccacattagaaaggggtggtgggccctgccctttgtagaaagagtgggaccctttctggcctgtgattttccatgccagtgatgccagggcccctgcctgtgggactccacccaaagcaggttcacaccaggacacacctggcacctttggcattgcctccctgtgccctaagcaatctcccagtgttgcacccaggagcccatgctgggcacaccagggctttccccttcctggctgcgcctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgcccccacctggtgcacgctgcctcaaggccttctgttgctgcccacgcctccctgggcagtgcttctaaaggtgccagagcctcaccacagtgccactctggctgggcaggggcttccctcagcttcccagagtgcacatctgaaggtgcctaccctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttggagatttgaagcaacattcttttccttcctgttacatgaatggggtcacctgtcccagtatcatacccaagcagttcattccccagacagcaatttttagccatgctgtgcttttgcagagaagagtcaagggtctgacttatctgctctcttaatgcataagtgagtgccttccagtgaaatgcactattttatttattttaaacttttagaataagaacctacttgatgcaatgtgcaaattatagtgaataataataatagcaatagctaatatgtctatggcattcactctgtgccaggcacagttctaatcactttacgtttattaactcatggaatctttgcgacagtcccaaggaggaaacctgggacagggagactttaagtggcttgccctcggggagtggtggagccaggatttgtactaaagccttctggctctcaaaacataatgctgcctctctgatattttaaggcaagctccttgtccatttttattttaatttctacagagctagcaccccacttcccagtgatcttaatgccatgagaaatgctatgttgtttggtggatctaacccagttaatctacccagggttagagttagggcttagattgctgaatttatgagtacagcggtgttgcattataccacatttatctcacattacttaagtcatgtggactcaatagactcaagagaaacagagggaaaatctctctctgtctcctttttttttttttttgaaccggagtttcactcttgttgcccaggctggagtgcaatggcgcaatctcagctaaccgcaacctctgcctccagggtttaagcgattctcctgcctcagccttcccgagtagctgggattacgggcatgtgccaccacgcctggctaattttgtatttttagtagagacggggtttctccatgttggtcaggctggtctcgaactcccaacctcaggtgatccacccacctcggcctcccaaagtgttgggattacaggcataagccaccgcatccggccttttttttttttttttttttttttttgagacagagtcttgcgctgtcacccaggctggagtggtgtagtggcatgaggcatgaacacagctcactgcagcctcaacctcctgggctcaagtgatcctcccacctcagcctcccaagtagctgagaccacaggttcatgccaccacacccagctaattatttattttttgtagagatgaggtctcatcctgttgcccgggctggtctcgaatgcctgggaccaagcaatcctcccacctcagccttccaaaatgctgggattacaggcatgagccaccatacctggtagggaaatcattttaataggacatgtaatgccactcaatgagtacacttattttgcacagtgtacattattgcataatgcacatcagacattcatacagaggctgcttaactaaccaaacacaactaaagcagggaatttcatatatatatttttttcatatatatatattttgttgtttttgttgttttttttcttgagatggaatcttggcctgtggcccatgctggagtacagtggtacaatctctgctctctacaaccttctgcctccctggttcaagtgattctcctgccttggcctcccgagagctgggattacaggagcccaccaccacacctggttaattttttttttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttatatttttagtagagatggggtttcaccatgttggccaggctgctctcaaactcctgacctcaagccatccacccactttggcctcccaaagtgctgggattacaggcatgcaccactgcgcccggcctctaacccactcttttatttatttatttatttattgcaactttctgtttccaaaacattgaacataattttcagaaaaatagttattctccttttctactcttattttatctacttacatcatatttaattaaattatgtaattactataaaaagtacaactggcataaacaagttcagaaacaatgataattgactccttgtaaacatacaactcaattcagtaggagcagacgtatgctggcctgatagaaagcagcctactaccttcagcattcaggctactgtgtacatctctttgttttgcaaaaggaatatagggtatccatcagtatggctagttcactaaacgggggtcagatgagactgcttctggacatatcacgcacaaaccgtgtatacggtactttatgaccgattttcaagggtaattttgactacagataattttgatcttatacatcatttggaatcccacattacacataaccccatgcccgctgctctgaggatgtttggttaaaagataataacatagccgggtgcaggggctcacgcttgtaatcctagtactttgggaggccgaggcaggcggattgcctgaggccaggagtttgagacccgggcaacatggtgaaacttcgtctttactaaaatacaaaaaattagctgggcgtggttgtgggcacctgttaatcccagttactcaggaggctgaggctcaagaattgcttgaacccaggaggtggaggttgcagtgagccgagattgtgccattgcagtccagcctgggcaacaagagggaaactctaagaaagaaaagaaaaaaagaaggagaggagaggagaggggagacgaggggagcggaggggaggggaggggggaggggggaaaggaagagaaggaaaggaaggaaaggaaagaaaataacatggaagacattctggacctggagtcagaagagtgggttctgattctagaatggtcccttgcaaatggagagacttaaagcatcttttctcaggggaagtgagtggcccctgatctaccaccaatcaggttattataaagatcaaataaaataatgggacttggaggaaaacgctttgaacaccaaaatgtggcaggcacagaaggcatttctgttctagacctgccagaaggctcacagtgtcccttaattccttttttcttttcctttttgtttttttagacaagggtctctctgttgcccaggctggaaggcagtggtacaatctcagctcactgcagcctcaacatcctgggctcaagtgatcctcccacctcagcctcctgagtagctgggaccaaaggcacacgccactacacccagctaatttgtgtgtatgtgtgtatttttagtagagatgagctttcgccatgttgcccagactcgtcttgaactgctgggctcaagggatccacccaccttggcctcccaaagtgctaggattacaggcatgagccaccgcacctggccagcgttcggttccttaattccaatcttcctcttcattgattttgaatcccagactggctcctccctaattgtggccagtgaactttggccatctacagctctgtaaccggtcaaatacagtaggggggaagaaacaatgactacacacacacacacacacacacacacacacacacacacacacacacacacacacacacagtaaggtaaatctgctaagaagatgggtggtgaaatggcgctttcgaaaaccaaggagaagctgggcgcagtggcttatgcctgtaatctcagtgctttgggaggccgaggtgagtggatcacccgaggtcaggagtttgagaccagcctggccaacatggtgaaaacctgtctctactaaaaatacaaaaaaagttggctaggcgcggtggctcactcctgtaatcccagcactttgggagggagagctgaaccgacctttccgagtctatcagtcaagctggaaagcaatggcgcactcaacacaggcccatttcaggagtttcaggaagagaccattcaccagattgtgggtaaggacccggggtagtgagagctggggtcatcaccaccccaggcctggctggcaaatgcagggagaagtcactggaacctgcagacagagatggctggcaggagacagagacgcccaacagaggcagggagggtgctaggggatccatagctcccaacctcgctctcctaccgtcttccattctcctgggctttttctttctttccttattattattttaataatttattttttttttactttcttttaaaatagagggaagttcttgctatgttgcccagggtggtctcgaactcctgggctcaaggtatcttcctgcctcagcctccccaaagtgtgagccactgtgcctaccaccatgtctggcttttttttttttccctgagacggggtcttgctttatcacccaggctggagtgcagtggcatgatcatggctcactgcagccttgaactcctgagctcaagccatcctcctgcctcagcctcccaaatagctaggactataggcatgcatcaccatacccagctaatttttttttttttttttttttttttggtacataagggaactcaccatgttgcccaggctggtcctgggctcaagcaatcctcccgcctcagcctcccaactgcctgggtttcttatggtccaaaccaaatgagaatttggaagacactgagatgccatccacacggggcagcctcccagtggggcgcacagcaaggtcgggggataggaggggccaatgggaccagcaggcccacggcagtgcttccctgtgccttccggtgctgctgtccccatgaccccttaccctcttttacccagggcccatcatatgcacgtctcatatactcttttcttaacgcccataaagagtgagtgaaattggatccaaagaggtttgctgagcgcttctaccacaaagggtgggattttctagtgtgttgtagaaggtaagaagtctttgacgggggactgggcgcagcggctcacgcctacagtcctagcactttgggaagcagaggaaggcagatcacctgaggtcgggagttcaagaccagcctgacccacatggagaaacctcgtctctactaaaaatacaaaattagccgggcatggtggtgtgcgcctatagtcccagctacttgggaggctgaggcaggggaatcacttgaacctgggaagcagaggttgcagtgagccgagatcgggccacaaagtgagactctgtctcaaaaacaaacaaaaaaaaagatgccgtgagtggagaggtgaagggacctgccatggaagtgccagaaccagaatttgaactccggctgcctggcttcgttgtgccccctcttttaaccatgaagcagctttcacccagggttaagacactgcttgacctggaggagaaaagtaggggagacctccaaactctgggtgggccacagatgaggcaggaaacattgcttccaaacaacattgtcctttagctgggcgtggtggcatgcacctatagtcccagctactcgggaggctgaggcaagaggatcacttgagtccaggaggtcgaggctgaaatgggctatggttgcatcactgcactgcagccggggcaacagagcaagatcttgtctcttaaagaaaaaatgttccggccgggcgcggtggttcacgactgtaatcccagcactttgggaggccgaggtgggcggatcacgaggtcaggagatcgagaccgtcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagtgagccgagatcacgccactgcactccagcctgggcaacagagcgannnnnnnnnnnnnnnnnnnnaaaaaatgttcctggggtcgacagaactttcttttgttttgagacacagtctcactctgtcgcccaggctggagtgcagtggcatgatctcggctcactgcagtttctgcatcctgggctaaagtgattctcctgcctcagcctcctgagtagttggaattacaggcacgcaccaccacacccggctaattttcgtacttttagtagaggcagggtttcaccatgttggccaggctggtctctaactcctgacctcaggtgatctgcctgcctcagcctcccagagtgctgggattacagaggtgagccactgcgcccggcctcagcaaacattttccctaaagggttttgccggccacagagtctctgtcatagtgcagaagcagccacagagaatacataaacatatgtgcatggctgtgttccaatccaattttatttaaagactctgaaatttgaattgtatataattttcacatgtaacgaaatatcattctggcttttatttttttctgaatcatttaaacatgtaacaatcattcttagctcatgggccatacggaaacagatgggg

SEQ ID NO: 105 - DNA, 7039 bp, Homo sapiens
atgaacgtgctgtctctgggtctggttgacagcatcagcaccgtgtttagcattctctgcaaactaaacgtggcgggatgtaggcaagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatg

SEQ ID NO: 106 - protein, 2021 aa, Homo sapiens
MNVLSLGLVDSISTVFSILCKLNVAGCRQAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHDAGTYTCLATNSRGVDEASADLVVWARTRITKPPQDQSVIKGTQASMVCGVTHDPRVTIRYIWEKDGATLGTESHPRIRLDRNGSLHQTWSGDIGTYTCRVISAGGNDSRSAHLRVRQLPHAPEHPVATLSTVERRAINLTWTKPFDGNSPLIRYIMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSATTSSSMLVRWSEVPEADRNGLVLGYKVMYKEKDSDTQPRFWLVEGNSSRSAQLTGLGKYVLYEVQVLAFTRIGDGSPSHPPIRTLDDVPGPPMGILFPEVRTTSVRLIWQPPAAPNGIILAYQITLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGIGYRLVYEPCSPVDGVSKIVTVDVKGNSPLWLKVKDLAEGVYFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 107 - DNA, 5370 bp, Homo sapiens
atgaacgtgctgtctctgggtctggttgacagcatcagcaccgtgtttagcattctctgcaaactaaacgtggcgggatgtaggcaagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcaggtgcgccccgccctgctgggctgagaccccacagctcattatctcccttcttcctgggtccctccacttggggcacttgcctctgtcctccgcctgagaaggcgcttgtgctactacaggtgaagtcacctggccctgttgaggagtgggaaactgggttggggggctcc

SEQ ID NO: 108 - protein, 1772 aa, Homo sapiens
MNVLSLGLVDSISTVFSILCKLNVAGCRQAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHDAGTYTCLATNSRGVDEASADLVVWARTRITKPPQDQSVIKGTQASMVCGVTHDPRVTIRYIWEKDGATLGTESHPRIRLDRNGSLHQTWSGDIGTYTCRVISAGGNDSRSAHLRVRQLPHAPEHPVATLSTVERRAINLTWTKPFDGNSPLIRYIMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSATTSSSMLVRWSEVPEADRNGLVLGYKVMYKEKDSDTQPRFWLVEGNSSRSAQLTGLGKYVLYEVQVLAFTRIGDGSPSHPPIRTLDDVPGPPMGILFPEVRTTSVRLIWQPPAAPNGIILAYQITLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGIGYRLVYEPCSPVDGVSKIVTVDVKGNSPLWLKVKDLAEGVYFRIRAKTFTYGPEIEANVTTGPGEGAPGPPGVPIIVRYSSAIAIHWSSGDPGKGPITRYVIEARPSGAPRPAGLRPHSSLSPFFLGPSTWGTCLCPPPEKALVLLQVKSPGPVEEWETGLGGS

SEQ ID NO: 109 - DNA, 6258 bp, Homo sapiens
atgaacgtgctgtctctgggtctggttgacagcatcagcaccgtgtttagcattctctgcaaactaaacgtggcgggatgtaggcaagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggc

SEQ ID NO: 110 - protein, 2066 aa, Homo sapiens
MNVLSLGLVDSISTVFSILCKLNVAGCRQAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHDAGTYTCLATNSRGVDEASADLVVWARTRITKPPQDQSVIKGTQASMVCGVTHDPRVTIRYIWEKDGATLGTESHPRIRLDRNGSLHQTWSGDIGTYTCRVISAGGNDSRSAHLRVRQLPHAPEHPVATLSTVERRAINLTWTKPFDGNSPLIRYIMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSATTSSSMLVRWSEVPEADRNGLVLGYKVMYKEKDSDTQPRFWLVEGNSSRSAQLTGLGKYVLYEVQVLAFTRIGDGSPSHPPIRTLDDVPGPPMGILFPEVRTTSVRLIWQPPAAPNGIILAYQITLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGIGYRLVYEPCSPVDGVSKIVTVDVKGNSPLWLKVKDLAEGVYFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYHSRASKAGVQKEGENRERMCVASSSSALRWWGSLLPWELHGAGEVAVSLLWTRSGAGIWRERGSGG

SEQ ID NO: 111 - DNA, 26929 bp, Mus musculus
  misc_feature (1)...(26929): n = A,T,C or G
tgctggtgcctggggaggggctgtggctgtctcacatcgtggcagataatattctgtgcggtcatagtgacagaaagagataccacatagcataagaagagcagaagactgagaaatggccaggctccttcgattataacaagccattgtcctaggactaatctactctggcaatagtcctctcataaggttgatcatgacctaatcacccctagacttcatcttttaccttccaaaaccattacacagaggaccaagcttccaacatgtgaatctttggagacaaacaatgtctaaatgacagcagcataattcctgggtaacttgtgacatcaacagcttctagatgtcccagaacataatatggctctaggagcccaacagtaccattacagtgcctctctataaagacaccactgactgactgcatgataccaaagcctttataatcacaccgggatgctgtcatcccaagacaggcagtagaaactcccagggcatagtctaagattccataacacaatgctgggtttagatacacacactcacatgtgcacacatatgcatgcacgtgcacacgcacacacacacacacacacacacacacacacctctacaggatcctttgctgtgcccactgacctagctggctcctttcagatccatctcctgcctgctctgcgtgtacatgggctgctatctggcatttttgcttcattcctggacctgtgaatgtgtgtagtgacttaggacgtgttaaactctctttctcctcctcttcatcttcttccttttcctcctccatatccccttctttttcattttcttttcttcatgtgttttcttcattagtaaatgctaaacttaaggcctcatgcatgtcatgcaagtactctactactaaacaacttcacccatccttagtgtttcgagacagtcttattttgtagctctggctggtcttgagtttgtgtttcttctgtcttaagctcctaagtgctggtgttatagaaaggtcccatccctcccatttccttctaagacattcctggaggattggctagggcggaaatagtcatgagttttagaattgtgagtgggaggctatatttacatcgctggtcatagcaactgttaactaagtactccctatgccaagagttttattaagcaacctcattaatcctcgtgcctgtttttctgttgggcagggcatgacttccttgtaaggaaaccaaggcccagagatgaaaagattcttgcccaagggcatgtggctattaagtggcacgttttgactagtgatcagaatcatagaagacgggagctactctatattttgtgctagcaatgaggccagggaaggcaaaggcagcagcctagccactggggactagggtgagccccatcttatccaacggctctgcagcagcctcagcagttctaaccccacttgtagaacacctgggtgtagagctggttgcttcctgcctctgtcttcgttcagcttctagaagattctctatggaaactttctatgtttacccatccacaactaccttacacttctctaggaatctgaaagattctccagtcagatgtcttttcaaaggcaattacataatctctgcatagcaggtctgtctggtaagctcagtggtttcttttcaaaggactgtttttcaaatgactgtttcttttcaaatcacacgtctcatgaccatggagaactagatcttgatatgtagggccacagggactgtatgttagttcagtgagactgtatagtcccccaaaggctgaaaggtcagcacagatgactggagctgctcagactgttgcagatgctgagtggaacatgaatgtcaccctcaccaaccacaagtgcaggcccagagcttgttagaagcgcagttaaaaaaaaaaaaaaagatctggccaaaactctcttttccttcatgatttatatttttccaaaagctgacgaattgcctcggctaatcaaagcaggttgtcagcaaagagtacaagttaatcttaaaaacaacattcgtccttgtcaggctttctgcaaatactgtacatgagcaaattaggttaggaggctatttactaaatgtggaaaaatcaataatgttccagaaagactgtttacggagacgaagatccaaacaaaggctcccaagtagaagacgttgaaaagcacaaatttccatcttcagtaaaggaggtacacttctgctcccctgtgttccctgtgtgtatgttgggagtagggtgaagaggaaaggaactgcaatagtcattctttgcttcagagcctcagacacccactggtaggtggtagcttctaggtgctgtgcctgcaggaagcaactggggctaatcgctttttccatttaatcccctctgtcttagtcggggttcctattcctgtgcaaacatcaagagcaagaagcaaggtggggaggaaagggtttattctgcttatatttccatactgctgttcatcaccaaggaagacaggactgaaactcaagcaggtcaggaagcaggagctgatgcagaggccatggagggatgttctttactggcttgcttcctctggcttgctcagcctgctctcttatagaacccaagactgccagcccagagatggcaccactcacaaggggatctccccacttgatcgctaattgagagaatgccttacagctggatctcatggaggcatttcttcaactgaagctcctttctctgtgataactccagcctgtgtcaagttgacacaaaactagccagtacaccctccatagcaaaaaagcatcggggcctttattctccccatttgataagtggggaggccaagcctaaacagggaagacttaacccaagttcagggccagcagaaaaggtccatatttnnnnnnnnnnnnnnnnnnnntatccccactactctccctaccccacctctatcccactgcatcctggagaagggaccctccaccatgtgcttattttacatatcaaagcagacctggcctccagattctcccagcatccctcagtccctacctagcataccctgtccccaaccctgaactttccagcccaggggctgggttgccctttctccagcagcttctccctatataatccagacattttggtctctttccttctccttctctctctctgcatattcactctttttctctttctcttccccctcccctttcccttctctctccccatggtgactttcctggccttattccttggggtcagtgaacttgcccaagagcatcttcccagtaaacatgcctttaatatattctaatctggcttcaattgactcatttcactggcagagaaataacctatcagttgctgttgggaatcaggaaccaacactccaaaatatggcattttgggaactgggcattttaaatgaaacactcaacaatgagcaggtgatgctggaggcatccagccctcttatctgcattaagcacagttgcacccaacagtaggggcttcgtccaattcttcaaattctccatctataacaccagagagaaatggcaacagctgctattgtccaagctggcatctgtccctggagcttgttcagatcctagaaacaagctcactttggccccagggttcatttatctccctcagatcattataaagatcagtggttctcaccctcccacagttaactcaccttgtaataaccccaaccatagagtcattttgttgctannnnnnnnnnnnnnnnnnnntgcaatagtcattctttgcttcagagcctcagacaccccactggtaggtggtagcttctaggtgctgtgcctgcaggaagcaactggggctaatcgctttttccatttaatcccctctgtcttagtcggggttcctattcctgtgcaaacatcaagagcaagaagcaaggtggggaggaaagggtttattctgcttatatttccatactgctgttcatcaccaaggaagacaggactgaaactcaagcaggtcaggaagcaggagctgatgcagaggccatggagggatgttctttactggcttgcttcctctggcttgctcagcctgctctcttatagaacccaagactgccagcccagagatggcaccactcacaaggggatctccccacttgatcgctaattgagagaatgccttacagctggatctcatggaggcatttcttcaactgaagctcctttctctgtgataactccagcctgtgtcaagttgacacaaaactagccagtacaccctccatagcaaaaaagcatcggggcctttattctccccatttgataagtggggaggccaagcctaaacagggaagacttaacccaagttcagggccagcagaaaaggtccatatttcaggaggctgagcccagcaggctccagatgggaagttgttttggcaattggcttgagtgcttcccaggtatgaactctttgggaaaggcccaccaggagcagagacagaggagcagtgcagtggctcagtagcttgccaaagtaacaaggcagtggcattagtggcatttgaactaagtatggatatcttttatatcttcggttcagagcaagggtcagtccccaacactccactctaagatgaaaaagtaccctagaatgccattgtttatagtaagctgggatctttgtgcccaagctgggctattgcagtagagcacatctccatgcaacagaatactttggagaataattgtgctgtaactaatatgaatagttttccttaatttattttttatgactaaagcaaaagattaaattggagaaatttcaattttaaaacatgctattcatgccaaagtttcacctgtagaatcccaggaggattagagtgagtttaaggctagtctggataggctatagagtaagatcatgtctcaaaacaaaacaaaaccctatttagattattcaagtacttcataaataattgtgtctcacaaactctattctgtgttcttgtcataaattttgagcattaaactcccaagccaaagtagttgctgtttcgttttctgannnnnnnnnnnnnnnnnnnntgttgctacttcataactgtaatctcgtcactgttatgaatctaaatgtaaatatcgaatcacagtgtatctgatatgtgacatttgtgaaagggttgtttgatgcccaaagagttctgtactcacaggttatgaactgctgctctagattttctgtgccccacccccatgaaaagggcatttatgctgagtgtgatggtgtatggtggcaatctcagcagtccagaggttaaggaaggaggggtaaaaattaggggtgagcctggactatagcatgagaggaagcctgcctcaaaattacagatgagaaaagggtgcaggacctaagtctcacatgaccttttctttgagtttcattatttttcatggctcctgagtgtgttcgtgtgtgtgtgtgtgtgtgtgtgtgtgtgtgtgtgtgtgtgtatgttaatctattgttagtttgtttgtacagagtatatttaaaattgccaatggaaaatgtgaacttccttgagtcacatgggataatagtgtcttagtgactcagttctcagaactcaggttctgtctagtcccttacactctaatactagcattcactgtgaatccacttatagattgtagaatcgtaggggcttggccatcataccttctgagtgacccccccaactattataagcttactctctgagaagcaaggataattttgaaactggctccgagtctggacacaccaagacacaaattcattacgtaacaatgcttctgtgcttcctataggaaagacatccagagcccattcaaggatagttggaaacagattttcaaaaacgaataatctcagaggaagccagtttgtctagtccctgactttctgaggtcacaggctcaaatttaccctcccagaacaggataactcactagcctggaggacagtgaatagcaaagagaagccatgactttctttctctcctctagagaaattcctcacaactgacgagggaggcaactggaacttgtgacaaatggctttcttttgctggtccactggtcaataaagggcttttaaattagaaatctatttgtttgtttgtttgtttgttatgtgtgtgtgtgtgtgtgtttgtgtaggtcagaggacaactcataggagtcagtttttcttctactatgtggatccgggggctcaaactcaggttgtcaggcttgtccaaaagtgcctttacttgtttacccactaaaataaaaagagacctgttagcattccttctaggctccaccccacttactgggcaacaaccaggtatgcctggctcagtataaaagaggctgtttgttccctcctcactctcttcctagcttactctcttaccctcttactctcttccctttctgtcccttctctcttcattctcctcccacactctctccatggcctctactcctctctctctttccctctcctcttcccctccccacttctcactctctgtctccactcctgtcccaagtcccttttccatgtcctaaataaagtctattcttaggaagaaagggatgcctcagaatgggcccttagaggcatcccctcccctgaaccttaccgcatctctatcaaacatatcctggttctttattctgtcttataaaacacaacaaagccttgttttcatccgttatacattttctgtgaatgaatcaccacctgcttccctgcatctgttaggttttcaacctgggcctgccctgtgtttagctgctggctctgtggaatgtattgaccctctgcccagggacaccctgatttctggctcactgttgaaatgtgtccttcatcaccaaggcagcagctgctgaggtcactggggccaccctgtttcccatcattctcttgcgccttctccattctatctgctacaaggctcataacacagtgcagcccatgctctcaccaccatgttggtgacaatgctgccaagtacacagtaggtgatcattgtgcactcaaggaagaagaaaccacaaaggcatacacaggcacctatggatggtaggagatgctgtgtgctacactattacatagtttgtctctacacctccaggagggagagagagagagagagagagacagagagagacagagagaagccagataaatcctggaatgacttctaagcaacaaacctgctgctaactgagactgaactgatcattccagttccagtgagatgtgagatacctttttaaaatcaattcagaaaaaaagctcagagtactcagcaagactgcaaaggagaaatagggaactataggctaagtctcgccaggcttgggattgttctggaacagtccccacattcttttctggtcctggaagcccaagtttgcatgctgaccatcacctaactccacttctcagtgtctacaaaaaggtcttatgttatctcttcagttttccccaaaggattccaaagaaaatcccaaatcatttcatgtcctggggctctactgtcttctgtatcctgcctcccatgcctcaggctctaggctcagtgcaaccaaccccttgtccacaaggccatggtgtatattctttcccacatgtgccccattcttagatatcttccccttagaacattgtttcttaatctgtggttgcgaccctttcaggagttaagtgactcacaggagccacatatcatatatcctgaatgtcacatatttacattataattcataacagttgcaaaattacagttaaaaggtagtaatgaaaataattttatggtggggggggtggtcactgcagcatgaggaagtgtattaaggggtcacagcattaggaaggtaaagaaccactgcctcagagtctaactccgttgccctttttattcccttccgtactgcctacttcccactaccggcttcggattctgataatggtcttttctgccaccccttgctttgccttatgttgccttcaatgaagtgaatcaatactgaattgttcacatttgtcactttttgaaatcatgaaggtaagaatacctccctgtaattagtgtttagcctggtatccaatatgaaaagttattagactggtagatggctgagtagatggatggattagtgcatggctgagtagctaagtggatgatgaggtggatggaatgctatggacacctgagaaaaggtttgagtgaattcttgggaatcaggtcttgttagttctgaactccagatagcattcccctaaaaacctgcctagacaatatcctgaaccccaataaaagctttgatatcctctcttcctctctccatccttctccccccttcctccctagtctccccctatcttctctctgtccttccctcttcttatttctctcccctccctctccctttcagtgttgccatagttccccacttcccactaacattgagatctgtggtaacacaaatctcttaattcacatgttcttttgggttgcttcctcttgcaagtcacgaccacactcacaaccgtgggcatcttgggaagaagaaattgcatctaataaagaaaacaaaacaaaacaaaacaaaacacccccccaccccaccccaaaaatctatcaggacatttgcccgtgtcaagccctgcctctggaaggggcatatgatctggcaggccaagactagaaattgcaaagtgacctcaaaagcaagtgagagaacagtgtagtcagctgccagcaatagaggagtgagtgctcaagatctgcccagaatcctgcctcagctggatcctgcctccactgggatgactctgtgaagtggcttttaacctatcttaggaggctgggctcattagcacacttgtgtggcctcattctgttactactttcctttatctcttaatctaacactttctccaaagtgttagactctgagtctagctggggtcaagtagaatatggtggtggctggggacaggggcagttaaacgtagtttccaccttccagtggctagctttgattgagacaggccttggcccaggtgctgtgagctgtaacgcctgcccgggtgttgattcttacatcgtgattttgagctgcagcctctgattgtgctcctgtgcctttgaactccgcctaagccttgggttagggaatatgacaaggcaggccaggttcattttcccatctttctgatcttttggggaccctgacacttcatttatagtgcactaggaaaccctgaaaactattttcacctttttaaaaaatatatatattctcatggagattgacattgttggaaacccagaaattcccacagccaaaatcctatttaaaagcttcctgtctatttaaagttcatgatgggaagaataaaagaaaaaaacgactccaaaaacagagacagggtacaagataggaaaaaaaagcagatccagtttgcttctaaaaaaggccgaaaactataatctttccatgcccttgtgtctcaagcgtcacatatttttctttcccttctggtggtttgcaatctgaagtggaattttatcatgggttacttggatgatacttttcaagtctctaccctcccaccccccaaagtctctgctcactggacagcatgccactggggctctttgtggtatgggaaagtgaacggactcaaaataaagcagccatatctcttggatcctctgtgtttccacagctctgagccagagactgccctctgaacaacaaaaccgtgatgaaggcaacaggagtcagaaggctattcatggcaggaaaccccagcatccggtgagaaataagaagtaggagagcacaggatgcgccctgggtcaggaggacgtgaaaagcgagtctttgtaaccttctcaatgccagagctgtggtagtgtgaaagcagcagtgcgcctctgctcccttcagagcacagcctggtgtcaaggtccaggttccaccggctgctgctgtcaccgcaggggagtctagcccctcccagaaggagacacagaagaatggccatctcaactggtttgttcctgctgctggggctccttggccagccctgggcaggggctgctgctgattcacaggctgtggtgtgcgaggggactgcctgctatacagcccattggggcaagctgagtgccgctgaagcccagcatcgctgcaatgagaatggaggcaatcttgccaccgtgaagagtgaggaggaggcccggcatgttcagcaagccctgactcagctcctgaagaccaaggcacccttggaagcaaagatgggcaaattctggatcgggctccagcgagagaagggcaactgtacgtaccatgatttgccaatgaggggcttcagctgggtgggtggtggagaggacacagcttattcaaactggtacaaagccagcaagagctcctgtatctttaaacgctgtgtgtccctcatactggacctgtccttgacacctcaccccagccatctgcccaagtggcatgagagtccctgtgggacccccgaagctccaggtaacagcattgaaggtttcctgtgcaagttcaacttcaaaggcatgtgtaggccactggcgctgggtggtccagggcgggtgacctataccacccctttccaggccactacctcctctctggaggctgtgccttttgcctctgtagccaatgtagcttgtggggatgaagctaagagtgaaacccactatttcctatgcaatgaaaagactccaggaatatttcactggggcagctcaggcccactctgtgtcagccccaagtttggttgcagtttccacaacgggggctgccagcaggattgcttcgaaggtggcgatggctccttccgctgcggctgccggcctggatttcgactgctggatgatctagtaacttgtgcctccaggaacccctgcagctcaaacccatgcacaggaggtggcatgtgccattctgtaccactcagtgaaaactacacttgccgttgtcccagcggctaccagctggactctagccaagtgcactgtgtggatatagatgagtgccaggactccccctgtgcccaggattgtgtcaacactctagggagcttccactgtgaatgttgggttggctaccaacccagtggccccaaggaagaggcctgtgaagatgtggatgagtgtgcagctgccaactcgccctgtgcccaaggctgcatcaacactgatggctctttctactgctcctgtaaagagggctatattgtgtctggggaagacagtacccagtgtgaggatatagatgagtgttcggacgcaaggggcaatccatgtgattccctgtgcttcaacacagatggttccttcaggtgtggctgcccgccaggctgggagctggctcccaatggggtcttttgtagcaggggcactgtgttttctgaactaccagccaggcctccccaaaaggaagacaacgatgacagaaaggagagtactatgcctcctactgaaatgcccagttctcctagtggctctaaggatgtctccaacagagcacagacaacaggtctcttcgtccaatcagatattcccactgcctctgttccactagaaatagaaatccctagtgaagtatctgatgtctggttcgagttgggcacatacctccccacgacctccggccacagcaagccgacacatgaagattctgtgtctgcacacagtgacaccgatgggcagaacctgcttctgttttacatcctggggacggtggtggccatctcactcttgctggtgctggccctagggattctcatttatcataaacggagagccaagaaggaggagataaaagagaagaagcctcagaatgcagccgacagctattcctgggttccagagcgagcagagagccaagccccggagaatcagtacaggtaaagtgccataggttacttgggtagctgggcagccagatgtaggcctgggaggcacagaccacagaactgagagcagagacaaacagtcagcaggccatttgttgtttaaagccaacctcagcagcccagtccaaaagtgcctatctgtcctatgagttcatgtggagtagcggcaaggggaccaaggatgcagatatggcagagttccatggcatctcacactgtaatcttctgttttccacagcccaacaccagggacagactgctgaagactatgtggccttagagacagctgccactaccttcagagctaccttcttagatgagggggaagccacatcattctgaatgacttgactggactctcagcaaaaaaattgtgcaccttccacttaagaacctggtggcttgggataggcaggtattttcttggtgcctttgatatgtctgggggtgaaagctgtgtgttggtttgtcattgtggggagttttgtggatattgacagacctcactcaaacacccttttcaaatccaatagcaactggttcctctggttcctaattagggggaaaggagtcagaggggtgggacagggtggggggatggggcttcaaagttttttcttatcacttgatttatcatcgaaggagttactggtgctaattacaatggaaacagttcctttccatcacaggacagacagcaaaccaatttaaaactacttaactaggtgagagtgctctacccttcctatagggactttttcaggatggctgcctttgtgtacatttgccttctggcatttccccttcacgtccccccccccccccagcccccttggtattgttgaaactgtcagaatgagaggaagttcaaccaactgcttagggagtaagctggcaggaagtttagatattgtatcccctcactcttaactttctgatagccttgggtttatgggcaagcaaagttacaagttgggaagttgcttcaagtgagtgagaggtcttggtaaaagcataatccagagggggaggcaggaggggattgttttaacagatatttgaatgaaaatatcagaatgaactgatgctaacacacacctgattattgagaaacaataacaaaactcctagattcatttgtctttgcgctagcacaggccccaactccactgcagggcaccctgtctacctttatactgtccctaactggaagctggtactgtaggctcagaaagccttaggaggctttcattctgaacgtaaggaaaggatgtgtgagccaggtgatgggctctattttaaatgctcccatttaagtttaccttagtccacttcacagttaaaagtacatctggaggacttgagccctatcttgttggcgtgacacataccaaaccaaggattagtcatgaagaaagttctctctctctctttttttttcttaaaaaaaaaaaaaaggagatagaggggaaagggaaaggggaagagagaacagctaaaaaatgtccagcctttaaaactgcttagagccatcttatgattgacatgtttatttcaaagtgtccatttacaaaagtgtcccttaaacttgcaaaagtgtcccttaaacttgctgacggtaatgttgtttcagctgcacaggtctgtctggggactggaaggcatccctggtgagtcactttagtatctctgggaggcttcatcttagttgtctctgctgtttgaaaagctgagacatggaatgtgtctccatcatgagattcagagtctttgttctcagactagagaactttggtttctaggaacaaaggcacccatccctcaagttgatatccaggaatcgaacgttaataacaagcagattcaagacctttggaaatatcttagagaaatatattagagaaatacctttttttggccaatttaaaatgaagatatttttattagtctctctctctcctccctctctctctctctctcttctctcttctctctctctctctctctctctctctctctctctctctctctctctctctctctctctctctctctctttgaaaacacaaggtggagagtaatgggaaaaagatcgggctcagtgggatgcctgaaatgagtgcatttaaaaatcaactcagcatctggctttcagttgaagtttgggtgtttggaacaggatccctggcaataactgagattggcagctaatccattaccagcagaccagcattaccagcctttcagatcattcagatgaatttagagccatggtagtatctgcatatacggacatgaccctaaaagcatcacttttacctccaggccttcaactgctcacctttatggctggagatgaggaagataactgaatctaggctccccacagctgtgtttgatctatgcccaggctgctgtgtaggacttcaactgaccaggatgacttaggggatagacatgaagctccatttccaatactcctaggggtacaggatccactgtgtgggacccacaacagggaagggaatgatgaggaacatattttctcaaagtgtgctttcagcatgagccactcccgtggagacagagctctctcatctcctgacctgccaaagccttcaggagaaccatacctcatgtggcaaagccaatggagccactcactgttcctaaatgggtgctttattttcacatatttttttttttttttgagacagggtttttctgtgtagccctggctgtcctggaactcactcagtagaccaggctggtctcgaactcagaagtctgcctgcctctgcctcccaagtgctgggattaaaggtgtgcgccaccactgcccagcctcacatatattcttgctgtcctcatacttgagactggaaaattctggcttagggcatctaagaggcaaagcaataaataagtgaacttctactggaccaaaggtgtgttaggctatgccttctctacccacgacatcagtgagcagagacagaacactcctctgcctgtgaggaccagaggaagtactacttggcaacagaattttcttaagtccagacctggaaaaactgtattttggaggggcataccttcaggcctccagcctacccattactgagttgtaggtggccatcactgtcctttgtattttatgtggttctggcgatggtagccagcacatgagtatggtagacactagccttccaggatccctatactcctagtaccttgcattatttttgttcattattaaagatagtcaaaaagcaatacctcctcacccccagtaatttgaggagttaaacaaacaaacaaacaaacaaacaaactactcagaaagaagtgcctggagagagagagagccctgaacactatttgcaaaggaagtctagcctcagttttccctggtgtctagcatggctttgatgcaaccccaaatgtatgcattttctggctttggagacccacttatcattatcattactaccatcaccaccaccactaccaccaccgtcaccatcactgtcatcaccagctcagggtgctacgcatcatcatggtgttttattaatgacagtaactggatgaatcccacctgtctctaactgagagcaaaaaggccagacagaagaggagcagaaagaagagaagcgggctgctttccttcagcttcatacccggggaaaccgagtaagcctctggaaaggtctaccctgattccttccccagagcactggataatgtggaatgaaacacaaatacttttgagtacatgttcacagtgcagggcaagctgccgagaaagaactctttacctcctcatcaagttttcctcctctttgagttcctaaccatgagcctcgcgtggactgttatcaccaaccaaactttcaataggtggatgggatcactaggtcattttgttctgcctctcttttctcataaatatttctgcccaaactataggaacagagatgagatttgaccaaaaaaggaaaaaaaaaagattactccattcaaaataacatatttttttaaagcaaatataggaaagccttttcctattattttttttcttcttagcttccccattgtctgaattgggaaaacaggaaagcattgctttctagcacctgcaaaatggtttaatgcccctgcatatttccatgtccttccaacaatagatttagcatgggaatctgaaatagacgccctgaaaacatctgtctcttccccagctcctaaacccaggctttgattatgtatggtttgtgaaatctatcatccaaaacggggacagacacacctcaatcctccatggggtcaacaactatatacccccagtgaccccttaggcaaggacttgttgagaactgcatcacattttgacctgttctcaacagtacccatctatttcaggtgggatctctggacctttcctccttcccatcttgtctgcaatgtggcaaatggcttctttttgcatttttactccgcccccaccccaagctgaagttcatttgcagatcagcgattaagtctgaattgtgtggtggtcagtcttgtttccttttgtcaggggttattgtaaatgttagtaatttcgcctcaagccctcagtaagaacataaatattttaaaatatgtgcgtttgaaatctgtttcatgcatcctggaactgtgggatgctcaggcaagagtgactttagtctttcagtgaatgttgcccagaatgtgggtagggaaggctcacaggttactctcctccttagagctacaacataacattctgaggggagtcacagggttgcctttaaaaagtgggagctatgtcatgctttgagctttctgttaagcacctctcctaataaactctgaaaaaatatttgttttgaacttgttttgtgtcatttgtggcaacttaaagtacatggcagacctttctttgtggttattaaattcatgttcccctttgcaaagagttactttgatggacttatttctgcctctcactggaaggaatgctggtatgggtctctgttggtgctgtctctccggaagtgactttgcagagtgagactgcactatagcggtgcagtgtccaaagcagctgagagcaaactctaggcctccttccagatttagcatcttcagcctggtcgccatggccacctttaattcccagtatcttgttgattgcctgagtgatgcctggtgggggattaaatgcagccaattggtgtgatgagaaagcaccccctgtaattatcacagagcattatcactgctttgtcagtgaagctcggtcagtttacttaactaattgaacgggcagacagaaacattgcttgttgggctgcaaagatctcacggagattttgtgttgttggaagcagatgataactcgtgattttcagatggtgtgcttggtaaagaagggtttaagtgagataaagggctctattctataatgctaatcacataggacaatttcaataaatatccattaaaattaaataaagcagatcttctagtagttaagccgctaacaaaatacattgacacattgggaaatctcaatttattctgagacttccaacacacacacacacacacacacacacacacacacacaccctatagacatagacacaacatacaaacacaaacacacaatcttaacatctatttcataatgaatcaaccagagatcaatgttccctggtttagggaaagctcccattttaatagcagcatcttctccttcctgtaaattacttagatgtcaggtaagtcttgtcaaaagtgtttacccaaatgctcaatatacagagttacttgtatccgtggtacatcttcattgtcatcagacagttgactgagattgaagagtcatagagacagtgcggacattctgtggtattcagttgagttaagtgagcatgctaagttctcggccaatgcttaaatgtatttaataagaagggagagtagtatcagagaaaaacatgcctccaaaccaaaacatcctcagcttagacttcctctaaatggcattttcatgtgacacaggctttcgaagagagtctctggacttgttcttcaagcctcttgatgttcccagggagatccttttcataggaaaaagagaagaaagatctagggctggtggtacacactatctgagaacttgagagggagagtcagaagacaagttcatggtcagcttgagctatgtaatgagagtctttcttgaaaataacgtgaaatttaaaaaaggacggagcaaagacaggaagggggaatgaaggaagggagaaaggaaagaagaaagcaggaaaagacaaactaaaagaactgaataagtttttagaccaaaaattattcaaagaagttcaatttgacagaccttcaccgggctgcttagctcagtgagggcactgtcttgcctccaggaagcacactgctagaggtggtcacagccactgtgtctcaattaatcctatttgttggtttttgtttgtttgtttgtttttaattgagattcatttccgttttcttgggtactgatctgatttcctatgttccaccctggttcatagtgtttaaattgatggaaggaagaagaaggaggaggaaagcaaagaagggagggaagaaggggaggggaggggaggaaggaggaggaagggatgagagaagggatggaggggaggggaagggaaagggagggcaggagaggaaagaggaggaagggaggagagaaggaagggaggggaggagaggagagagaacacaatggagcagggtcagccgctgcggtggtgatggtccctgggatcagctatcacagctctcgcttcagctgctgtaggacttttttcctcaaagtcacacagatcaccttggccatatttgaagaagcaaagtgtctgggtagaccctcatggagacaacacatcctctgtctagtgttcatgtcctcttatgctgaagaatgcagcttctctcttccatattaagctaaacacaatgttcagaagaatatgtatgaagccataagctgagcctatgactacttctgttacattggatccttcgcaattaaaattcaacagtaaagtggtaactaaaaataagaatgttaaattttatctttttttactttccaggatcttgcccctcccctaagatcatgtacagaaatatttttccttcattgtcaaaactaccaactctcctgccacacaagagtgccgtgcgaatttaattcctacatcctcctctaccgcactttgcccactgctgctcagccctccaggacttgctgagcagtcttccttccatgttaaggtctgtcaaaatctcccagggttttatcagttctggttctggaaagagctgtgttgtattagtgactgaaaacatacttggtaggttgctgcttttgtagttataatttcttactataactgcaaattcaaattacatgtctgactttaataaggttttattctattgtaattttccccttttaatatcactgtttcatcacaaggcgctacctttcactttgtgtgggttcttttttgtttctttcttctttttaatctaataatttttttgttttttttttctatgaagccacactatttgcatttccaaggttgtgggtgcctagaggtttagtttatacattcccttctgaatggtagtgtactatgttgatccattacaatggttctcaacctgtgggtcataactcccttggcaaacctcgatctccaaaaatatttacattatgattcataacagtagcaaaattacagttatgaagcagtgacaagaataattttatggttggggtcaccacaagaggaggcagtgtattaaagcattaggaaggttgagagtctctgatctattagaaagtataccctactaggctgcccctacatctggtctctaatacgttacagccatccagatcagggactgacatgtgatgatacttgataaattcataccaaatacttgactgactgggagatcgcagtcagaggcagcatgaatcatttcaaggccttgaggatactgttggaggcctgcactttccatgagcatttcctgactacccatctcctgagacccttcaggtacctctctggctgctcctttgccttgtatttacttgtgggaactgtctacattcaagctcgcacccctgcttgcctggacattggtcatcatgtctatctggtctccagatctttccatccaccctccttattaatcctcccttgcacctccatgaaaatacctcatggaaacaacaagaggggcaataatgtcactggaagcatgggataactacgcaaacacatatgaagtatctcattggatacccagctcctactgagtagtgataaagagctgttcagatgctatagatggtaagtcccaaaagtttcaggtgaccaaatactgaacacagtgactttcctcttggagcagtagggtctcagagtgcagatgagacactatcaggtagaatttgacctaagttcaacaactggctacagtctgctaggggaacacctgtgttccttatacctgctttctaagtcctcaatacttactccttactaactccttccctcaggggacctcagtctctgagaaaggaattggcttttggaatttctctaatttccctcaccacaatagtcaagtagctatatgccatatagctacttgataaaggctgattctttattataccctaactcatattccagtctcagctacagttagacagaaggcgagcaggatacattatttcatattatttcataatattaaggcagtatctgccattgaccttcccagcatctatagggtttcccagggaaggcagtgactgggggagcagtgtaggcaattggagtcatgctgatagcagagagggaaggtgacagcaactggcgatttatggggtcaatactactgatagaacacaacttatttatctgggactggcaagaatgtttggtgagaaactctgagctcttttaactcttaagcatacatacatatggacagacagatagataaacatttggtaattaactgctgctggtttttagtaagtgctaaaaacttaactctatgcttaaataagtgctagggaaatttaactctttattactgttctgtaattacataaatgctaaattctggcaagtgaacacaatctgtccagctgtaggtgaattacgtaaaaggatttattgctagagttcctttctctggcaagtcagccaggagcccctcactggctaactgagagactctcagaactctttaactcttcttgaaccagaaagaaaagacaggaaaggagaggagtccctcacacagaccacacacaccaggtgaaaaggaaaacagctacaccacctccccttagtgcttttagctatttatagctttcagacaaaaagttgtctatgtaagaaagaattacctcacagaaaaaatttttgcataagaggggagtcacagaaggacatcaataacaagttcaaagcagtgtttcctactgtaagctcatagcaagtttttacatgtccttgcctaataatgcacacctatggctttagccttgaacctgatttttttttaccttgaacacaaatttgtctcaagcttatttctcttttgtgtgtaagtatgaacactcattggatttcttattatgcagcctttgcttactgttaggaggagtgggcacagtctattcttgattctaactttattacatctttctagcaaaacaactaaaaccatctcttaaaattttcttcctaagatcaaatcaggaattctataaaaatcattaccatctaagtagtattaattcataaaagtttatctttatgttggtctgcaccaaatcggctcagtagggtagactaatgcccaggagtccctaggctctgtttagtgataggaaaggcatatcagcaacaagatgaaatcctgagatgaagtctcttgggatcttgcctctcagagctcacctatcttaagccatgcataaggtaggccacttccaggaaagtcacctgctagctttagccttttctagatagctcctgacaagtatcaggaaaatcatataaattttacaacttattaaatatgaaagtagcgtgtatttgttgaacaataagtagtgtttctgctcccccaaccgtggtagggacattggagcagagaattctaaaatctgttcacagatgacagatggtgatattgggtatgaatcactaggtttcactaactccggctaaacattaacaggaacaacatctggaagctgtaatatgaaaaaaaaatgcatcaacaagtcatgaataagctggcattttagcctttagtgaggatctcataggagacccttaacaggagacttctcaacaggagacgtggaagactgagcaataattgcatcttgacaatgttttatgttcaaataagcacacttgtgtctgcatacctgcctcatccaaacacaagtgtgctaaacacactcagtgcagtccctgaatcgttgcccacactgcaatgggatctgcctgattgaaggcagaccccgttgatgttccttgcctacccagtgtgatcatcttctctgcctttgtcagatgctatgcttgtgtgtagtagcagaagagggagtaggggtactcacaggttgccctatggtcgtatctggccatcagaagaagctcagttggaactagtgtatatgctgttggaaaggtcagtgatgctgcctcttcaaaattagcccctagatttttttttttaaagaattaaacacaccctcaacattcatttgatttgggtgtggtagatgagagtgtgcagtgctggggatcaaactgaaattcagtctacctcttagaccctcacaatccagcaattctgctcccaggtagttatttaatagaaattaaatcatagcctatgcagccttggatatagatcttcataggttgtttatgtgtagagcctgtccctgaaagccattcagacatccatcagcagcaaactgtagatgctcaaggattatctatagagggaagcactcctcactaggaagtgtcacatagttaatgaacaatcaaggaagattcagaggaacagggaaagctagatgcttaggaattaacttgcattaaattcttgaacaacaaaaattaatctatgataagagaagttggtaagcagttacgtgagaggggagtgaggtttactgcaaagaactaaaggaccttctcagaaccatggagatggcatatcttgatcagatgttggctgcatggacatttgcattttcagcactcattaaaccctaaacagaaaataggtacatcttattgaatacaaattacagcataataacactgattttaaaatgctccctgtcaatgtatgaggaagacaaaggtttacaagttatagcctgattaatttttctagaggaatgagatgtgttttcctcaggctttattatttcagaggtagtaatgagtgaatgaatctcttgtggtgttgagtggcttagtgcttctctactgtcgatccttgtacaagcccactaatcagggttagtgattgtggagacccactcctgtgacaccactgccatgaaagcctttccacacaaaggagcctagcgatcagggagctctttagttatactaacctatacccagccattcacactcatcccggaggatctccaggctgctccagtgccatgttcttccaatgttgtggtaactttgcaaatgtaaagtactggcctctttctttcacgtccttttgcatttacttcttagacagagccaatcaatctggctctgctttttaagggaagtcttttttttttttttcactacggagacaacctttcctattattaaacttcatgaggaaaaaacaaccatagcaaagcttctggcagagtctacaggtgccaagctcatagtggaactgggatctgggataaggtcatggcttttcattaagagggattttgggtttgttttgtttccactgcataaagaccagatgcccagtttgacttgttaaatgcttgctgggactggattggatgctcaaagggtttctggctgaaattaagtgatgtctattacctttaattgcatgttgaatggtctttagcatgagttatttattctttctgagcaaaggaaaagatgactcatttgagcctcattatttcaaaatctggagtcacattgagttggaaccaacccatgcaccagcttcacaaacaagaaaacaacccaaaaatatttctaagagtttgttaaaggaaattagtttcataataggctaagctgctggtctactaaaaattcttctggtgggacatttgcctctatgtttacatttacacatgtatattaaaagatgtattgtaaatgaataatgtacaaatatagagggccaaaatatcttgtagatactttaatctgattctgattatgtataaaaactatatttaacagtgaaattgcttctatatgataaagtctaatggtcaaaacatttgtgtttttcttaaaatgagacattcagagtatccaaatgagggcttctgcagtggctgttcgttgtactttctttgtctctgtggtctttcatcaccagtgtgtgactttcagtctcatgattgccagataacatctatatttctcagtctcatgcaaaaggtccacccattaaggcactcttcttggaattttctttgggaggggtgctggagaaagagcttagcagttaagagcaattattgcttaactgctcttacacaagatttgaatttggttcctcgaacctacatatatctacttatatatctacctataatctatttccagaggataaaacgatctcttctgacctctaggacttttgtatgcacatggtacacatatagatacccaggcatgcgtgtgctcatacacacacacacacacacacacacacacacacacacacacacacacctaaataaatgtttttaaaagttttgtgtttgttttgttgttgttgttgttttttcgagacagggtttctctgtatagccctggctgtcctggaactcactctgtagaccacgctagcctcgaactcagaaattcgccagcctctgcctcctaagagttgggattaaaggtgtgcaccaccacacctggctttttaaaaaaaaattaaaaattatatgcatgtgtacatctatctgtgggtatgtgcttttaaatgcaggtacctgtagaggacaaagtcatcacatatccctggagctggagctggaggccgctgtgtgctgcctgacatgggtactaggaacaaaacaaaggtcctctggaagagcagtatatgttgtgaaatgctgagttatctatctagcttcattgctttgtttctaaaatactgtcttgctgttcagcttgtgctggctccaaactttcaaacctccttcctcagactcttacagatgagtgtgccacaagcccttgttaacacggaacttgtatactctatgggttttgacacatacagagtggttaattatacattctaccacagcagtatcagatatggcaggtttagtggcaggaacgccccttgtgctctgtccattcatcctgtttctcttgagaactatggctttgtttattgattgcataatttttttcctggaatgtgtcttgcctactgtgtagcattttcaaactagcttcttccacttggcagagtgcatttagggcttctcaagccatttccgtgacttgatcatttattgattttaatcaatggctaatattctattgccaattatctactcattcactgaagaacactgtggctacttctgacttttgaccctcaaaaataaagctactaaaatattctcatacagatgtctatgtgaaactaagttttcaattcattggcataaatgcctggaggtgggattaatggatgatagaattagggtgtgtctagttttgtaaggaatggccagccttcgagagaatccaagtcactctgcattcccactaccaagggccatgattctgttccacactgttctcagcatagatgtcatcaagtgttggattttagttattctaataggtgtataaggtacaccactgctttaatttgcagttcccaatgagatatgttgcttacatacttccctgctatcagtgtctcttaagattttctgggccattttttcacttacgttgtttgttttcttacagttgggttttaggaaatctttgtggcctttgaacaacagtccgtgctcagataggtattttgcaaatatatcatccaagttgttggtagtttgtctttgaattcactcagcctatcactcacacagcagctgtattatactgttcacttttgcttctcttgggtgttaggagttcaccgagtggtggagtgatgttgtggtatgcgccaaagtgtatggtgatacagaaactgcaagccaaacaaaagcaagtgctttaattacagtgttgctgtatgcaaaaggctggacccagggacgatgcttactctgtcatttgacactcccccccaccccgtgaacagtaggccatcaattgagagtcatatttgaacttatcttgatattgagggagttgtgaagaaaggatttcagcactctacagacctgaagttggaagggaagctgtggaagaaagggcaagaaaattcaaagttgaaaaaatctgtaccaactggaagaagatatgga

SEQ ID NO: 112 - DNA, 3069 bp, Mus musculus
gaaagcagcagtgcgcctctgctcccttcagagcacagcctggtgtcaaggtccaggttccaccggctgctgctgtcaccgcaggggagtctagcccctcccagaaggagacacagaagaatggccatctcaactggtttgttcctgctgctggggctccttggccagccctgggcaggggctgctgctgattcacaggctgtggtgtgcgaggggactgcctgctatacagcccattggggcaagctgagtgccgctgaagcccagcatcgctgcaatgagaatggaggcaatcttgccaccgtgaagagtgaggaggaggcccggcatgttcagcaagccctgactcagctcctgaagaccaaggcacccttggaagcaaagatgggcaaattctggatcgggctccagcgagagaagggcaactgtacgtaccatgatttgccaatgaggggcttcagctgggtgggtggtggagaggacacagcttattcaaactggtacaaagccagcaagagctcctgtatctttaaacgctgtgtgtccctcatactggacctgtccttgacacctcaccccagccatctgcccaagtggcatgagagtccctgtgggacccccgaagctccaggtaacagcattgaaggtttcctgtgcaagttcaacttcaaaggcatgtgtaggccactggcgctgggtggtccagggcgggtgacctataccacccctttccaggccactacctcctctctggaggctgtgccttttgcctctgtagccaatgtagcttgtggggatgaagctaagagtgaaacccactatttcctatgcaatgaaaagactccaggaatatttcactggggcagctcaggcccactctgtgtcagccccaagtttggttgcagtttccacaacgggggctgccagcaggattgcttcgaaggtggcgatggctccttccgctgcggctgccggcctggatttcgactgctggatgatctagtaacttgtgcctccaggaacccctgcagctcaaacccatgcacaggaggtggcatgtgccattctgtaccactcagtgaaaactacacttgccgttgtcccagcggctaccagctggactctagccaagtgcactgtgtggatatagatgagtgccaggactccccctgtgcccaggattgtgtcaacactctagggagcttccactgtgaatgttgggttggctaccaacccagtggccccaaggaagaggcctgtgaagatgtggatgagtgtgcagctgccaactcgccctgtgcccaaggctgcatcaacactgatggctctttctactgctcctgtaaagagggctatattgtgtctggggaagacagtacccagtgtgaggatatagatgagtgttcggacgcaaggggcaatccatgtgattccctgtgcttcaacacagatggttccttcaggtgtggctgcccgccaggctgggagctggctcccaatggggtcttttgtagcaggggcactgtgttttctgaactaccagccaggcctccccaaaaggaagacaacgatgacagaaaggagagtactatgcctcctactgaaatgcccagttctcctagtggctctaaggatgtctccaacagagcacagacaacaggtctcttcgtccaatcagatattcccactgcctctgttccactagaaatagaaatccctagtgaagtatctgatgtctggttcgagttgggcacatacctccccacgacctccggccacagcaagccgacacatgaagattctgtgtctgcacacagtgacaccgatgggcagaacctgcttctgttttacatcctggggacggtggtggccatctcactcttgctggtgctggccctagggattctcatttatcataaacggagagccaagaaggaggagataaaagagaagaagcctcagaatgcagccgacagctattcctgggttccagagcgagcagagagccaagccccggagaatcagtacagcccaacaccagggacagactgctgaagactatgtggccttagagacagctgccactaccttcagagctaccttcttagatgagggggaagccacatcattctgaatgacttgactggactctcagcaaaaaaattgtgcaccttccacttaagaacctggtggcttgggataggcaggtattttcttggtgcctttgatatgtctgggggtgaaagctgtgtgttggtttgtcattgtggggagttttgtggatattgacagacctcactcaaacacccttttcaaatccaatagcaactggttcctctggttcctaattagggggaaaggagtcagaggggtgggacagggtggggggatggggcttcaaagttttttcttatcacttgatttatcatcgaaggagttactggtgctaattacaatggaaacagttcctttccatcacaggacaacacacctcaatcctccatggggtcaacaactatatacccccagtgaccccttaggcaaggacttgttgagaactgcatcacattttgacctgttctcaacagtacccatctatttcaggtgggatctctggacctttcctccttcccatcttgtctgcaatgtggcaaatggcttctttttgcatttttactccgcccccaccccaagctgaagttcatttgcagatcagcgattaagtctgaattgtgtggtggtcagtcttgtttccttttgtcaggggttattgtaaatgttagtaatttcgcctcaagccctcagtaagaacataaatattttaaaatatgtgcgtttgaaatctgtttcatgcatcctggaactgtgggatgctcaggcaagagtgactttagtctttcagtgaatgttgcccagaatgtgggtagggaaggctcacaggttactctcctccttagagctacaacataacattctgaggggagtcacagggttgcctttaaaaagtgggagctatgtcatgctttgagctttctgttaagcacctctcctaataaactctgaaaaaat

SEQ ID NO: 113 - protein, 682 aa, Mus musculus
ESSSAPLLPSEHSLVSRSRFHRLLLSPQGSLAPPRRRHRRMAISTGLFLLLGLLGQPWAGAAADSQAVVCEGTACYTAHWGKLSAAEAQHRCNENGGNLATVKSEEEARHVQQALTQLLKTKAPLEAKMGKFWIGLQREKGNCTYHDLPMRGFSWVGGGEDTAYSNWYKASKSSCIFKRCVSLILDLSLTPHPSHLPKWHESPCGTPEAPGNSIEGFLCKFNFKGMCRPLALGGPGRVTYTTPFQATTSSLEAVPFASVANVACGDEAKSETHYFLCNEKTPGIFHWGSSGPLCVSPKFGCSFHNGGCQQDCFEGGDGSFRCGCRPGFRLLDDLVTCASRNPCSSNPCTGGGMCHSVPLSENYTCRCPSGYQLDSSQVHCVDIDECQDSPCAQDCVNTLGSFHCECWVGYQPSGPKEEACEDVDECAAANSPCAQGCINTDGSFYCSCKEGYIVSGEDSTQCEDIDECSDRNPCDSLCFNTDGSFRCGCPPGWELAPNGVFCSRGTVFSELPARPPQKEDNDDRKESTMPPTEMPSSPSGSKDVSNRAQTTGLFVQSDIPTASVPLEIEIPSEVSDVWFELGTYLPTTSGHSKPTHEDSVSAHSDTDGQNLLLFYILGTVVAISLLLVLALGILIYHKRRAKKEEIKEKKPQNAADSYSWVPERAESQAPENQYSPTPGTDC

SEQ ID NO: 114 - DNA, 28678 bp, Homo sapiens
tggggcccatgtggttggcctgcagaggtcagaggaggccgacgtgaaagcagccccaggacaccagagaggcagaaaggacagccatgaatgaagaagtgggcagatggaaagcagtgggggtgaatgcacgtgctgagagcctggctgcagcaggaggagagaactgggctgtgctggcctggatctcagctttgccagatccttgcacgggtccaggagcctcctccatgacccgtgcaaggatctggcaaagctgaggctggacctggcctgtggctgagctcccctgccctgggctgaggagagcattagtttgagtgaagtgcctactgtatctgtttctttaggaatcaggttgctgtattacagggagatgtcgacagtaaccctcaaccagagcagggctgctttccagctgcccccatatccttgatgcttttatttggtatacgagttgtgcagtttcctaatactactgtggttctgtagcccctccaacctgcccatcacttgagactgagttgaatggaaatgtgttttataatcttctgtgcaataaattggttttgcagtgtggcaacccaactcgtgaaagtgcttatcattttcaattataattttttagctcagagataaattattaaagcacagcaaaattgttcctgaagataacatgctcacatggtaattactcaggtaaaatgctggtagtccccgggcattctggctttgcctttcttaggaaaccatgcagaactatctctgtatgacgcagcagtgtcacgttttatcctgagtaggcaaaagatgcagcctgctcccgttgtgggtctgaaacagcttctgcaagttggagcctgaagtgacccagtatctcaccctgcatttgccgcccactttgttcccacgggaaacaggaaggtgagggtgccagtgcatgggtgtagatgccaggtttcccgactgctccagcgtgtctgccttgccctggccatgccatctactgctgctcgcttcattggaccccaacgtacggtgctagctgttggagtatgaacaaccagaaaaataaaggccagtcttccccaggtatggttgtcagctgttctgagccaccacctggaatatctgcaggtggaagtagccactgagctgcttccctcagtgtcagtgcccgcgaaggaaggctactctttcaccagaaacagttcagctagaagactcttctgtcttccaatatgagtgggtgggagtgtgggagagcagaatttggccctagaactgttgtgtagatatgaatctgattcagcaaacagaccaaagctctgcaggcctgagaggggcttcagggcctctgggtcagctcttgtgtcaaagaatgaaatttttaggactcagaagtctggagaaaatgcttttggctgcaagtaacaaccaaagtataactgctcaaacaattaagaatgagaataatttcatataagaagtctcaggtgggatcatttcaggtttggtgaatcccacagttccaggaggcttttggggacccgagctcctgccctctttttgccacctttctgagccagcttgtcctgaccacagcagctttgcacaccagccctcagaagatcactcagaggacaggctggccatttctccagtctctgtttaagagcaagggggactttcccagaagcatatggaactttcccttatgccacatgggccagtctgtgtccctcctgagccaggtccctcctgagccaggtgtcagctggggacagaaatgtcatcattgctcagatctgtcagggttgtcccctgaataggggagtctcccagcacgtcccaacgcttactagcatcaggtgcacagtggagctggtcttaagaagaataagggagagtaacagttgtagagtcttcaagaattcataagatgttacaattagaaggaccctccctgctttataaagaggatgtccaatattttggcttccctgggtcacactggaagaagaattatcttgggccacacataaaatacactaacactaacgatagtgatgagctaaaaaaaaaatcaccaaaaaaatctcatagtgttttgagaaagtttatgaatttgtgttggactgcattcaaagccatcctgggcctcatgggcccttgagctgtaggttggacaagcttggtatagggagaatcctggatagttcccagctaactttcatttgaagaactgtcatgactttcgatagaagatgcataggctattgtgttataggtatttagtgatgttgaggctcccagggctgcaggagccagcctggcggcactaaggaggaagctaatgcaggcactgattgccacgttgggctggttgccagcattgcaagacactttgattttttttttttttttagaaaagccagaaatgcaaatctttctgtaaaatctcacatttcttaaatatgcacaattcactgaaatatttaaaacactgtgtgggtctaatagtaaatgatgaagagctggacccaacctgggagccagcagctgacctcgtcccgatgaagagactggtgtctggaagctgtcctgaggctttgcctttactttctccaatgaccaggcacagcatccagcttgggagacacaagatgttccagcggaggccttgaagagcactgccatattgtcccgcactgggctcaggtcactttccaacttttaccttctagaaggaactggaatggagggacgagatgaaccagggctctcaggggcagtagacaggattgtgtcctgcacagaggagtgcttttcttacaatgctagagagaggtagggcgtgcacagtgtgattcatagtttcgaggaaaaccagacaacattcagaacttctatgggaaatgaagctggatgatgaaatgtagccactggtaaaataaaagcaggcaaagaaaccccactatgggcagacagatacatatacgggcaccttcatcagtggaacaggccagaagtgggggcgtgggtggacgcttattgggtgaacagctttccgtgctaggatctggcatggaaacatcaaccacgcctttgtgtattgggggatccagtcgtgatttgaatgcctaactaggaagggctcttctctgtcatttcaccaggggcagactgggcatgtgccctacccatgctccttgctccccactattttagtgcacggggacctgatgtcacagccagcacctacctgggggctttctctggctgctggggccatgagacagccatgttcctcccctcctgctggtccccccacttcctaagaaacagatatatccggactgagaaacgaggcaggtatacacaaaggcaagctatttgtcattttcgacaaaaaggatatcaaaaagcaacttcgcttattttcaaaatgactgaatcaaacccaattctgtcagctcattctttatgagatgtcaaaacccgagcacgcttcatccacgtgtccagtgaggaaacaccataatcggggcggcatcatgggctgcattctcagcttgccctgctcctctccttctctgcccggactggctctcacagatggatgacaaagagccctggagagttgaattactcggctgaagccacagaacatgggccagcagtgagagcagaattcagatggtattgtatctaaaacacaggacttggcttctcacagttcaggacaacagggagaattccaggtttctgtggagcgattgaatcctaccatcagggcacacagggagctccacagacagctccctgcagagaggcagactctgctttgctgatggctctgaatgcttctggctcccctccaaaggggtcccagcttatgcccagctggcatgtctgtgctttggaggtcaaggcatatgagcccacagactggcatatttgagtgagggttacagaggtagtgcacctgccgtgtcctttatctgcaccccagcaaggagggttaggtcatcaaagctgggaagtgttcttgcaggggagctgccttgtgcccactgggagatggcaagccctgaatgcctcagaccaacttgaatggctctgggacccagcagcggggatgatagattggcataaagatgcatggacaattgaccacatggtgctgaaaccttcgggcaacaccttgataccaggatcccatggcaggtagggaaagctctcagtgctcaggtcctggtgctgggcatgaaaacacacacatgccaccctgagccctacacatgttgcctggattcttggattagagccactgtctctctcctctgatgatgtctctccagcagcctttcttctctgtgtgcaggtggggtctatccagcattgcttcatctctgggtctttgcaagggtgcggggacctaggacatgctagacatttcttccttctggagggttcctggtgacttccctgccagagaatcacctagggcaaaaataataaccataatcattagaactgttattcagtaaatgtgagattgtattcataccactaatcgtggaaccacagacttaccacctactatgccaagcgctttactgagtcatctcatttaatcctcatgcctctgtggatgtgacaccatttacatgtaaggaaactgaagcccagagaggaacggtgtttgcccaggggcacgtggctagtaagtggcacattttgactagtggttgaaactacagaagataggggctattattcccatcttgtgctaagtcagtggagcttggggatgcccactgagatgcggcaaggcaaaggcagcagtcctggccttgggagactgggctgagacccagcgcttcctcctgctcctggacagtctccctggttgcaaaccctcatcccaagggttcctgggtgtggacctaaatacacctagcactggagggttctcaaccagtgcttgtgaggtcttcctttccagttgtagtctatactcctcaggaatcttcagaattccccagtcagcttcccaaaggaaattaaattttcccggaaaagcaggcttatctattcaaattaaatgacttcttttcaaacaactgtgatgtcattgttctcatttttctgaagaattagatcttgacaagttaggctaaatagatcatttttatttctatcaaattatattgtctaaatatggctaaattgttacgacaacttactggaatcactgaggatgctgttaatgtcaaatggaacctgaaatcatccacaccagctgtgtgagcataatttagagacttgtatttcatgctcagagctgtccctggagatcaaatgtgtgaacccgatcctgctgaaaactctgtttccctccatgatttatctctttccaaaggctggtgagtagcctttgcttatcacggccagtgtcaagaggtgagcacaagttaacctcaaaaacaacattcagcccagccaagttttctataaatatggtacatgattaattatgtcagaagactatttactaaatgtggaaaaatcaataacactctaagaagaatgtttacccagcctaggatccaaacaaacactctaaagccagggaagtttttgaaaaatacaagctccgtgtctccagcaaacataagggaggttttactccttttcatttttgccttggcagggatgggccctgggggtgtgggctctgtctctgctcattgcaatcagattgacatgactgttgtccactgatgtcggccacgtgtcagcccctgcaggaagcacttaccactaggacctcttttaatttaatcccactgacaggacagcggcatcatgactcttatcctccctgttttgtaaactaagaaaccaaggccccaagaagtgaaagtgttggtcccaatcccaaagccagcaactggctgaggccccagttccagttgcgggagtagagtcagggtggtctcaggccaccgtgtcctggtgtgataggaattcactgttcctgccaggtgcttttctgagcttcttttaggtatgcactctcttagccctcacaaagccctgtgagagtcggagacagctgagggtgtggagtcacagatagctgtaccatataacagtggacagagtggctcagacgtgaccttagtcacacagctgtaagtcacagagtgggattgtaacccagtgcagacaggttccagcctttctctctctctttttttttttttttgagacagggcctggctccatcttccaggctggagtgcagtggcttgatcactacaacctctgccttcctggttcaagcaatcctcctcccacctcagtcctccgagtagctaggactacaggcacacaccaccacactccactcatcttttctctttttttttaagtagagatgaggtctcgaactcctgggctcaagtgatccactcactttggcctcccaaattgttgggattataggcaagagccactgcccccagcctctatccctctcaatgcaggacagatggtcaatcgatgagcctcccccaagggcagacgggtgtcctcgagtggggttgcctgcagcaatcctggcatctttgtgcccagggtgaaccttgtagcacccctcacctctgtacaacacaatgactttcagaaatcatcatgtcataatcaatattagtgattttcctagttttttaagttttaaagcaaacgattaataaaggacaaatttcaattttacaaaaatgttattcaaattctgttaagcgcctcatgtatgaactaaaatctgtactgacaaacaaaaatatcaggtctcacagttttcactctgtttctgttttaaactttgaacacaaaatccctaagtggtcccatagaatgacaggtcacagtgactccagttctgtttcatttcctccaccatttctgtgccactgttgctcattgtgagtctaccatataccatgttatgccaggaaatacgcagtgtgctttgtttccctttttaatttaatttttagttacaaaaaaaaaaaaaaaggaaaaagacaggccggatgcctgaatgatccacaaaccaattagtctgctcccaaataactgagattaaactcgccccatatttgagatcagaacattccattccagcatcgtgcaaagtaaatttttaaggcaatttaaaaagaaagctcagagtactcataaagactgcagaatacacacaaatggtgaggagccttttgctcagggtacatgccatgctgttaggctcgccatggttctagaacacctaacgtggcttccgtccaaagatctgccgagaaaaactttttccatctccttctgctgattcctgctgtttaagtatcggtccttggagaggtctggtataatctgctctctaaataaaatgggatgaaacaccatccatggggaatttagtatgtgaggtgcagaattccctcaaagtttgcattcagactatcttaaattctttgtaaaactccaccaaatccctcccaggaaaagcaagctcttcatcctcccctgaggtcgaagcaccatgccctcagcctctacgaatcccctgaacagcctctaaggagcgtcccctataggtgggagcggacacagaagggcggggctggagctagagaacctagctgtaagtgtcccaggtgaattaacccacctgagcccagcagggatcagccaaagggtgaagggacacagtggaagtcagatgtgggggacaaggaataggaaactaccctgtgtcttggcagtcagcgggtcaatttgggatgaaattgggtgtgtgcagtttagacagaggtttgcttacatgtgcagtatgtcgagggctcagcaatggtctcagtgtccactctcttcccaacttgctttctccctaattccagaggggagagttaagcatgatttcacttttattaatgttagagcaagaaagtttccagaggccctgttcccacctctgcatttatagatgagaagtggggctgagttaaccaagttactgaaaataataaagtaaaatccaaggacccccagggcaaggcagtttctgcattttacatagtctttctcactgttggtgctttacaaatacttccaaggttaatggataaaaaacagagtatatgtcttgctagttcattttcttctttaagatgtcatcacttggctaagtgaacagtaattggtttgaaagttcccacatggaagatgaataacttacagctaaagaagatatcttgacaaagatctgggggtcagagtggctaacatgctgaaagtcactcatttagcccatatccttaagcaccaactaagtagaatgctgagcgaatgctgcagatcacaatctacctctgaggaatctacctccgagctgcacaaacaggggcctagaccacgagaacggctccctgctatgagtggatgctagggctgcagaattgattttacagaatgttaagaagttacctgcttgtaaataaacccttagaaatgaagcttctcccaagcagagaacaagactgacccttgccaaactcaaatgcatggccagctatattgactgggagccagggacaccagccttccctggacccctcacagctggctgcttacccagctctggtggcacacttagcgtcccgaggaggcaggtcacaaggacagggggtctgggagaccctgagccccaagaggcaatcccctgtgttctcagaaccaggtacctccagcggacacagccttccaggaccccagctcccggcaggagccatgcagtccttctgcgtgcccggtgcccttccccccacctccacccagccccgagaacatctgacctggactccacagcctggaaacctgcggccacctgctgagggcccccccacccactgcttgggtccactgaccagtccccttccacatgtaggcctcatgccagccctcagtgtttccccgtggatttcaagacgaagcctcaagccttcattactggggttcacagggctccatcttcccctgcatcctccctcccactgcctgggctttggtctccctgcccttcactcactctctgtccccagggcttctgtacatgctgttcccccatcccgacaccattccacatctgagctgcttctcctttagattccggcttgactgcctgtcttctccagaggagtctctcctaattgcccatcccccagtcaggatgccacccctgtatcaaccacgacctccccgctcccctgtgctgcctgcaataaagccatcagtgccgtgacttgttcaaagttgtccactctaacaggactccaggatcacagaggcagggatcccctcctggaatccagtgcctcactcagtgcatagcagggtcttaatcaacaaatgttagatgggtggatggacaaacagatggatgaatgaaggggcacagggagggtctggtggcttctatggagagttcccaaaatgtctcaaatatctttgctaaaatgcaaggacttaaggcacattcttaggaggtatccagctggagtcagagatgcctccttgtcccttggggagccagcgagctcctagcccccgggacaactcaacatctccatggaggccactgtggtggtcgctggtgccgggtccacaggcgttcactgtgttctccaccgtggcgcttcttcccctggggccctcacggtcagtgcagagcaccaaagagttgccgctgtgtagagaattcttataattgtgcattgcatccattttgaatctaatttggaccctctcctaccagaagcagggtttattgctcttgacacggtgtctagggctccaccccctcccagttcctcaatgcggccaacccagatatctgccttgtacacccacctcctggtgaccatttccctgtgggacaggcagatacagcccatttgatggtctcagtgactccacaccccacagggacttcccagacatgccgccatgcccacctctcagccacagggaccccacggagcccgtgtctgtttgctctaaacccaccagtgagaagtccccttgggaaacctgcttgggaaacgtcctggaccccaataaaggcttaggacccaggtctctctctctcccttcacccccctccaggtgagtgtttgtgacccagacagctccccactttttgctggccccgtggggtgcactgccctctccctgggatctgtaagtgacacggtgcttgtgttgcttcctgtgtcttcttgtgctgcctcctgcatctcccctgacccacaccccaacccaactctcctcccatcagggatctcttaggaagtggctgtcttgataggaataaactggacatgggtcagacgagagccacaagggtgtctgtccatagaaacaagttttatgtgagagagacccctggtcactgggcagggctagaatttatagtcagtctctcaaagtgagagatacagcctgctaccaatgacaggggacttggagagcagtggagcctctccctcagctgagatggtgctgaggtgtggtcccctcaggcccccagagtttcctggcactggctccagcagcccagggtcaccttctcagcaagtcatcatgggttggcttcctccttgtctgtttcacttcccctcccacataaactagtctccccaaatcctgtctcagggtcccctcctgggggatcccaaccaatgagcaaaggtctgtggctgcaggaaaagcacactgtgagtccctggcttttgccgagtcgcggtgtcgcaggagggcctgcccgggcttcgattcccgctccctgcccagatttccggcccttgctaggaatcctgagccgggggaagtgagcctgcaagccctgcgccacgaggccggacacattttcattttctttctgatgctttttgtgaccctgacacctcacaatgcaatatttccactatgaaacccccagaactgccaaatttcacccaatttggattaacattatcgaggagcttggcattatgttgaaaacccagacattcccacgacccgtatcctatttaaaaaatgcctgtctatttaaggttcacgatgggaggataaaagaaaaaaggctcccaaagtcaacagagaacatgagctaggcaaaaggaaagtccagtttgcttctaaaaaaggctgaaaattataaccatccatggccttgtgtcttaagtctcagaattttttttttctcttttggtggtttgcaaaccaaagtggaattttattatgggttactaagggagcttcctcgagttcctagcccccaaagcccctgctcactccatggcatgcctccgaggctcctcatgccatgagaaagagaatggagccaaaatcaagccggcagtatctcggggctgtaacgtcttccccccgtcgctgtttccacagtgctgagccagggacccggcagagctgcctgactccttttatgaacaacagcaccgtgatgaaggcagcaggagtcagagaactattcattgcaggaagccccaacatccggtgagaaataagaagtacaacagtacaggatgcgccttgggtcagggggacgtggaaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacaggtaaagggggccctgagtgaccgggggaggggatgggcaggcatgggggcactgactacagtacaaagaggtggcagcaagagcaggcccaggtttcctgtgggcagacacaccctggtccttgcagctgacccctcaacctccccccacgccaggcactcgggcccccttagagcatactgcccatctgcagcacggccgcacgtggggctctctcccaaggtggggacgtgcaggcacagaggcgccatggcttccaacgctgtctgttttgtttcccatagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaacttgttttaatatatttcacgacaactcgaaatacctggcagaacttgctttcaaggtcattacatttatccatctcccctttcaaagagttgctaaaaagaaggtaccttgtggctgagtttctgcacctgcacctgctggaggcgacagggggcgctgggctctgccttccttcattacctcagcaaatgtgtaccctgcccctcagcgtgctgcccttggggacatggaatacagagggctgggctgcactgcgcccagtgtccatggcagctgagtccactcatccatggccccctcatcactctttaattctctgcatcttgtaaattacatgggtgatgcctggcgcagaattaaacatgtccaatggatgcgatgtgaaaacactgttctataattatcattggagcatttatcactactttgtcagcaaagccctttcagtttatttaactaattggacaggcagatcagatcgctggttgtttggctgcacaaatctcatggtgattccaagtcaggaacagcagatggtggtcaattctgagtcagcctgcttttaagattgtgcaaaaggctgtggcaaaggcacaggacttaagaagaacaaagggttctgctctgttatgctaatggtacaggacacttgcaataaatatccattatttagggttaaatgcagctgatcctgttagaagtctattcattaacaacatacacttggaagttattcctcgatatgaacaaccatggctgttcccccaacacacacacccacacacataaacacacacatgcatgacacagagatatgcatccacaaacacacacaacacacacccacaagacacacacccacaagcacacacagttctaacatccttctgtgtcgtactggaacacctgaggccagtgtttctcaatttaggaaaagcctatgaaagaaaacaccaacttgtgatggttacattttttggtgacttttgctatctcactaaaatttcttaaatgctaggtaaatcattcgcaaacaaataatttgccaagaaaaattaatttgcacacatatctattgcacaatgcagagtacatttgtgttgctatcatcagacaaaatgcagattacaatgagagactcagacatgtactatgtaccttctgtgggattgaacatgcattgagtgagcctatcaagttctcagctgactcttgtgtatattcagcaagaggagatacagagagcagagatgataaacttgaaaaccagagaagtcggagtcagcctttccctgaattatatttgacattacaggtgcttagaaacagaatgactaatgggtttacccttcagatcctctgaatgcctcctaactctcccttttcagaggaaattatgaacagctcaacagtgaaaaagtgaagaaagaggcagagagagtaaaaggtatagatcaagtgcaatcatttttccggaactgtgattgacttaagggtgctcagcatgcagctcaggcacaggccctctcctgagtccccaggagaaccaccaccaaactctccatgagcggttgtccctctctgagttctggtagttgggttctatttgaggtttgtcgtgattaacttggatgatgatgttctcttgtggttaaaattggttcatagaattcaactgagtggaagaaaggatggaagggaggaaaagaggaagggaggaagggagggagagggaggaagggagggagagggaggagggagggagagggagggagggagggaggaaagaagggaatgaatgggaaggaatgaatggtagggagggaatgaataaatgggaaagagaaggaaggagagatgagggagagaagagagagagagaacacaaaagggggtagaggaatgtcccaggtgtggtggtcacaatcaggtctcacaaagctgggcttggagcctgagaaggaagggctgagtttctcagggcgtgccggtgcgaatttcaggccacttcgttctgctggccttggtgaggcccagcaccctcctgtcaccttcctgcaaagcctgcttgcctctgccactggccttacgcctgtccacatagttcatattgtaaggtctgaagccaagcctgtgacctgtctctgtggggctcctactgtgttcaagtatcatgaaataatgaaatttgtgaggtggaagaaaataattgggacgtctaccttctttctccagggtctggctttcccaaaaacgttatatcacaaatgttttacttcattgttgaaatcgctgcctcctgtcccgcgtgtgtttgtcggggtgtcacgcccttgtctgctttccttctcatccgtcctgcaagtcctcatgccctggcctccatccaggccctcatcccccatggctgtggcttcgtcagcttctcctcggatttccaccagttttgtcttctatttacagccgcgtggtgaagggactaatatgtgtttggcagatttcgtccttcaccaataaaaaatatacctttttgaaccttttcacttcaaattatattatatatgactttacaactgatatacccgattcattctgctgcatctgatgaatatctggtattttttccctaaattcagctttctggtgacacttcatgtttgtctcttgtaaacaacaaagctggatttcactttttttttcttttattcaatcaaaagtctttgtcttttaatgggagaattcaatctattcacattcattaaggttactaataaatttgtactgacttattttatatgttccatttataatgattcattgggatttctagcctctctctcgtcaattattagattgattaagttttctttgatctactttttcccttaatattttggaattgatatagactatttgtattcttcaaatagtcttactttttcacctcacatactaaagcctatatcttctattaatgtcttgtgttaattaatagctatctcctccctctattccccaaaatacccagcaatctgttatttctatttcctgtcctctcaggttacccagattcccacaccactgcccacctggattgcatctgaattttatttttttattgttatacatttttacaaccaaaacctacttggatgccatgagtttttgttgattttttctcatcttcacctctgattcccagtactgttggattcagttatcacgggagtgttttgttttgagttgtgtctttttctgagaaggtcatgcttgcatgaccagaaatgcctttcccttccgcaagttgaatgatgcctcacctagacatagatttctaggctctaaactgttgtcctgtagaactctggagatatccagcctttgctttcttgcatacgttgttactgatgagaaggctgatgtcaaataatgtgttttctttcatggaccatttctttcttttttcctttttttttttttttttttttgagatagagtctcgctctgtcacccaggctggagtgcagtggtgtgatctcggctcactgcaacctccgtctcccgggttgaagcgattctcctgcctcagccctcctgagtagctgggattacaggcacacgccaccatgcccgactaatttttttttgtatttttagtagagacggggtttcaccacattggtcaggctggtctcgaactcctgacctcatgatccacccacctcggcctcccaaagtgctgggattcgcccggccttctttttcttttccatttttccccgagtgctttggcaattttcttattctctgttgagttctgaggtttcgcttcaggttgcaggtgtggttcctttctggtcccgcctgcactaggtgagctcttcccagcacaggagggcatttccttctagctgtatttgaacctgagcatgtgtctgaatcctctggaacctcctgcagggctccttaaaacggaacccctccctcagagcttctgacttggccgatctggggtggagcccaagactgcatttctgctgatgctgctggtccaggaaccgcccttggagaaccgctgcttcatttggtcttgagtgatcttctcttattcttgttagtataccttcttgttcattgtcttgactctcttattttggaaacaattttagatggttctttccttcctcactttgtacctatcttctcccagtgggctataaggctgggccttctctccagcactcccagcgatccttgctctgctctactgtttttccaaaacaccaatcaccttccaccctggtttatgatttctgtttgtacactatgattgattatttagtatctgtatttatttactagaatgtaagagccaacaggggcacttttttgtcttttggtttctgatataccctaggcctctagaccagggcctggcatactgtggtgctcagtaaacacatgtggaatgcatgactgagctgggggttggagcagtgtaccaggtagggtgggctagcacaccctcctggtgggcctgtgtgagcctcgatgctgtccagggcctcttcctccaccatctgccacctgtcccctgtctccagctcatggcacggcctgcactcaagtcttcactattgctgctctgaattgtggccgccatatccagctggtctggggctctttgcactccagctcccagaaacagagcctgagagaaggactcaccatcctgtggttcactgggaagcacagggaacagtggtaatggcatcaagtggtgacatcactgtagaaatcctgggaaatggtgcaaaacatgccagggtcatcacatctgaaagccaagggagtggtgtgtagatacccattggtaatgagtagagggctgccctgggtggagttggcgggtaattcccagcacttccagatgaccacacatgtgggcaaagtggccttccacacttaggatggggaaaccttcaggtacagatgcaggccctggcaggtgtacttcacctgagcacagtgaaaagtgcaagcacgatttgttgagcactggcagcctccagcacacagctgtcctctaaactcagtgcagacagtcctccctgcctctagaggtcatgcctccatttccccaggaggagctgtatccatggggatggatttctctctcaggagttttctgctggcttttatcactttattccttgcatgataggtcagtggctacatgacttgtgtcttcctgagagactgtaaggcactcaagagcaacgggtacatctgtattgtgccttgctcacagtcaagcctcaaaagattttttaaatacaagaccccggatatgttattttataccacatatgttattaaagcaatgaagaggaaaaaaatcactgaccttttactatgtaccaaatgggaaaatagtatttgctattgagaaataggtagtattaatatctccattttatagttaaggaaattgaggcagagagaagatgagtggtgaattagatgaatgaaatcttacactctcactcttaatcactaggcttccctgcctcccattagacatgaataggaactgcaattgaaaaagtgtcaaccagcaaagagtggggagatgagtgggcctctcagccagtttcagataggaaaagcagagtgttaagcaatatgggtatttttaataatatgttcaaacaaacttacttgggcttgtgtatgtaccccccaaacacacacacacacacacacacacacacgcacacacacactggggtagaactactcaaaagccctctgatcagaaagattgtgcatcctgagacctgccttgcctgctctgagggcagatcccagggaacgcaccctcacagtccccccacgtggctatccccagtctgccttggtgagagcaatgtgtttgaatgcagtaggagaggaagggaagtgggaatgtgcaaatcgccccatggtcccgacctgctcagaggctacttcccaactggaactcttgcacacggtaatagaaatgtaaacggtataacttctttaaaaacagatggtttctttcttagaaagttaaacatacacttaacgtacaacctgacaattctgctcttagatatttatttaagggaatgaagccatgatctacattgtcttggccatagatattcacaaggtttatttatacagcttcgatctggaaagaacccagacattcatcattaggtagctgggtgaagactgtgggtcatgcacacaatgggatatcccttatcaaggaaaaggagcaggcgtctgaaatacacaatgagcaagaaagccagacacaaaggaacaaaattagctggacactgcatgattccatttctatgacattctagaagaggtaaaactaatccgcagtgatggatggtagttcaatggttatgtgagagtgggggtgagggttgggagcaaaagaccttgagggaccttcgtggaatgaaggaaatacttgtgtcttgattgggtgttggttacatgggcgtttgcatttgtcaaaactccttagaccacacagaaaatgggtacattttattgtatgcaaattaaacctcaataaagttgatttttaaatgctgctaatcattgttataaattaaacaaaagatttacaaattgtgacctgaatatttttctagaagtgggaaacatgattgcttttgacttcgtcatttcagtggtatcaaaaagtgaatgactattgtgggctggagttagttttgtactttctacactttatccactgccggttgctttaccaaatcctctgctcagcactggagactgggaagacatctgtctctgactgtcctcctccacctcccaccaaagcaccacagggatcatgaatatccctaattatactggcctccatcaaaacacacacacatcatgaaggagcggtcacctctgtgtgttccaaggccactttcctttcatcaatcctgagtattgactttttaaacttgcagctttgtttttttttgtttacccattttcctttgaatcatctgactacatttctttcttagagatggccacagccaaaccctgctttttggctgtaggtcttttggctagaggcccttcagttttaggaaagcatcttttactatggagacaacatttcatgttatttaactttatgacttaaaaacaacctcggaaaatcttctggcagagattgcagacgccaagtttgaagtggaatcggtgtcaacaataaagtcatggcccttcattaggaggttttcccattgcacaggagagaccagttgcccagtttgacttctttgatgttcacagcgcctggatttgatgcttaatgggtttgtgactgcagtgaaatgccgttcattaacttttgttatatgttgaattgtcttcagatgaggtatgtatcctatttgagcaaagaaaaaataattcatttgggccttataatttcaaaatttggagtcacattgggatggaattaatacacccattagcttaacaaacaagaaacaaaccaaaaagagagagagatgaaagatatgttggggaaatgaggttcataagagactttagctgtgctgtttagcctactaaaaattcatcttgtaggagcacttagctctatgtttatatctattcgcgtaaagcagatatgaattttaaatgattattacatgaatgcaagaaaatcagtatctgttctaggtatgttattctggtcctgcttatatctaaatatgttaataaacttataatatttagcagtaaatttgcctgtgcatattaaagcctggttaacataatgcttatttttctctcatgacaagaaattcagaggtgggaaagccagggctgctgcagctgctttcggctgcatttcttcttttggtcctccgcaccagcgagcatgtggcttgcatcctcgtgcctacagcatggctgctgtgcctacaggcctcacacagaagtcccgctcaccaaggaagcatttttaatcctttttaaaaagttgaagtaagatttatatgcagagaaaggtacgaatcccaactgtacaatttaatgcattttgataaatgtatataccattgtaaccatcactttggtcaagatgtgtaactatccatcacccctagtaagtttcctatgctccttgcaatcaagttccaccccatagacaaacactgttctgctgtctatcaccacagatttgtttggcctgttttagaagtattcgtagatagaatcagcatttattggggttaggcctgttattcggttctttttctacctttcctaccttcctcttccacctcctcctccttcccttcctttcagttctcttttcctgttttctttggggttattcaagtatcctttttaaattattataatttcatttttgagaaacgttaggtctacagatgaattaggtagaaagtacagaaaattcccatatatgcctcctccaatcccatcccgcaagatgtttcaacaacttgcagttgtgggagagaaaacataatttcctttcttttcctttttacgttattaggtgagaaactctcctgaaaacagatgtcaaattaacataagaaaaacaagcagaagtttattaatttatgtagtacccatcacacaggggaagccttagtccaaaagtatttctttctttctttttttttttttgagacggagtcttgctctgtcgcccaggctggagtgcagtggcacagtcttggctcactgcaacctctgcctcctgggttcacgccattctcctgcgtcagcctcccgagtagctgggactacaggcacccgccaccacgcccggctaattttctgtgtttttaatagagacggggtttcattgtgttagccaggatggtctcgatctcctgacctcgtgatcagcccgcctctgcctcccaaagtactgggattacaggcgcgagccaccgtgcccggccagtccaaaagtatttctgaaggcaatggcttaggggtccttggttaaatagtatttcagcaaagagccataaatcctatgtagtgacaaaacaaagaggagagcagttcttgtcttttaaaaggcaggaagatctgggaagatagtaaagcccccttccagacgtctcttgtgcctgctgatgccctctctgggctgggaagcgagtgctgtcttcagtaaggaagggcttgtgtgctgccgtcagccaaacagcggccgaggccaagtgcttccctgtgcttgtggcatttttagctgaacaaccctcaatattttgggagaaataatttggtttccctcatgttggtgcggtacatttgttaaacttgatgagctaatattgacatattattattaactaaagcccaaagtttacattagggtttattcttactgttgtacatttcatggattttgacaaacatgtaatgactaatgatgtgttccactgtcacagtgtcatgcagaatcgtttctctgccctaaaaatcctctgtgctctgcctcttcttccctcccaactcctggaaaccatgatcttttcactgtctccatagttttaccttttctagagtgtcatatagttggaatcatagaatatgtagccttttcagattggcttctttcacttaataatatgcatttaggtttcttctaaacattttcatggtttgatagctcatttcttttttgtgctgaataatattgcattgtctgaatagagcactgtttatttatccattcacctagcaaaggacatcttggttgcttccaaaattcggcaattatgagtaaagctgctataaatattcatgtgcagatgtttttatggatataatttttctactcatttgagtaaatacctaagagtgcaatttctggatggtaagagtatgtttagatttgtaggaaactgccag

SEQ ID NO: 115 - DNA, 7092 bp, Homo sapiens
gggacaggcagatacagcccatttgatggtctcagtgactccacaccccacagggacttcccagacatgccgccatgcccacctctcagccacagggaccccacggagcccgtgtctgtttgctctaaacccaccagtgagaagtccccttgggaaacctgcttgggaaacgtcctggaccccaataaaggcttaggacccaggtctctctctctcccttcacccccctccagtgctgagccagggacccggcagagctgcctgactccttttatgaacaacagcaccgtgatgaaggcagcaggagtcagagaactattcattgcaggaagccccaacatccggtgagaaataagaagtacaacagtacaggatgcgccttgggtcagggggacgtggaaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacatt

SEQ ID NO: 116 - protein, 648 aa, Homo sapiens
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATDTRGPEGTPKATPTTSRPSLSSDAPITSAPLKMLAPSGSSGVWREPSIHHATAASGPQEPAGGDSSVATQNNDGTDGQKLLLFYILGTVVAILLLLALGLLVYRKRRAKREEKKEKKPQNAADSYSWVPERAESRAMENQYSPTPGTDC

SEQ ID NO: 117 - DNA, 6859 bp, Homo sapiens
tgctgagccagggacccggcagagctgcctgactccttttatgaacaacagcaccgtgatgaaggcagcaggagtcagagaactattcattgcaggaagccccaacatccggtgagaaataagaagtacaacagtacaggatgcgccttgggtcagggggacgtggaaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacatt

SEQ ID NO: 118 - protein, 648 aa, Homo sapiens; identical to SEQ ID NO: 116

SEQ ID NO: 119 - DNA, 83943 bp, Mus musculus
  misc_feature (1)...(83943): n = A,T,C or G
caacaacaaaaaaccccagcactcaccgaacaaagacaagacctgatatctacaccaagaaacacctcaaatataattccagatgcctagatcccactgcaaaaacacaaacatgaacaaccaagacaatacactttctccagaagccagcagcccaattccaacaggctctgagtaaagcaattcagctggagcatcagccaaggacttcaaaatagcaattgtgaatatatgtagcaagtccttaatgaggatctgaataaatgccttaatgaagaccatgaaaacacagttgagtgaaataatgaaaataatttacagaaatagaatttaacaaagaaatgaaatcgctaaagaaaacacaggttggaataaagatggaagaaaaaaagtcaacacaatccctagaggcaagcctcgtgaacagaccagaggaaacagaagagagactttcaagtcttgaagataaggtagacgtagtggatagctcagtcaaagaaaatgttaattctaaaagtattcagacacaaaagatccaggaaatagaggaaactttgaaaagaccaaatctacaaaaatttatagagaggaagacaacaaaatccaggtcaaaggcacagaaaatatttaaaacaaaattgtagaaggaaattactccaatctaaagaaggaggttcctatcagggtacaggaagcgtgcagagcccctaaacaggaccagaaaagaaattccctgtgatgcataataatcaagatgctaaatatacagaataaagaaagtatactaaaagctgccagtgaaaaagaccaagtcatctttaactgcaggcccatggtgctttcagtggagattctgaaagccaggagagtctggatggatgctctacaagctctaagggacaacagatgccagctcagactcccacacccagcaaaactgttaaccacaattggcagagaaagaaaaacacttaatgaaaacaaattaatgtctaccaatccagctctacagaagaagtcaaaaggaaaacttcagtatgaagaggttttcatccaataggacacaagaaataatcccagagcagttcatcaaaggggagaaggatacatgcaacaaaataatagaaatcaacaaatattgctcattaataactcttagtatgaatggtctcagtcccacaatagaaagacatagagaacagattggattagaaaacaggatccatctctctcttgcaacaaagaagcacacctcaccatcaaaagcagacagcaacttagggtaaaaggatagaaatatattacaattaaatgaacccacgaagcaagccaggtatatagctgttttaatatttgaaaaaataggcttcaagccaaaattaaccagaatatataagaggacaccaaatattcattaagggaaaaattcatgaagatgatgttactattcaaaacatttatacaccaaacacaaaggcacacaagttcataaaagaaatgctactacagatgacatcacaaatcaactctacggcagtgatagtgggtgacttcaatgccctgctctagccaacagccaggtcatcctgagaaaatgctggagttacataacactataaaccaaatggacgtgacaggcatctacagaacatttcacccaaacaataaagaataccctttctcctcagtagctcatggcattttctccaaaattgggcacatattaggacacaaggcaaatcttaacagattcaggaaaattgaaataactcctgcagcctacatgacccccacggaggaaggttgagtattacagtagggacagcagaaagcgtccaaacccatgcaagctgagtaactgactgctgaatgaaaactgggtcaagacagaaaccaagaagtaaattaggaacttttagaattgaatgaaaataatagcacaaatgaaaacattattttttaaataataagaaaaaagagtttctcagtttggcatttgttaccattcaaattgagtttgggttgaaatttgtcttttgctttgttgctgtttccaaggttatgcaaagtaatataatgtaccctttgccataggaaatttaaaactgtctcagagggaaatcaattttcaaacatcttttagttgctttgcatacatgttataattgaatgtatgttttctgcattcttttacatatttggttaagtatgatctactataatttactatatgttagtgcttggcattagtgaacagcagtcctttaaaaaaaaaaagaataactttacctcatttgggggctggagcgatggttcagcaggtaagagcactggctgctctcccagaagacctaggctagactctcagaacacacatggctgctcacaaacttctataactccagttctcgaagattcaacacccccggcctccacaggcactgggcaagtatgtggtgcacagacatatgcaggcaagacaaccacatatgcataataataacttaaaatatttattttacttttaagtatgtacattcatgtacatacttaattgtgcttaacatgctttaattatgtgtgtgtgtgtgtgtgtgtgtgtgtgtgtgtgtgtgtaccgaggcccgaaggtgctggatcccgaggctggagttacagctgactgtgagcttcttgctgtggatgctgagaactgagctccagccctgtgcatgaatagagtaatatgtgctcttaactcctgagtcatctctccatacccatttcttttaaaatactctataattctgtatgtcaacaaactcactcaggctgggaaatgaagagcggccatgtgcagccgcactttctaccgcctcagtcaggctggccttgctctggttcacataaaatgattttttttttccaagtgaaccatattttggcattagatggagaagattctttagatttttaaaatcatgttcttttcattgtgtgacctattttggttttgcatgcttatatgtattattttactgttgtgtttctcgatgaatatattttcttatttggaaggaactataaaaataaaagcacgtttattttaggaaaaatgaccaggggatattaggcatttctttaaaattccaactttttttttgttttttaaaggaatttgactttcagtatcataggattgagctaagcactcactcaacatctgacgacagctccaagactcagtaatggcttcaaatcaaaggattatacaattcagtctctaatattaaagccatataacatcatgtggactgttcatatgttccatttgctttaatacagggatcctatcacgctcttctcatcagaggcattctcaattattaaaacgagggcaagactggttttaatgtagtgtgtgtgtgagtgtctgtgtgagtgtgtgtgtgctgtgtgtgtgtgtgactgcgtgtgtgagtgtgtgtgtgctgtgtgtgtgtgagtgtgtgtgtgctgtgtgtgtgtgagtgtgtgtgtgctgtgtgtgtgtgagtgggtatgtgctgtgtgtgtgtgagtgtctgtgtgagtgtgtgtgtgctgtgtgtgtgtgagtgtctgtgtgagtgggtgtgtgctgtgtgtgtgaatgtgtgtgtgctgtgtgtgtgtgagtgtgtgtgtgctgtgtgagtgtgtgtgtgctgtgtgtgtgtgagtgggtgtgtgctgtgtgtgtgtgagtgtgtgtgagtgggtgtgtgctgtgtgtgtgtgagtggtgtgcatgcctgttgaccctgtgtgtgtggaggttgatgtaaagtattgtcctctatcacagtctacctcatttttgagacagggtcttcttttcttgatcctcaggttggagaagcctttttgttagattagctggtggtgagctccagggaccctttggtattcacaccagcgtgtgagtaatgtctctttttgccttatttagcttttacatgtgtgatgaggatctgagaccatgactccacacatgtataggtagacttttgcccacagagccatcaccaaggccccactcttttttttttaaattagatgttttctttatttacatttcaaatgctatcccctttcctagtttccaaaaaaatcttctatcccctccaccctccctccgatccccaacccacccactctcacttcctggccctggcattcccctgtactggggtatagaatcttcacaatacctaaggcctgtcctcccattgatggcagactaggccatcttctgctacatatgcagctagagacacaagctctggggggtactggttagttcttattgttgttcctcctatagggctgcagactccttcagctccttgggtactttctctagctccttcattaggtaccctgtgttccatccaatagatgactgtgagcatccagtcctgtatttgccaggcactggcatagcctcacaggagacagctatatcagggtccaaggtattatattttaaacaaaatgcataacacaacatgggaacagttttccttttgtactaaatactgccggatattgttaaaatgtatttctgttttcactttccatactcttgtataaccagttcattttaaggaagtcaaaagtttacagtcagtgtagagaggggcatctacactcccttggatttgggctatggccttcctcacaccatcttccttagggcaacaaaagacagcactgtgcatccattgtcacagtcaagcctcctgacccactcttactcttgtgttacctaccacccagctttgccctcagtgtgtctgcacctttgtttccatccctgctgctaccatcctagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctaacacacacacacacacacacacacacacacacacagaagctttaacagctagggacaaatctcaaaaacatgttgctttcaccacggaacttccttcttacgctctgtgatccattgtatttccatccccagacacaataaactcacgttcacctcagaatgtggtttcctttgaaacctttatctagaaccctctgccttctgatttcttcttactgctcagcttctggcgtacataatggctctttccaaagccttcctgtgaccccattccaatcacttttatcctttctgctgtttgctatgatcgtcagactacaattcggtaaattcataacatagtttgaagattttaaatttagattagtatttcagagagtttttttgtttgtttgtttggttggttggtttttgtttgtttgttttttctgagtttttacaaaattaaacgaagccattttgttacagactcagggatagaaaggctcaaatggcatttgtatactgagatatttacaagttgagtcacaggcacaccgcaatgctgaacatatgactcacactttacatcttctgtgcagttagtgtttagatgttacagcattgtgccaaaggcaaacgagctgtttataggattaaggacctcagggattgctccatcctggttttcctcccgagtttactatctttaaccaggtccgtcttgtttggaaagacaggtctgtcttcctgtgtcctattctttttaaatgaacctaagtttcttctgtagtatacacagttcctaatgtcaagttgtatctgccaagcttcaggcctctctctttgcttagcctcttgcttgtgatcattagcctgggccttctttccgttcttggaatttaagctcttggcttccccgccccttaccatccccagatccctgtttatactgtgctctcactggaatgcacgctttgcaaaggcagggatcacttccaagatactcaccattgtgtcttcagagggctaacctagcatctggcagcacagagttattgaataaatatttgttcaatggatgaatcaagatgataagtaagactggttgcacagtatgatccagagtcaagactgaatttatatattgaaaccacacaggaaatgatgaagacaaatctagtgtggggttagttgtagaaatgtggatggaatagtttggaacaatgtcagatgtaaggcacaacatatacatagtcatttttataagtagaattcaaccttgtcccaatttcaagagtgtctatcctacctggaaccagaagacagatgtctagacagcttttggaaaatagccctacagctatatttgtataccataaaatgacatatttataactgcattcattataatagttccacagtaaaatatatgggtaaaaatgaaatgttcatagaggttggctatgcacattgagatatacccattcaatggaatagcatgcagtgtagagagtgagtgagctttctaaatgctgagataggagattttgtatttttactaaataaaaagcaacatgtataactctctctctctctctctctctctctctctctctctctcgtgtgtgtgataatacttctttgtatgtaaaagaacagggtataaaattctcctgtatatatgtgtatagcttttgtgtttaagcatggtaaaaatgtaaactgaaatataaaattccataagtcaaagtttctatcatttgtctctccacagaatgaaggctgtgatgaagactggttaggaaaagctaggaagttcatatagcaactgactgcatcaaagaagttctatgagtttttcaatgattttcaatgcaaatttattttaaatatctttatttttgtatttgaaatacaaattcccaaacacgaggggcaagggcgacacacttcttctttttgagatacagcttctatttgaagcttttcaggtgacaacattaatctttaaaagtcaatagatgtagatccttttcttatggatttacaatgcacaaggtggagatattttcaactaaggatgaagctaccgttatctggaaagagcacagagcagggaactctgctgctctcttctgtatgtgctttacagtaaggacagaggatgtctgccactgggtaactcacaaggacaaagagagcagctgtcctacagatagctgaaccgctagcctaatgagaaccattgctaacaagtaagggtctcaaggacaggaatgaaattccccaccccgtcttggtcccatcactggaaagtaatcaataacttcgaaaggaatttaaactgatacaatttcctgcctgactgtaacctgctcagtgacattcctcagagagtcattttataccttggctccaacattgcgaacactccctcccctgcacattgtaaagagactgggcattctgtagtgtgcactgagaactgactgcataacctccatttctctatggaacgtcaactcgtaagaattctgaatctgctcattactaatgtccccgcccccggatggtgggatatcactaagaacatcatcataccttctgtcctttcctattcctccctgggagaaaaatcatgggatgttctgaactctctggctttaaatagatacagttatagaacagcacaccctcctctgctttgaaagcctagtgctttaatatttcatgaatcgaagacaactgtgtatgtttgaaatatggggtgctgttgactctgccctctgtaagcacaatgggaaagggaagaacaatcacatccaaatgattcaattttgggtctctgtctctatttggtctacctgcaccacctggtggtagtgtatgttaagtgcgaagttgtgtgtgtgtctctctctctgtgtgtgtgtgtgtgtgtgtgtgtgtgtgtgtgtgttttgcaggtacaaggaaaagagaattttaatgtatgtattcttaaatattcatttagggtggtgatacgatggctccatactaagtgtaagatacagacagtcacagtcttgctcagtacaggataggcacaagctcaggctggaaagcaaaaggactctcttgtatccattagctattggccttattattcctggaattatcagttattttttatgctattgctctcaggaaggcacaagtcaaatactaaggtgaaaccatttttctaaaagaatgatagttttgcaaattatgtgtcctttgcttctgtgtgtcatcctttgaaataaatcacaagacaggatgttaaaacggcagcacaccctagcctgattagacgtggccattgatttgatacctgaagcagcagctgagccatggggaagtaagggatggagccaaggccacactgtttgttagaatcccagtccggtaagaaactaggtcttctcagcctaaagactcacacccaattgtgcaagatctgtgaaaagatgtgtccttgcctagggatacctgctttcaggccctgagccttgggttgctctagtgctctgaatttgaaggactaaaaacataccctcacttaccaacctcctccgtgccaatgtattgtaaagatcatctaacatttaagaagcccttatatatgttgtagggacatatgtttttcacagactgtacagcttctgtgtttaaaaggtctaacattttcctttctctttgtaacggcttgggaatcagaggtctgtttccacagcgtgaatgcccacttgtggatttaagccgaagccgtgtccacagctcccccttacgaccactcaacagtgtacaagcctccttctaattctgctgttttagacaacgaacagctcactggttaagttttaattgcttccaatgaggtcagcaaaggtatttattgaaaatctctgaataaaaggctccacgcactcacacaagcgcacgcgctcacacacggagaaaatccttttgcctgttgatttatggaaacaattatgattctgctgggggatttctcagctgagaaatagtttgtagctacagtagagaggctcaagttgcacgaggcagacagcagacacggaactcttgtgtacccagctgttccaaacagaacaagtaagttactgttatttgtctttaaaacaatgctcttttctgaaagattttctctttctgtggttattgtcctggggtggggtcaggggggaaagacttttgagctgtgaaaatatctacagaaattgtgctgtagtacggacggatggaaggagactcttgaggttctccagggcaatcctgacacttaacttgaaaaatctgggtagtttaagggaaaataattataaagcacaaatgtaaaagcatagactaatgaattccagggaattcaacttcaactttgtcgatagaggctgtaaaacttgatttaactcaatagctgtgagtacacagtgtttcctgacaagatagcaactggaatgaatggtgtggttttcttgtggtgtctcctcactaacgcatagcgcttctgaatctatgtgcagagtggcagagatgctcacgtcctctgtgggagctgttttaaacgtgctttcaacatttaactacactgacatgttagactatctaactactgaaatttatacatacaattttttttatctccctctcctctccccctccccattcctaatctctctcttcgagcagaagtcaaggagcaaccgcactgcagcaactggccttgtcacgacctgtttctataaggatatacctatcagctgtgttcctgaaggaggaatcgtgttattggtatcagaagctaaaagataaggttaacagtttggaaagagcgacgactttttctctcatcaatctccagttcacaaataggaggaggcccatgacctaggagtagcaatcaacgcaagattcaattctcattatgttattcatgaacacccggggcactacactataatgcgcaaatggatactgacacggatcctgccaactctgctctacaggtcatgcttccacctcgtctgtctagtgggcactatatctctagcttgcaatgacatgagtccggagcaaacggctacgagtgtgaactgttccagccccgagcgacacaccagaagttatgactacatggaaggaggggatataagggtgagaagactgttctgtcgcacccagtggtacctgaggattgacaaacgaggcaaagtgaaagggacccaggagatgaagaacagctacagtaagtgatgcctttatcacagccctgcttagctctttaaggtttgtctaaggttcactttccagtgctgtattctcctttcctatgggggcaaaaaaaaaaatcagtgtcatatatcaagtcctaatttttctaccttgggatttctgcactaactccctaaaatatctctggtaatagggcaagtgtcctcaccttatggttggaactgatatagttggaaaatactctgtggcttaaatccaaactactggttagtaagaaaccatgtcagtgagcacgcatgctcatgtgtgattgtttccctagcaaagctcagcagcggtgtgcatagagctctcagtaggtgttcaccaaactaccagccaggagtttaaggagcagaggatgtatctgtctttattagtggtgttgcttttgaaaggactctgccatggtactaaccggttaagaatctacttcctgagcaccaaaaactgtgtgcttctaaaacagaagggagtcggtgatgccctggaacatctttaaaagtctaatgagtttgttttagattccttaactccccacccacaggtaacagaccttttttagcagtttctttatcaagagtctgtcatgttaagtctcttgctaatttaagaggaacataaccttgaggaagcagagctgagttggaaggcaggttgggtcggggaccttcacctggagcaccccactttccttagacccagttgtttttttaccttaaaatgccagggcttgggttttcatttgatggttacagttagtaactaatctcagtagtattaaatgcaatggcataaaacacacactcaacatttaccttaggtatttaaaacccacacgtggaaataggtttcttagcactaataacacatgggtggcgttgacactgtatgtttgatagtacgtgtggcagtatagtttgagaaggatacatggagacaatagtgtagctgggtgtctgtgacagggccaccccaagtagttcctatctattcctgaaatatctttttggctctaaactcactgaccaaaaaataagagtttggtgactctttccaaaatgaaaatgagggaccttcatttcagccataactcatacaaactgagcaaggaaacatgccttctggaggactgattccatgggacccagctcagcagtggccactggaggaggatttgctgaccgtcccttctatgtggccttttcatttgatttgaaaatcatcgagccttattgtagataacagaatcatgggggcagtgacagcatgtgtcccgtccctgtctgttaatgactttggggcactttagtgttcccaatcttcaactggtaaacatggatgcatttttcaaaatctttctccttctcacagtctaattggttctgaggcagggaacgtaccacacaatgtaaagcctcaatactcattacctagttgtcaccccaacagtgaggcaaaagtgcctgctctctctccagactaaccatgcagtcagggctagttgcaaattttataacaaggttattatcatagctcaattgcagacttctttttatttaacgactaatccctttggatgctttccactaactcataaaaaaaggtaaaaaaaaaatgggtgggaacagtcagtgaaaatgagtactatgattatttgagattaaagtagttacaattggaacatgtaaatatatgtgaattttattttgtgttaaattcctggagctcatgaatttcaggtatttgtacacatttacaaactggtaaaatcactttacaatttgaaacatggtgtagtgctaaacctgagaagtcttaaagcctgtttagcaaaccccctttctcatgaagcaaactctatagtaataagaaagacaaaagtctttcccaaaatcatggtgttgaactatcagagtgccttgtacttagaaagacttgacattgtttatgcaaataccaaatacgtttcttacaagtcttttaatagtctaaatttatatactttcttggcataattcaatctcgaggagagagtaagacctcatgagaatctctcagataaactataaaatagttaccattgtcctgccatcctactgaaaagacaagataaggtttctcccaagttagacagatgtgatgggacttttgtgtgtagaaaatccaagagtcagaagaataaaggagaataatgtattaggagaaaaatctgataattgttgcctgttagttgagacagacttgctcagtttaagaatgaacataagcagatagacgtatgtgaggctggagctactgagtcagggaatccaggtccaaatagtgtgctcagaagaacttgttcactgtaaccaagcagcatgagaaatgcaatcacaaaagctcagggtggtttcctgagctttcagagtcttcagagttagctcagtgatccgaaggaggaggtccccctcttgctgtcactagaatgacagctaatagtgactggactcaaatgaatagaaatcattcagaaagaaataaaactcaacatcaacccccagacttccttctcatggctctgatgccttccacttttaagcaggtccttaaacttctttggaagccctttaactttaactttggaagtccttaaactttccttttggaagcattggttttcattttcttctcgttagccactcccatggcttttgtttgagtgaaaggcaatttgacctgaaggtatggatgagtcttggcaggctgcttgcttccccagggaagcatggaaccctggggtcatacacatgctaggcacgcctgctacccaccgaagcacatacggacctcctgggaatatgctttataaaacactggtagatatgggaagccttgtagaaacaggtgaaagatttgggtgtgtaatgtgctcccgaggtattgggctgggctgggtggatttagagcagagaggaagagaggggagtggtgggctggtgttagtgttagtgcctcaaatcttcaggggaattgaaatttcacttcaggtaccgtggtgtttggagccctcgctttagtctcctccatcaagtttagatcagaataagtaaattgtatagcaaaaagaaagcaaacaaaccaagtcctccaaacagttcaccaaggatttggaaattcaggagccaaaagtagaccacagtttccactctttaggacagtcagaggggaaccattctcctctctcccctctctggtgcccttcattttcattcagctctacagatgaaactggactgtaacaacaagaagagaagcaggagaagttcatatacaaagagagcattggtaggctgcatcgtggaggccagggaatgaatggtcaatgcttcaagcacttctgttgtaaggactgtcccttggagacaaggctagagctagaggctggatttagataattattggagcagccagctcatcagcagaccgaggcaatcagtccacacctgacaagaatagcgctgctgtttagctgggagctgaggtgccgagtgagagatggcagcagtaagagacagatgtgggatggaaggcccagtgccttaggatcactctcctgctttgtttgtattcagtgactacaatattgtgttcccaacaatagttaacaccatccattcttctggagaagtcctggatgaccagagcctctaattctggaggaagctcatctgcccttttgagcaatattagtcacgtagtaagaaagggttatttgttctgagagtgggccaatggcttggcaacatcctcttttggattggtaggctgtgatgggatgtggcctcccagttggcagaacacaaataaacacagcattgttggatttgactttggccacagaatctccagcaactcaactgtcaacaattctttggatgggtttctgtctgcactagtctctatagtaccccccaagtacacacaacatcttagaatgccgggagtgcaagcatgcttgtgtcccaaagagttcttagtaatttttgtgaaagaacaacacacagtgtcaaaataaacaaaattataaatgtataacctgcttaaaaaaaaaagacaaggatcacgtcacacttgtgcaccctggggcacatgtgcaaaacaaaatcctagacatgattgacaagctggaatcttctagaactggtcagagggattccttactaaagggattccaagtctttaaaatatgaaggatgaatacattactgggggcagatttagaaatgttgactactctatggaaactctgatattaatttttccatattatcatctttatttagttatggcaagtatatgaaactcactgactgctactcacctcactagttcaagtatgttctcttaacatttcttcacttaaaataaccagttgttcatatttatttttcatagttttaattctttgtgtctgtgctgatgtctagtggagggcacgggtgttacaaacccctccaggcagagttgcaggaaggttgtgaattgcccgataccggttttaaaaatcgaactcaggtctctgcaagagcagtccatgctcttatccaaagaaccatctctccagctccacagtgaccatctctacgttactgtcatttctgcactggtccagatcagatggtctttttcctatagctaagccatgtaagatctctgcagcctgtgggttaggaaaaccaaaggccagagtgacctgagggagcagagggaggaggatgttagacatgtgaaggagctgctcgctctagatttgtttcttcttctatttctcaatcttggctggatattgtattcagctgggacctgtaaaaattactgatgccagatcccatccacaaagactcattaagttgatctaggatgcagtctgggcatcaggaattttaaaagctctctagatgattctgagatgcttccaaggctgagaactactatactgtgggaatcacattagagtactggatggattgtagctcaattgaatcagaatctcagcaggagggaggagactggaagtcagtattccttatggttttccagctagagatgaatgtatggctagggttgcaaactgttacttaggggcagggtagaggtggtgggtggggtatgggatgcagactgagacatctcagggatgcttgtacacattttagagcccttgcattttagagggcttcaaagttactccacccccaacccacaccaatggactggagtaactacgcctctctgatttatgaatctaggacttcttttaggccacttggactaatctcaatggcatcaacatgtgctgaacaggcctagacacgcatgtaaggacagtcccatggcatgatataagaaggttgcttaattggataacgcagctgcatcgtgacaggtgctggagcagggggccaaggaaggaggtacagacatcagtgtctgtctgcttctgtgaactcacagacacttctaaattaggctttcatttctcatagccatgctactaaattcaaaggaaagagaccgaaaagacagtggctaatctaaaaaacccagcgtggacagaactgcaggtccccaaaggatgtttccagtctagtggaaaggagtggaagctagatgcttgtcctctttgcaaggctgggattatacataacacgaaggctgcactttggttactttttgttttgttttgtttttagactaaatagttttggtagcatggaaacatctgtagcatcagtatggaacaacacagtatctctacatttaaatttcacatatggcacagaacacatatcgaaaaaaagtctgggcaatagctaatcttcctatactccaagcaggttgaaaataaaaacccttttctatgcgcatgctctgaaaagctgtgttagaggtcattggacagctgatgaagagatggctcagtagttctgagcaggcactgctttctgcaggggacctgacctgaattcagttctcagcacccacgtcaggtacctccagctccaggcactccaacagcctcttggattgttaggcacctgcactgatgagcacttatctcctttaccacattcacataattaaaaacaaaaggtcactgaatatgtaattcttgacaaagcttcatctctgcatttgtagacctaccctaggtagtgaaataattcaatacttttaaataccacgcttcaactttcttaagtggaatattttttcattttccattatatttctcattttatgtttgtttttgaattttggatgcaattatggatatgttgacagaaatatttgagacgaaactcagaatcaactcagtctgcatattttccttaaggcagtgtttccaaattgtatttcttagaacactggtgtcccttgagatattaatggtgtttcctcaagctgtttctctggcttgctaagtgggaactactcagttaataacgctgaattagtctcttgcagcagaactctctgagcctatgttatactatggtcagccccaacttcaaggcaatgttctatggaggttcccacgctgacatgatgacaggacactcctctgtcccccacccatctccctgctcctactctttcttggtagaacatttaaatttcattaattttcaacttgagagcaagctgggatccatctttggagtagtcaagaactaaaccaacctattactcagctgtttgtctgaaacaaagaagtcacacactgccctgaactgccccgtgatttcagaagcccggggcccagcagttctgcggatactgaagcttgcttgtcagtctgcaccaagacagtgttctgcatactgatgaaggtctaaatccagaggtttccagtggggtttaagcctggttggaagttctgtctgagtgctaggcagcactagggggactgttttcctgataggaaatgatgtctgcagctatgcctggacaaccaccaaactacagaagtgtttctcatgcagtcactgaaaatgcttcaggactgcaaggtgattgaaaaactcccaccacacggacacatgtactcatgtgaaagcaacagacttttattttacttatcaaaaaagtggttcaagcaaaagctgtttatttctattttatcaagtaacaagtttcattaactgaccaaaaggtatttagaaacctgaattataggctcttgtaggaaaactagcagaggaccactcatctgaggcttctaaagggtaaagggctagaggctcacctatcctctccacaccttaggtgttttgctggctctttctctgtgtgtagctggcactcatactggagtgctctcagcctcctttttatctccctctggtccagggtgctgcatttagtcagtggaagaaggcagaaagatttgcagtcgttaaatatatttttcatttaactgattacatatttaaaatcaggtaaaaatacgttgttaaatcatcaagaaaattgatgtgaacagtaactaaaagcctttctaaaataaaagaaaaacacatctcatttttttcttattttctatccttcagaagtaaaattattccccacaaacaatttggctaagttttttttttctatgaagtttgaaggggtcagtcagtggaagtctgttttttatcaaggcccactgtataagcaggcacagatagtgacactgggggattaggtgtcagggcaatgtgaagaccaagccttgaagagctgtggtctgtcccaatatttgttcttgtttttatcaacaagcatacccagaagaaatagttcatagttggtattggcttaaggaacatctgtattgagagaaaacaaagaaaacctttaagcatgaaaaagaagttgtgctagcagaaaacaagtctcagagtggttgttttagggtgggagtctgactattagtgagaacggtccttgtactgattggttttgtgtcaatttgacaaacactagattcatcagcgaagaggaaatatcaactgacaaactggctatgggcttgtccctggggtagtcccttgattaatgattgatgtaggagggcccagttcattatgggtggtaccccgatggcaggtggtccttggccatataggaaagcaaaaactgagaaagccaggaggcagcatccctgattgatcttctcttcagttcttgcctccaagttccttcgatgacttcccttagtgacacatggtgacctgggagtttctcaagttacttttggtcaggagtgtttaatcacagcaataaaggcaaagtggaggactcctgaacgcagcgatctgaggaaggaaatgctcactgagaaagagaactgaggacagggagaaagtctggaactgttctcactagttttgagtggcagcagtcggataagcaagggtcttttgtgtcttatagaacttgtagaagtgtttctgatcacatccttggtgcctctggttccaggcggggaggcacagagtcatgggaggtcgtttgtggaatgcgcaccctttcttccttactttacaccaaatgaaaggtatttgaaagactgagcctacttttctgttttcattcttttgttaaattcaatagtcccaatgcctccctttgagagactaaagaatagtaagcaattccacagcctggatttttggagaattaactgtttagttgggagtgagaggtaggctacaggccagaggggacaaatatagagaacacaggggatttcctagcccaacaagagagaagctcaagtgtgccatcctttgagcaaatgctttcaaggtgcttgttagttaccacagtgtgatttctgatagcaaatgagagcaagttagatctcttgaggtatcagtgttgagttcaccaaaggcaaccctgacttttctttatttcaaaaaacacgaacacacatacacacacaccccacaagaagataataaatctttgggattgagagatagctcagcagttaagagtacacactgctctcgtataggaccagagtttagttcccagaacccatattaggcagctcacaagcacatataactagctccggggtggaacccaacacttcttttggcctccgtgagccataattaaaaataaaaccttaaaaaagtctccatgagaacatttgcttgtaatagaccatcagatttttatctgattgaagtatttactaaaaatatgactaccttcaactaaaatgtaaatccccttaggaacacattctgaaagggtcttcactactgtactctcagcgtgtcgcaaggtgctatcaaagtctgctttttgaattaataaatgaattgaatagggagtccactccacttcatatgatgactttctatgaagggaaacttttttggaagtcataattcaatttatgctagcttgaaaacaacatatttttcatacatatagcagcatatatttctctttttggttttccaatcttcgtggtgcttgggtcagagcatgaaatgacggctataaaggctacactgtccttatgaagttcttttcccatagtacttcctgagaagccggagatgtgatggattttagacacatggttaacattttagggtagaattatagagatgaacggctgccttctttagctaagactactgaggtgtctgtgtgtgagaagtgaggtttaactccctcccatgaatagttcaccagatcatagtgtggctacctcacggcctcatgatggactctggacctggaagaactccagccaactttcctccgcatgtctcccttgcttgcttcaattttgtcagacactgaacaatggttgatctcaaagaagtctggcaggaatctgtatctcggcttttaagatttaccttgaaatttatgatcttttaatgtattttaatagttcattaggcattcacattaaaatcattacattgcagagacatatatttgtttttattttaagtctttgaatttagtctctgaaaaaattgtgtgacatataacaggaaacatctctctctctctctctctttggtttttcaagacaggttttctctgtgtagccctggctgtcctggaactcactctgcagaccaggctggcctcgaactcagaaatctgcctgcctctgcctcccaagtgctgggattaaaggcatgcaccaccactgcccagctattttttttaatagaatataaaaaatatagctaaaacaggttaattcttttacaaaataaatgccaatactggaaatggtgaaatattttcctggggtgtgaggacttcttgagctctctcctactgtaagcttgagctagcacttttaattccgtggaatagatagaggcctgagggaactggcaaggccagttgtctcattgctgctccaattttagttttaaaattatacacgatcctgtttgcatcacatccgggtagcattcactttaattatgacattttggtgtgttcaaaactagtggatgactcaactgatcaaatggcactgatggatggtttcctggaaatcgggcctcagtgtgagcatgttcacagagggcaggaccgagaagtggtgtttagtgccattgcatgtgagagtgtagggaagtctcacacatgagcataatgatagcatgtatagtgtggcctgctgtatactttcctgtcacatgtattctattgccaacccctttcatcagtacctcttcatggaaaaagggggaaaaggaggcagcccacgtaatatctttcccccagtgaaagcacgggtcatcaannnnnnnnnnnnnnnnnnnnctttaattatgagatttttgtgtgttcaaaactagtggatgactcaactgatcaaatggcactgatggatggtttcctggaaatcgggcctcagtgtgagcatgttcacagagggcaggaccgagaagtggcgtttagtgccattgcatgtgagagtgtagggaagtctcacacatgagcataatgatagcatgtatagtgtggcctgctgtatactttcctgtcacatgtattctattgccaacccctttcatcagtacctcttcatggaaaaagggggaaaaggaggcagcccacgtaatatctttcccccagtgaaagcacgggtcatcaatattgttttaagataatagtgaaactttttactacaacaagatgtatgtacacacatacacgcacacacacacacacacacacacacacaccacatacacatatgtatatatatacacacacacctatttaaatggagatactttataacaaagagacaatacttctcccaaacagtgtaagtgtgcaatattttgctcacaggacctggctcatttcacaagtgtggatgggctggcagacataaacatgctttgtaggtagggactggctctgaactcctaagggaagcaatgtgtagagtgtagatgtgacctcaaataggcttaactcagaaatagacttctagtttccactacttgtatcactatactctgactggtatcactaaaattccacatattaatatgtaccatgctgtgggataatttgcatgtgaaatatataaacataaaattgtctttcctgtagcatggtctaatgagtacttagcattatcttctgttgagcgaatgctttactccagcttcctcccctttacaacatccccatctgctgctctgccccgtgagttggtgcagtaatttcagattcttttgcttaaagattgctaaggatgcagacaaagaacaggctttgaatgcatttccaaaatgtactgatatgtctgtactctgctcatttaaggtctgcataatttatacaacaggacatacatatacacattaatttcagaaaattaaannnnnnnnnnnnnnnnnnnnctggcagacataaacatgctttgtaggtagggactggctctgaactcttaagggaagcaatgtgtagagtgtagatgtgacctcaaataggcttaactcagaaatagacttctagtttccactacttgtatcactatactctgactggtatcactaaaattccacatattaatatgtaccatgctgtgggataatttgcatgtgaaatatataaacataaaattgtctttcctgtagcatggtctaatgagtacttagcattattttctgttgagcgaatgctttactccagcttcctcccctttacaacatccccatctgctgctctgccccgtgagttggtgcagtaatttcagattcttttgcttaaagattgctaaggatgcagacaaagaacaggctttgaatgcatttccaaaatgtactgatatgtctgtactctgctcattagggtctgcataatttatacaacagacatacatatacacattaatttcagaaattaaaccaggcaattttaggggtagatctagatctgggacatctagtcccaggaggactaagcacatcctctcttgaggtcctattcttaaggtgttaatgcagctctgacacattacataggtgctgtgatatgattgattaagttattttagtgtcttataaaaccagtttagaagttctgtgttctcaaagttacaatggttctttctagtaattaaaagtagtatttgttgaaatagatttagagtatatgttgtacagtatactttggctgcattgatacataaaaaattttactatgggggaaaatttcagctcatttgggatttcaactccacaaagagtagtactatattaaggaatgcttgtgttcacagtgggacacatcttgtgacctacctaccaggtgcatggcccttttaacagtaacagatatgaatccttattgtgaagtgggtcttcaatcagaaagtgttaccactataactatcactctgtactgcatcagtgggcacactttgccaggctggttgttattgtagctcattcccagcaaggttgttttgttcattatctttctcctcgcctattattatctccctatgagagctagccaacagggatggatgaaacttgctttcctcatgctctacaactcaaatacgtggtatctccagaactagaatattctggaaggcaaccaagggctatggcaatagcttataaagtttggtagtctctcccactgacttgataagtggtagcttgcacctggcttcttgttagttaacttatggtgtttgtgagagatattgtctctttgctataaggaaactcctttaaaaatcacatacacacacacacacacacacacacacacacacacacacacacacacacacacacacacacagagtttcggaagcttctgcatcagaaggtttccatttggcttactcaactatctttagtgtgttatccctgtccatgctgtagcctttaccttgccctcccatctcccactccacttcattcttcctgttccattattcccgtttgtaccacctgtgttctctctgtctttttttacattccttccaccataccctctttctggccttttgacttatagcacacacaagtaaagattcaaagctagcatgcatatgtgcgggagatcaggtggcctttgtctttctgggtctaggttacctcactcacaatgtttatttccagcatcatccatttacccaccaatttcatttttctttattgatgaacaaaattctgttgtgcataggaacataggtacataggtcatggctattgcgaccatctagtgattggatggaccatctagtgattggatggaccatctagtgattgccatatgcagggatccatcccataatcagcttccaaatgctgacaccattgcatacactagcaagattttgctgaaaggacccagatatagctctctcttgtgagactatgccggggcctagcaaacacagaagtggatgatcacagtcagctattggatgggtcacacggccctcaatggaggagctagagaaattacccaaggagctaaagggaactgcaaccctataggtggaacaacaatatgaactaaccagtaccccggagctcttgtctctagctgcatatgtatcaaaagatggcctagtgggccatcactgcaaagagaggcccattggacttgcaaactttatatgccccagtacaggggaatgccagggccaaaaagtgggagtgggtgggtaggggattggggggggtgggtatgggggacctttgggatagcattgaaaatgtaaatgaggaaaatacctaataaaaaaaatggacaagcaataaatatggatgagcaagtagccttgcattagaatgcagaattctttgtgaatatactcaggagtggtatagctgggccacatggcatctatttctaggtttttgaggaacttctagaatgactccccacttgagagtgccagcattcactccagtaatgagtaagtgctcccctttctctatatccacaccagcagtggctggaatttggtttttgtgttttagccattctgactaggataagatgaaatttcaaagttgttctaatcttcatctacctcatggataaacagggcaagctgaatatacataccaaagaacaaaactagagttatatgtctcactctgcaccaaactgaactctaagtggatcaaagcctcaacacaaagccctgatgtactaccctgattcagttagaggagaaacagagtaggcatcaactcataggcactgcttggacttcataaacaggacatgaatagcatgggcaatcagaccaacaattaataagtggagcctaaaaacactacaaagtttctgcatagcaaaggacaccattaagccgaccaagaggcagcttacaggatggaagaaattgttaccagctatacatctgacagaagagtattgtctagaatatgcaaaacataggaagctaaaacataaagttaaaattcaatttaagcagggcatgaagtgatttatgattttaattctcaatgagctgtattggttaggaatctatgtgaagctttgaaggaaatatgtctcaccaaaacccctatcagttaaattcctgtccaattatatacagtgattctatcagtaggtgaagcagctaatgctttcattggacctacatgtttttattttttaagtggttcttggttaggcataattaatataatgtgtttgaattgctaggcagctctccttgatgctggggatgttttctcattcatctttttattcttaaagccagcacagtatcaagatagtaggggtgcttgaattaagcaagaaagagtcaaacacaggagtcannnnnnnnnnnnnnnnnnnnttagcatggatatttaatgaatctagagaacagactcagttttaacttgttgctattatgtcagacacttaaccagttccactgtcttcctctctgtgtcttagcgtgacgtttggacttctacatgctatatgctatcctttctcatctctttaccttgattaggaatgtgctgctcattctactcaacaggttggcttggaagaaagaggttggaaatggcagagacaaactggagggataagaactttaagatcatcaaaagttgttctgtgggtctgagtccctcaggttagcatcttctcttgtgtgggtctgtgtccctcaggttagcatcttctcttgtgtgggtctgtgttcctcaggtcagcatcttgtcttgtgtgggtctgtgtccctcaggttagcatcttctcttgtgtgggtctgtgttcctcaggtcagcatcttgtcttgtgtgggtctgtgttcctcaggtcagcatcttgtcttgcagagagcttacgctcaggccgagctccagtttagacccatgcaggtctgagcaggcctgggaaccctgcagggctcacacatcaccaaggacatctgtgcttatctgcggtgtctgctctcaagggctagcaaaactgccagctcttcccagctccttaacactgttttctgtgttacacctgcaattcaaggattaattaaatgaacatagtggctcatatttgtaattccagcagtggaggcttggctgaggcagggagattgccatgagtttaagatcaacctgggctatagggccagactgctttgaaaattaagagagaaaatgaaaagaaaaacaataaaatctgagccaccctttaattaaaggaggggaaaagttgacagcttaattcagaaagccggcctgtgtctctcgctgttagtggttctaaagtgattcaggtgtataaagaacactcccagattccatcattctgaccaacagattcacgctcccccacccctgtcaaagtccttgtnnnnnnnnnnnnnnnnnnnngataaacagggcaagctggatatatacataccaaagaacaaaactagagttatatgtctcactctggcaccaaaactgaactctaaagtggatcaaaagcctcaacacaaagccctgatgtaccacccctgattcagttagaggagaaacagagtaggcatcaactcataggtcttaatcgcgttctcacgcccggccaggaaagacgcaacaaaccaaaatcttctgcggcaaaactttattgcttacatctttgggagccaggagggcaagcgcccagcgcccagccccaaaaacgaaaagccccttctattacatctttaagagccagagctccggcgcgcgcgctctattgtttacatctttaggcagcgagcgagcgcagggcgcgcagagccagagagatgccagcgagagagaatggcggaaaccccgtccccttttttaggagagttatatttcgcctaggacgcatcactccctgattggctgcagcccatggccgagctgacgttacggggaagtcagagcacatggagtggagaaccaccctcggcatatgcgcagattatttgtttaccacttagaacacagctgtcagcgccatcttgtaacggcgaatgtgggcgcggctcccaacacataggcactgcttggacttcataagcaggacatgaatagcatgggcaatcagaccaacaattaataagtggagcctaaaaacactacaaagtttctgcatagcaaaggacaccattaagccgaccaagaggcagcttacaggatggaagaaattgttaccagctatacatctgacagaagagtattgtctagaatatgcaaaacataggaagctaaaacataaagttaaaattcaatttaaacagggcatgaagtgatttatgattttaattctcaatgagctgtattggttatgaatctatgtgaagctttgaaggaaatatgtctcaccaaaacccctatcagttaaattcctgtccaattatatacagtgattctatcagtaggtgaagcagctaatgctttcattggacctacatgtttttattttttaagtggttcttggttaggcataattaatataatgtgtttgaattgctaggcagctctccttgatgctgnnnnnnnnnnnnnnnnnnnnggattggtttaggtgcattttctgcaatcttttttcttttcagattaaacatattttgaaaaccaaagaagtattattccaaatttagacacttttctcacttgaaattagtttttttttcccttcatgatattttaatctaaaacaaatggggatttttacctcatctctgtttatagtttgttaacttttctaatattttagtttatatgaaatgtctaagaccaattaagttcagatgataatagctgtctaggatttaaaaattatatatagctatcttcatgtcttcagagaaaataaaataatatataatgtatttgaaactttttatcatgaaataaattctaattgcttttatagtcaagtttagttatatcatttgaactcagacagtagcatctgtaggcaactgtatcagacttcctcaagcatcctgaaactttatatgacttacatgggtttcctaataaggatattagcttttcttttaaattttctttttcataaaaactgtggtaggtttctaaataccaatgtcttatgaaatgctcttatttattacctgtagaggtgacattggttcataaagtatatgtaaagtatacagagataaaaatgtgagtgtttatgggcttcaacaggaagtaattagtgaccactctccactgctttcctagaaaaagcagagctcagtgggttaatgttgagtgtctcagagtgtactcaaaggggtgaaaggggacagatggaaagagttaggacgttccgggaaagtaggaccaccatagaaaggtgggggtggggtgaaggggggggttggtgttagaccttgatatcagacttttctctgagggcagaaaagtggggaaaagatgtggacgccgttgcaaaaagcccaagtggaggctagctgagctgtgtctatctgcagaatcaatatggcatagggaaagtagtaatacagaggtaggacatagacaaagcacttcagcgttttttgcctttaacttcccattgtgaagagggaggaaaagaacagagagtaaggcagtggccagttgagggaatggtgtcaggaagcaactagaaagaaatgcaggcagtgagcattgacagagtgatctcaagagaaagaaagagactcagactcatcaagcgagcaggagaggcccaggtcacaggagggcacaggcccccacccagcagacagccttgctctgatgaatgcctcattaagcactgggagaaactgcctcagagtcagatgtgctcagcactcttacactggtacaaagctctcagaaagtaagtggacaaagtgccaaggcagaatccaaaagactattgggagttgttatacactttgttgtttttcctaatttaaaactgacaatataatacttgtatatttagagcaatcatagttttatccaagcacataggaaactgatggaaaaaaattactttacaactttgacatgttttgatttttctcttcactttttgaagtgatttccacatagtagcggatatacatgtatgaaacttttgatggacatgcacatatatctatctgtacttatgtatgtttatttatatattcatataaactccgtctgacacatgcagctgtcagctcctattttaggcacagtgtcataggaccagcaaggccccacccaaatgcccagtgtctgagcattccaagacataactgatgaaacgtccctcggagctttccaagaatggaacctttagagcctgctactagtcagcttaaagtcttcctcgtggtcctcagaagctcaggagacctgcacctgtgccctcactcagcatacccacctctgccctcctccctagctcacactgcttcctcccgatcttcctcattcctagagcatggtgctcccaccgtggcctttccccagcctctctcctccccccaccccttctccctctctttatctctctgaattgtttcttttgttagatatataggtagctcacgctcccacttcttcccagtctttacaggattgttaactttctttcccccacactgagaacatccatatcttttctacccaatccacatacttccattcttgctggttgttactctccagcacacactatacctttatcttgtatatagactctttccccagctaggagaagaaagcaggagactcttgtctggtttattcactgtcacatacacaatactgaatttggagaatggaattattagctaaggcgatgaattccataaaaagtcactgactattgtattcagcacaggaccaggaatgaaggttagaaaacaaggcaagacaattgatcaagactctagagttcatcagtggcagagcccagcccaactccatccttggctccttaacgtaagatggttaaaatcaacctcgaaatcggcgtgagggcttttcttccctttcatttgagtagatctttgatgtggcatgctaggatgagtgctctggattatgggagcaaggaccactcctcattgtctgtgaagtaaggggagtgatatctgcctctggactggtttggtacctgactctttctgagcccctgaagaaaggtcctttcctgttttctaacagaagctacaagcagtgatgctgtattttcccatgtgtatgactgcgctgcctgacaactgtggagcttttctcataccaggcacaaacacagcagcgcacacacagtatctaattagaatcttagaagaatccagtgatgttggcattgctatttttgatttacaaatgagaaaaacatctcagaaagaatgtgttactttgaataaacacaatgtcaggaaaaatgacttgcgtggacttctaggaggtgacaggtttactctaatttttcttgtttttttttttttttcctttttttgttttgttttgttttggtttttttcgagacagggtttctctgtgtagccctggctgccctggaactcactctgtagaccaggctggcctcgaactcagaaatccacctgcctctgcctcccaagtgttgggattaaagacgtgcgccaccactgcctggcgacaggtttactctataagtgttcaggactcgtgttttcattggtgcttcctggtgagagtacataagttgagatgatgagggattcacatgatcaatgtttcatataatgaagaaaaaactgtgtggtctagtaccgtgtagacgaggccttagccagcatcactaataaaccttacttgcactgctgaacaccaaccagtgttatgctcttcaccataattattcctattatgaagtttacaaaaattatttcatttcctcaggcttgcttctttggtgagatgtttaaaccaactgacaactaggatcatttgttttagagtgtccataatgattttaagctacttaaaatgcttggccagctaatagagacctgaagaaagtcttaaataatcccactcaatgcatatgtattcctctacgtctcaggctgcaagaactccaagtttttcttgctactttcagtttacacgggatcatacaggcccctacttgttctggttgtttatttctgcatggaacaaactacattgagataaacatatatataatttaaagtgagattgcattaataaactttttactttatagaatcatccttatatgacagtggtagtaacataccaaggcagctacatatgtatttaagataatcctttctaagctaaacacaaatgaatcgatgccagtctgatctctccttcttttagacacacaccattgaaaccctgaacctgaatcctgacactttacctttcttttatctgaattctactttgttggcacctgctcaatattccaatccattctacaaagctgtaatgtatgaaagggcagctattcagagagttgaatttacagtagatgtagtctaatcctgtggctctcggttaggaaagtcacaggctttggaaatgcagtagcttagtacagagccgctctagggaatgttaaggcttacttgtagcgtgtggagatatgtttaacatgggacacttggttccagtgacttaatttcagaactggagtaagagattctttggagaagaaaaactttttgtgatgtttgcttctcatactacagatgttcagttactctcttcatcaaacctaactcagcaagaaatcaatacaacttgaacttgctctggaaactcatgtacaggtcaagcctctgtttcctgtacactccgctccagttagacaaccaggctgctttgtgaccgccttgtcattctgtttccctatgtggacttgtatgggaaatacatgtgaattacagatctggttagcttctccagagctatgttttgccctggccaatagcatctgcaatgtgtagaggtgtacatggctaatgtctttaaaattattcttaagaaacagtttaattcaaataaaagtttacatcagatgtgagtttgtgacatagcggaaatgtatgtcagaaacaacattctgcaagtttacatgcatttgcctccaaaatattaagacagtattgtttatgtacgaaatggtagtgttgctgaattctagccagttcacatcacttccatttctccccccattccaaacctttatatgtcatgagattccctctcaaattcatgacctctcctactgagtgggtcttaagtcctagcagatagctgttggctactcccaagatataagagccacttttgaactactggggatattttggcaggatggccattgttatggtccatgggctctacagctgggtgtgcctgttgattactttgcttccttggcatcttgggtaacacttttggatactatgagaactagtcctcaagtgcaggactccggttccatctctattcctctaagtcctgtgtttgaagtgtgtgatgtcttcagcaataaagtcttaactctcaacttggagaaagaatctaaaggcaatggcaatagcctctattgcttttggggtttcttggactactgtgaccaacaattggaagggaagcttcctacgcctggtactgggggtttggttagtcaatagnnnnnnnnnnnnnnnnnnnngtgtacatggctaatgtctttaaaattattcttaagaaacagtttaattcaaataaaagtttacatcagatgtgagtttgtgacatagcggaaatgtatgtcagaaacaacattctgcaagtttacatgcatttgcctccaaaatattaagacagtattgtttatgtacgaaatggtagtgttgctgaattctagccagttcacatcacttccatttctccccccattccaaacctttatatgtcatgagattccctctcaaattcatgacctctcctattgagtgggtcttaagtcctagcagatagctgttggctactcccaagatataagagccacttttgaactactggggatattttggcaggatggccattgttatggtccatgggctctacagctgggtgtgcctgttgattactttgcttccttggcatcttgggtaacacttttggatactatgagaactagtcctcaagtgcaggactccggttccatctctattcctctaagtcctgtgtttgaagtgtgtgatgtcttcagcaataaagtcttaactctcaacttggagaaagaatctaaaggcaatggcaatagcctctattgcttttggggtttcttggactactgtgaccaacaattggaagggaagcttcctacgcctggtactgggggtttggttagtcaatagctcttggagggagcattatgactatagtggtataactgaatttaaattatatatatatgtatatatatatatacatatatatatacatatatatatacatatataatatacatatattatatataatacatgtataatatattcacacatatatgcatgtatggtcatttatgttatgtttgtatttttaagaaagtatatgaaataatcttttgctacggctttttaaacatccttagtattatttgtccattcttccctcccctaactcttcatttctctccttcccccccgccttttaacctcccccactcactttttccaccctccccccttagtagcacccgtggcctactgtactcctctctggcgatccttttccttcatatcagggttccttcttccttccctggttcctgcagttactcaaggctctgtatgcacatctgaagacttgaagttaggaaccacagatgagaaagaacatgtggtgtttgnnnnnnnnnnnnnnnnnnnnacaattaataagtggagcctaaaaacactacaaagtttctgcatagcaaaggacaccattaagccgaccaagtaggcagcttacaggatggaagaaattgttaccagctatacatctgacagaagagtattgtctagaatatgcaaaacataggaagctaaaacataaagttaaaattcaatttaaacagggcatgaagtgatttatgattttaattctcaatgagctgtattggttatgaatctatgtgaagctttgaaggaaatatgtctcaccaaaacccctatcagttaaattcctgtccaattatatacagtgattctatcagtaggtgaagcagctaatgctttcattggacctacatgtttttattttttaagtggttcttggttaggcataattaatataatgtgtttgaattgctaggcagctctccttgatgctggggatgttttctcattcatctttttattcttaaagccagcacagtatcaagatagtaggggtgcttgaattaagcaagaaagagtcaaacacaggagtcagtcaaagcactgaacagctttcttcaacccagtgctcaacaaacttacacttgtctgcatttttctttcaacttagtttctacttggcaatgtaaagatgctactgtgtcccgctaatttattctgtctcttccttaaagctttggaaattcacacttactttcatggtcacattaacgatagggtttccattttaatgcaaatctacccattcccagactgtcgactgctctaaggagcctccctggtccttcttctctacccttccacattgcttggaaccttgtgatggtaaaatgtgcaaactataagatgccatgcagataggaggcattactgcggctcatcctttaaaaatcattgcatttctcttggattaggtcagagttccaaaagccatatgtatattaagtcttcttcggatccctctcacctttccttccctaccctcacctcctacctcagctaaggccagtgaggtgtatgtagtgatagtagttactaattatttcattcaacattctctatacttactacctttatcaagaacagtggtagaggatacgcctagtcctgatgacttgatgtgtgtggggttgtaagaggggtgtgatatgtgtgggggtggggtggggagaggggtctccctcctcagaggagaaggggaggggagagtggggggagaggatctgggtgagggaaggctgatattcagatgtaaagtgcataaataaataaaatttaaaaaagataatctattagcatggatatttaacaaatctagagaacagactcagttttaacttgttgctattatgtcagacacttaaccagttccactgtcttcctctctgtgtcttagcgtgacgtttggacttctacatgctatatgctatcctttctcatctctttaccttgattaggaatgtgctgctcattctactcaacaggttggcttggaagaaagaggttggaaatggcagagacaaactggagggataagaactttaagatcatcaaaagttgtttctgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaagaaacagtttaattcaaataaaagtttacatcagatgtgagtttgtgacatagcggaaatgtatgtcagaaacaacattctgcaagtttacatgcatttgcctccaaaatattaagacagtattgtttatgtacgaaatggtagtgttgctgaattctagccagttcacatcacttccatttctccccccattccaaacctttatatgtcatgagattccctctcacattcatgacctctcctactgagtgggtcttaagtcctagcagatagctgttggctactcccaagatataagagccacttttgaactactggggatattttggcaggatggccattgttatggtccatgggctctacagctgggtgtgcctgttgattactttgcttccttggcatcttgggtaacacttttggatactatgagaactagtcctcaagtgcaggactccggttccatctctattcctctaggtcctgtgtttgaagtgtgtgatgtcttcagcaataaagtcttaactctcaacttggagaaagaatctaaaggcaatggcaatagcctctattgcttttggggtctcttggactactgtgaccaacaattggaagggaagcttcctacgcctggtactgggggtttggttagtcaatagctcttggagggagcattatgactatagtggtataactgaatttaaattatatatatatatgtatatatatatatatatgtatacatatatataatacatgtataatatattcacacatatatgcatgtatcgtcatttatgttatgtttgtatttttaagaaagtatatgaaataatcttttgctacggctttttaaacatccttagtattatttgtccatcttccctcccctaactcttcatttctctccttccccccccccccgccttttaacctcccccactcactttttccaccctccccccttagtagcacccgtggcctactgtactcctctctggcgatccttttccttcatatcagggtcccttcttccttccctggttcctgcagttactcaaggctctgtatgcacatctgaagacttgaagttaggaaccacagatgagaaagaacatgtggtgtttgctctttttgtgtctgggttacctcattcagtattatgttttcttgtttctttcatttaactataaattccatgggtttcattttcctttaaagatgaatagtattccattatgaatattagcatatttttattattcattcaccagtagaacaacacttaggttgtttctttcctagttattgtaagcagagaggcaatgagcatggctacgcaaccttctccagagtaggatgtcaagtccttgggattatgttgaagagtgctatagcgggtttatatagtagatctatttttaattttttttttttgtaatttttcacattggtttccatgtgttgaattaaattctggaataagaaactgctgtttactattactactctcaataaaattcttgaaacactagctagagcaacaagactagagaagaaaattaaaaggaatgaataagaagtcaattatccctgtgtgcagatagtattatacataagagatcccaaaattccaccagcaaactcctagaaatgatcgacactttcagaaatgcggcaggatacaaaatcaacttagagaaatctgtagctatgtatccattgaaagcctgctgagaaagatgctcccactcccaatggcctcaacgaatatctgcgagtatcataaccaagaaagtgaaagacttatgagatgaaaacttaaagaaagaattaaaattaaagaaagaggttgtgagacattaggagatgaaatacccctatgtccatggatgggaagaattaacattgtgggaacgattgtcctacccatggcaattcgcaaattcagtgcaatcagaatcctcacatagctcttcacagaaacaagcagaccatcctaagatccatgtggacagccagatttatcctaggcaaaaggagaatgctggagaaattaccatcccagatttcaagcaatattacagagctagagcaataaaagaaagaccttagtaattgttacacacccttagcagtcaaggaaatgaaagttaaaactgctttgagatttcatcttaacccacttagaacagctaagatgaacaaagcaactgacagtgaatgtgggggggatgtggggaaaggcgagccctcaggcagagtgggcaaaggtttagtacaaaactctcaaggctttcctggagattgatactactaatttttatttaaaattatttttaaccaagcttttaatttcacagttgtatggcagttagtagaagttaaggaagccccttgtctatggggaaaagctaaaatacattttgcattaaggcagtaacatatgggttttccagttgtaattcatgagttaaacatctagtaggtaagactcatttagaaaatgagagattgggtttagtaagtagagaagaaataggaatttgaaaaaattctcttgatgtgatagccaactttattacttgacatatattcacaagtgggtttattgggtagaatttaaaacattattaatttttatttgtgaaaacgtaaataaaaactggtaatcattctatctctaaacttggtatgaaaaattatggtgatgagacaaatcacgtataaaactgctagaggacgggatactgctaaggatcgtatgtatgcaaaatgattgtagagctatttttattatcttcccatgtaagccacaaccttaaagagacatttcctgggcatgacgttttaggaagggtgacagagaaatgttagtttgtgttcaaatctaagatttgatgtaaatattgttaagatcaggagaaatagttattctttttaatcttagttttctcattataatgacaaaggtaacatctaatttgtatagctatgaaagtttattgaactaatgaacctatggccggagagtgttcagtttgtaaagggctttgaacctgcagtgtagcccaggctggccctgcacttactgtgctctggtttcagcctcagtcatgtttagattccaggcctgcatctaggaggctgttatggctgggaggccatgtggagtcactattgcaagctgctgcatgggtcggagcttgcagctgctttgtcccaggtcattgtacaagtgagaacatgggctgtaatgttcaggagccttcagtcctttccatctggacaggctatgagaagtctagattgaagaaagaactgttcagatgagggctccaagacggggcttctggaggacaactgtactctgaggtatcgtgctcaggccttcagtcccaccaggtcaagtagctttcctatcccgtgtctggcactacagatgccaaatacacagacagtagagggatggtgtatccgtaacatgtttgttactgtctcactttgtgtgtaaagcaaggtcgacctgcacttgtctattggttgtatattattctatactctacagtgtgtggggaaaacgtatctaaagcaaagctttggcaggcactccaggtcagtgatagtttactgaacatgcatgagacccttgacttaaccccaagtaccacaaaggcaaatatttttcaaaataactgtaataagggcatgcttaaagtatagactctccaatagcgttccaaaaatagagggggatattttacaggatttgtggctgggttgattatccttgataaaataacatagaaaaatactttaagcattttaataatttcttgtcaaatctctttcacttttaaacagctatttttaaatagtaacatgtaaataagtgcttctggtgttttcaaaaccttttcctatgattcttcttgttcaaagtagaagaaaataaagtaccctctacttgctgtataattaactaacgagagaaaatgtccattttgtttcatgtgtgctaccttacagttgggcattgttgaaccacagctttctattcccatcccccactcctggcccagtacttagaaacacactcctccagacttttcctctagcgttcagtatgagctggacattgccccagaatgacacttgtgttgcttaagacggtgtcaggaatactctggaagaaatttccattaacataaataaccaggctcaatgagtagccacatggcttgaagtgatcacgtgttctcccctcctgccttttatagctatctctgcaagccattctaaaacatccaagcaagtctagactccatattaaggaattctatttttgttgaacatatttcattgatttttttaaaagtttttacaccaaatgtgacgtgtttcagatctaaggcttcagaatttcatatgttacccaatttccctctgcgctggaaagtataactccaatccctgtattgtacttgatgaatacaatagatgcttttgtgggagatgcagaaagcaaagagttttatttggaagctgaaagaaataacgggagggcaagcagctggagagtgtcttacatgacaggcccactctgccaattagagttgtttggcggggttacgagaggctaatgtaaaacgcactgccgccgcatgaataacatgctggaagtcgaatttctcaaatcttctattccagtgcattaaacaaatacagcatttttatcgtgggcaagcactcaactagacatacaaaaacatttaaaagactcaaaaattaagcctgttggtctctgcctcctcaagaaagaaatgctatggagaaaggaacggcatacccacgtgagaatcacacccaaggaaagtgggagaccagttcttgcagaaaagaatgggagctatgtttgcgaatttcctaagagggcaagacaggatgtggagcgcgagcctggttagaaaggtgaactgtatactgacagtaggagggacctgtgctgggcgtggaccatgtgtgatttcccagtcaaattccatctttcaaatgacacattcttcttaaatcgtgtaggtggaaacgtggacttgaaaagccagtttcatcgcatcatgatgtgaggtgtgagggagcaggcaaatctagtttttaaagtcatgcttagaagtcaataaccattgttactaatatgctagggtacccaaataggtgggctccaaatattaaggcccgacttgggatcagggaaagcagagccattttatggatggattggagtcggggagagagtagggttaaaaaagagcagagctccgcagggtggtggtggcacactcctttaatcccagcactcgggaggcagaggcaggtggatttctgagttcgaggccagcctggtctacagaatgagtttcaggacagccagggctattctgccctgtcttgaacccctcccctgcccccaaaaaagggcagagctcagatgtcaagaatggtgttaattatggaaccgggaatgagagggcctcatgtgccacccagtaggtgggatctgtggtaagtgggaatttcatctgggagaagagaaatgagaattttttttttaaatttcagtttcaaagcttaatggtttggaaaataatggttccaattaaacaaaacaggaaaatttaacagaacaaaactctggcaaatatagtcacttgagtaatttttttcttaaaaatacacacacagagatactttttatgcgtatatatattattaaatttctcaagcaagtgaattctgtttttacacatccacgtatcaagaagagagaaatgatatagtacagattaggaaatgaagtctgttaaaatgatggcaggtttcttggagattcactgaagtaagaccactgtgccaacagcagtagctacccagcatctattaatccagcattgagagacaggcccacaaatcagccttgtgtttattatgttattttaaaattagcagagctatgatgaattacgttaaggaaacacgggagtttttgtagctgtccactaaacgatgtgtttttggaaaggttcataataggttcgtagtaaaatgtaacaaaatattgtaacttttgtcctaatgttgagaagtagtgttttatgcccctgttgatattatttatcttgggctgggaagtgctttcttaattgacacccccctttccctaacttacttaatggctatagtgctgctggctgctcgagtcagataaaacacgtaaagagtctgagagcttggttctaaggtgagacttcagcttggtaagctgagtaagtcgaggtacttatactaacatcagctacatattctctgggggaaaagaaccaagaaaaaaatagtccatttaaacggtcataatccatgactaagctattacttggcaccgagtcatctttaaaggtcactgaaactcacaaacattcacttctagcacagtaattgtgttcctaattaattatcatttaaaggcttcagttgtatttggattattttcatccaagattttcccgttccttctttcccaatttaagacaacacacctcatgcgttttaagctaatgcccactggagaggctctgtaaaagcaggatgactaaaccccgctgctgaccaccgccaagctcttgtctttatagaaatcacagtgaactttatgttctcatagtttctgactttcatacaaataaaaatgtaatacacgagaaaataaaacataaaactcactttctgataaagcttcataaaagcaatgggattagttgcagctgtggacagttttcatgttcccaaaatcttggctttctgaaattatcctttaacaactgaaaaacgtatgagttgcagataatgtcaaagtacttcccccttgcacaagcattttgtctttaatttctacttaattattttaccttttctattgtgtatgtgtatgtaagtgtatatgtgtataatgtgtatgagtgtatctgtatatgtatgtatataaatgtatgtgtgaatatatgtgccatgtggagagtatgtatgtatgtgtgagactttgtatgtatgtatgtatgtatgtatgtatgtaagtatgtatatgtgtgtgtgtacgtgtgtgtattgcagtgtgtgttgcatgggtgcaaaaatcagaacttgtagtagacagcttcgtcctcccaccatgttgggccagcacacacagctcagattctcatccctagcaaccatctttaccttctgaggcacttcgctgtccctatttctagttttaaaagtctactgctacatagttaatattcagtcgtgtctttctttttatcctcttctttcctcctcttccttccccactttttcttcttggtgatgtgaatataaaaattgtaggatatctctcctggaaaatttcaaagtgtataagtggctgagacagatatttgaacatatttgatcacttctttaattttaattttttaatggttcttttatttatttacatttcaaatgttatccaccttcttggtttcccctccacaagctccttctcccactccctccccctacttctatgagggtgctcccctacccacccacccactcatgcctcactgccctagtctaagcatggactgtccccactaggaacccttaggtagacagcacaaccaccctttgcctgcagcaaacttgaaggctatctcagcagatcactgtaattatggagccagcaggacttttctgaagccctcctccacgtgacacactccagtagtgctgtgtgctgttaccactgttaactaagagtgagcgtgataaatgagcttcccttggtatggtgataagtgtccttccttccctatctgtaaagaaaactctttcataaatctcagggtcctcttctaggcctttgtgaattttactcttatgtaaccatatggtctgggtgataattataattattttggtatggtaccatatgttgttattacgtttgagagaatgatctcatggagtttcaagggctatggccaggcatgaactgtgcagggaagacgtggtactaagctagtagggctttcctgactcctgggagctaacagtgtgcagcctttcaaacttcttcctcaggtcttcctcatgccatgctgggagctcaatatggacctaaaactggccatggcaggactatttaaacgctggaaactgatgaaatagggaaagaactacaagtcagaacctcttcttttcttctggagaggccattgttaaattcttactggcttatccactgcagtgttatttttggagagtgaacctcaggcccagggaatgctaagcaaacatcctacccctggggccacattctcagcccctcaatacaatttccccagctgtcactctcctccccaacactgcattctcatctgtctttaccaagaagagacttcgtgtttgctggtggcctccagtgaaaagaaaatacagccagagcatcatgtgtcattggtgaggctggccctggactctcacaaggctctcacaagtggtatctttcctctgatccttgctgaagccttatgaccctcaaactcagtgcctctagatagcaatgaattgcacacttaacacacacacacaggtccagatatgtcaagacacacaggataatgctatggagggtaaggcttgatttagtggaatgtaataattgatttcagtctttgttgtgtatatctagtgtctaaatatgacctctgaccatgcagagtctggaatgcatgtactgaaatcatctcatagtctaaatctgcagtgcagggactcttttggttttcctccttgtagcctgacatttcctcacagtctaagcgatcagtactaaacatctgaggtgggagtactagcaaattccaaaaatgtccaagcaacagccaagtcataaaacaaatattttaacccacacattgtattcattaaagtctaacaaaataggactcttgataccagtcgtgtatataatgattcaacaacctgaatcccccatcccctggcgctttcacaacttgtacagtttctctgtcttggcagtatgatgctttggcctgagtggagatatattagaagccagagttgtgtggtctttgtgtgggattcaaaaatctagggtgaggctccattgtttgttatatgatgttttgctttcagttttccattttctaaatattgcctatcccaaagagtactatgtgaaggcccagcatagacagccgacacacacgtggaccacagacattcctctgggctcttcatccatttctttcatttaacatagtcacctttcttttagtctacttttcctgattccaatgttcatcttgatggatttcttcaaggtgttcttatcctcagaggttcccattgccagttctagagttaaagacccatttcctcagggcttggtcaatctcctttgctactccaggtaaatgcaggtcttctattccagaagatagcttatttcaaagaaacttgcaacttacttctgtgcctatacatattacagaacggactcatgtataatgccaggcattggtaaacagtgccggcagccttttatgcagctgacatcacagctatgaagaatgtgacttccactctatggctttcaaaggaggggtgggtaggatatagtgagacaatggcttaaagggagctgagcaaacaggatgagagaacaggagagagagagagagagagagagagagagagagagagagagagagagagagagagagagagagttgtggtggtttgaatgaggatggctccatagaatccttgaatacttggtccccagttggtagaattgtttagaaggattaggaagtgtgactttgttggtggaggtttgtcacttggagcaagctttgaaaatttaaaaagccataccaattaactttccattcccaattaactttctctgctcatcattgtgtctcaaaagcttttagctactgctccagtgccatgtttgcctgcccatgcacttagtcctctgaagctgcaaaccccaagaaacattttcttctctaagttggcttcactatggtgtcttatcacagcaataagaatgtaactcagacagtaagaaatatagtgataaataacagtaaagacccttcagagaacttatatggaaaccaagctactattacagaagtttccatgtatatgtatgtatgtgtaacatatgtatatattatgctcacataaaataagagtaagatgaaattctcctataacagggcaacaatgcctgtattagacaccacaagctaataaatcaaagccccactgtcagacttttggggcggtcagctgggagagctgcagactcccaaatagtcagaatcttgccagtgctattggctctcctccagaactcaatgaaaagagaccctactgctgaggacaccatgtgcttgagtcacagaatatgatactgatctggaagtcttatctctactggctacctttcggtgcttgagtgtgttatgaatgccactggaggagaaaacaagtttgtctagctgaaaccccggccacctgcatgacctctggtgcaaaggtgacatgaacatcagtggagtgactaaacactttctgattggatttaagacctactccacaagagaaacccatgcttggcaccattgtcagaccaagaacctgtgacaagacaggttctaggcccaaggggacaatctacaccattgtatctgctaaatggacgtagtattaaatggaccccatgacttctagtgatacttgtagagtactacatctctgaggcctcaccagtgaagcttctagttgcagtagatagcaattaacacaggtccacatctgctcaaggtacagagaacaaaagaccaaccataaatcatggagttttcaaccataaatgggatgttagtatcatgcagattcttcccaagaccttgaaagcattgaggaagaggggggaagagtgtaaagccataggtggtagatgagtacaaggaacctgttctagacacaacagatagctgcacatttgaaattacagcagttgttacacatgcataagacttggacaaactcaggccagatcctaccccagcatgaagaggggagctgccacgatctcagacagttggccaagggccattgatgaatgaattctgggagggggagagtcagtttatctaaaagtgtggcttctggtaaattgaacacacttcagtggatggccacacatccaagaatatgttgactgcacaaattaaacttggtaggtgtgagaacaaagagaggacacaaagttgggtgggcagagaaagagggaggcagatctgagagaatgtgggtgagggagaatatgatcaaaacatgttttatggaaaactaatagtttttgtaaaactagtaagagcagctttgagttttcagagaaaaattttgatatcttgttaaaataatatttaaaattcatgtctaattttattttaattgttgtgtatgtagtttggaaacagacagttaaatggcctctctttgtgtgtagtccctggcttacctctttgtgtgtagttaatggcgtggcttctttttttttgtatcttacttacatacaaaaagggaggctccttatagagattcactaaatttagatctcgtcaggtgccatcgcttggagtgacattgcttaataatcctttatttttgcacattgcccagatccaggctctatccagaaacatcttttctttagactcacaatcctctctcctctctctctctctcccccccccccattggcacatagtttacaagtttttttttctggtccactttagctttgtgtcatgccgcatcgttacaatctgttctccgctgcacagggctggagagggtggggaggcaagcaagggctggccatggtaactggcgagaaggaaagacgcagcttcccttgcccagtgagtccaaccctgctctctctggccctctctccttttctccatcagctttgctttacacttacctgaaacacaacttggaaagacttaaagaacaaaacaatgaaagcaatgtcgactagcagcgtccttggcaagtggaaaggagatgattgttctcgaaggttgtttgttgagaaatgacaaaattaattttatattcagagtgaataagaacatgttcttcttgagatccagtttagctctctataatacgcgagcacacatattcagttttggtgtgctgaaatcttctctcgaaatatcaacatcactttagactgtctctaaacatcgtctctaaataataaatgttgtttgaaagtatatctaagtatgaacatcactctgagatttttaaagtgtatatgctagcttactcaggtaccctgactcgggatagctcaactcctacactgggctgagggcttgcccatttatacaaatacaacctattcttaggaaatgtgtcctctcatcaagtcctggtcatccttccttggagcaggtgcacttttgcctaccaatgctatcatgtcctcgttggccctgtctgctgtcagctctcctgccacactgctgctagaggtggcttttgaaagtgcctcacctcctaccttctcagaatgaaaacccaaacccaactagtgaaatacatttcagcacaagctagccttgcctacagttcacggttcttgcctgagaccttgtgtgtgctagaagcacaggagccctaatgttgctggatattacatgtaatggctcttgcagtttcttctctctgactttctgggtgttactactatgctgtttgaagtttgtgagctagacatcaagaaaaggagtgctatggatatacatccatcctacaagctaaatatcctacctacttactgaattcttttgagggcattgagatataaacagcagtttaaacctttgggatggcatgatgtgtttaagaaataaagttatacttttaatgagttcctatgatcctaaagtagaagtaagttcttccactagaaatgggaggaacatttgcaaatcaggttttcaccctaaacactatctctcagtattatcatcattggctaaatcttgagactgatttgttgggcaggcaggggatggcttttcagaatgtggcagcaataaaaaagctcatctgaattcccctgagtatgcagtttgagaagtcccgtgtttcagtactggcttgcaggagggtgctctttgccccacctgcaccatctctatgcttagacagtcataccaaaaaccactgattttttttaagagcaaacatttgaataaaatattgtaaatatgatgtttaatggctagattcttcaggtaacagaaaaatgacctgacataattaacatttttagaaatattcttaaagtaagaatgtatagtgaaattcaaagtttatagaccacaacattgtctttaaaccaaaggactaagctaatgataatacattttggaacatgggattttcataaacaggcagataaaaacctaacaggtagccgggcagtggtggcacacacctttaattccagcacttgggaggcagaggcaggcggatttctgagttcgaggccagcctggtagagtgagttccaggacagccaggactacacagagaaaccctgtctcaaaaaaaaaccaaccaaacaaacaaaaaacccaaccctaacaggtgcatttttaatgttttaattatatttattggtagtgaggggtatgtgtttgcgaatgtgcacagcatgcatgtggaggtcagaagggttttaagggttggttctctcttttaaaggattaaactcaggtcaccagacttggcccagagtacctttatctgcttagttatcttgccaggcctcatgtaatcaactttggaataaaatttaaattatatttatgagataaaaggtactgaataaggacctcttcattaaaaggcaccaaaaatcactttgaatgtttccctaaagatgctatcttaacatgaatttatagtaaaatgaccagacaaataatggatacaatgagaagagatcttagggcacaaaaacatactagccctgagtagataatatagtgtatctacatgtggactgcagatgtcattctctttgctcagagtaataaagactacaaggtaccaggaaagtcttctggagttagaatgaatggatgaataatgaatgaatgaataaatgagtgacgtagaaaatatactatatgcacaggctagatacaatttggactttcatctagaatagaaagtttttactagtatgaacattaagatagattatattcgatatttttaaaataataagagtatatataagaacaaagatatgttagctaactcatgaaatatgagagcttgtgtatgtgctccaagtgctggaaggaagacaggtgagtgaatatgtgctttgcctcattaccacagaaacatatggaagttgttatctatatcagagttgtatgctaaaaatgcaagtaggtttaaccaaaaccataatggaggactttatagttgaaaggagaactggggatgtttggagttatctcacagcttaactgagctgatatcataaaagtgatctgaaatgaaatattatttaaagtaacagtgggattttatacttatctatttaagtatactccatgactgtcagaaaatctgaaggcaacttacctactatttctacttatcctttgagttcagtcctcacagtttatatagagccttgaggcagtcattaattctttactcctggaataactaacaactaataattaataattatgctattcgtaattcaatacacaggttgataggggttcctatatctttctatgtctttcagcatttgctgggcgcctaccaggtagagattcacatattgtactgtggatttgatctttaacaagcataagtcagtccagtccatgcggcaacatttgggaaatactgtcatagagaactctatgccatgatgggaacagaggagtgtgctggagatttcgtggtagcataagaaaacatttgttgaagccaaagagtaatttgtaaaggaacaatgggaaaaagtgttaggagtggactgtagttagattttgcagggctttgaattccaactacaaaaggttttggtttactctgctttttacagagtgcactcccagagtgtttggagcactagactattatgcagaaagggcaagtaccaagtcagaaatgcctgagacaggctggtaggtgagatgtaaggatcccttggataacagagatggcaatagacagagtgagagcgttgtgtgcggagctgtgagacagacacggagcagtgagtacagaagtcctccacagaggagctgagttagaaacagaggaatgagtgcaaatgtcttccataaaagctcactgtgctctccacccttaacatttttaaaaaatatcttcttatatgaatagacattttcattttttactctttccttgaatttttcatttctgtaaaagcatgttaactactccacataacaatttatcatttagagtgacattgttagacagggacttccacctaaaccttcctaagagccaagggggcgggggtggggtggggctgtatgtcctgcttttgctttcgtgtctgagtgccagcatggtctgaattatcttactgcatgggaggcagaatggtcccacactctcctcttctatcagttccactcctgctgcctgtgtgctaagcccctttgcattcaatcaaagtctttcagaagctaggtattcactgatactacagtatttacatctctatccctgtgtcatgaaaatccagtatcccactgagatgttagacttcaggaaacaacaacaacaacaacaacaacaacaacaacaaataagccaatgacccagagaaactttctaggtggtaggaagttattgcttcaattgtgtcttcttatgaaacatgattatgagattgtgtgtccatacttcctgtttgtttgaaataatcattccaaacaaacaaagatttttatttagcagatgtggaacatctatatggggagataaaccattctttctgaagtgggagaacttcctctgatttcagaataaacaaaggtaccctatcttccttgcttcaaagaagcaagggctagaaaattgatgtagaattgccagtttgtaaacatagctcaaccttcagtatataccactggataaatatctcctatttactgcacagccaaataatttgcctctaattcagtcatagttgcaagtctgctgaaacaagctcaaggtgttttaaacagatgcagaaccaacagcagcacacaggtgtgcttctagagatctataggcagtttacttgttttcttaataaatctcccaatgagtgaagggatcatcatttttagccaacccgacaagttatctgaatgtttttgatatcactaaaaatagaatccggattgattatcagttcgcggtagaatgacagtggggagtcagccctctgttgcagaacacttggtgtgttctaaggttctgtgtctcaactctgccactcaacggttctagggcaagcttcctcagatcaaatgatgcaagtacaggattagtgttatccatcacacatagcaacggtgttaccctgaagtagcggtctccatctacatcagaggagagaatcacaaggcttcctctctagtctttgtgaaacctcctcctagcccaaatcaataaagaaacttgaagaaggtgggctggcttctttcccagtgtgaacactggcatgctttctccaggcagcaaagccagtgtagcacacatgtcacttgacaggaacctcacagagagcttgttctgtgttatgcggtccctgtttagttggaggtcctgattttaatctaattacttgtgatcttgagtctgtttaattctctgtaacttttgaggaaatcaacataagtaatattcacccctccagataactaaatactgcatgtttatataatttgacgctgaggaaaaacaaacaaaaaacacctcagtttgtgatatttcctaatataagttgttcctaagaaaagaaatgacccaagccatcctaaaaccaatgtaaaagtgaaacaaacttaaaaggacactcaactcgctcacttccttataagtaacttctctttagtggaaagaatgagcgtgactctgctcaaatatgtttgctttgaagaactctttttggctagagataaatattcactgaatactgtcaatataaaaaaatattacttcttccaggaatgttcaaaacaaaagttaatcccatttatctgacaagggtggggggaattacgttagttcaatcatcagaattgtgtattcaagtctaataaattatatatgtgcaccatcgttgtcactgttacactctatagccttaaagcaagaaaattaacttttcatgatgaaattattttattccctttagagtacagagtaattttcttccatagtcaaggtaaaagcaacagcttacaggttatcaggcaccacaaataattcataaattacctaaataacctgatttctactttttatccaaaagcaaagtagataagacctcatctgtagcaaaaactggcatcccagaaagaaaacattatcactgccaaagcatagctaagctgtcccgttacagtgagtgcagggggtcaaggtgctgttgtcttaatgataccaggagctttagtagcagactcaaagtggaaactgatggtagggagagaataaggaggccgtgctctgcatcaaaccatggaattctcacttccaccgtgtgccagttagattccatggtagctacagctgaagacatcaaataaaaacacgaaacaggaaaactgggaaattttgattttcatctcttttaaagaccttagcattatgatgcgagcatgaaaaatgattctgtgttagagagggaagtggggttaaagattccatataaggagtttctgagtgaataaacattaaatcctttaaaattagaaatgccaacataattgtattttaaaaagtgagatgatcccctgaaagttttttggatcatgaatattttattattactaaaaccaattctgttagtcccatgttctagctggaatgtgattatggactcacatcacaaagtgaatttaggaacaggatccagacaatctctatcacagcacactcattaccctcactaaaccctccaactcagtcaaacaaataatttacaaatctgaagttatgtttcaccagagaacacgcagaagaggggacacaaagagcacaagagtgggacagtggggaggagaaccaagagacagtcttgtgacctgacccaggactcaaaaatgtgcagcaactgcaactccttccatacgatgtgcacaggaccacacccccagacatctagtctctcactggggagatattgatgggcccaaccctgcccaggggaactcatggcaggtgagggctattggaaggaagtcactgtcttcccgggtgttaccaactaatgagttttcaatgatcctgtggatagctctgcacctgtgcccacacggacagcccttaaataggttaagcctagtgagtcatgaataaaatgaaaatgcgtgagcttgagatggggactgagtagaaggagggggtctggtgagggtgggaggggatgacggtgacagtacatgatcagatgtgtgacactcctccaactcaatgtcactcattcgtcagtgaaaataccacccctgccttttcttatattccaattttcaaaatgactggaatttaatgattcttgacttcaatatctcatgtgttttatccttggataaccattgggcatggaagttgagggatgggcacagcaagaggaaagaataaatgtgagagatgtaagtgatcctcactgtcagatatcagtagaatatttgcattctctcctatttgctgaaagcatgcagacgaggcagaggaggggtaatgttccagtgttatgtgcagcagtctagtggactggtgaagcatgggaactggaacctgagcaccagccaggaccagtgaggagaggtggtgcttccaggaagtcaacaacttccccaggacagatgtgtgtgggcatttgcccacatgtctatacttgtgtaccacatgtatgtaatgtatgatgccttgagaggccagagaagtgtgctgcaacacctggacttggagctatagccagctgtgagctgccatgtgggtgcaggaaattgaacctgggtcctcagggggaacagccagcgctcttaaccattgagccatctctctagcccttttgtaatattctttatgaatgaagacctaggcattttacagcctcaaaataagctaatcagtttttgattctaaaacaattaacataatctcaggttggaataaagaattcgacccatcattccttaatttggtatttttctagtttagaaagtaatggtttgagtgtctgcaagaacatcaagtatggctgtctggcaataagacagaggagatgattctgcttcggacttacttgttatttcatcatttcgtcaagacaggatgactttcactattttataaataggtccgttctctgtcatgtgcagttaaatttgtaaccttaatatgactgttggctaacagtattctcagttaaatataaactaatcaagtgtaaaacaactttataacccacttttaaacttcatattgtgatgaatttgacaacgtgtagttcacttgtagataatcttcatgtcagcagagtctctgcctagaatgaggtctggcaatgagtgcgccataactacttcttagcaaactttgtgagacggttgcacagcagccagcgttatttgggggaagtcaagcagtctccacacctgcaatgcttagcttgtggagtgctgcttgcgatagcagggtaaaaccacacggtcatcttatcattgagaaactacatatattacaagaagaatcaagctagcttttttggggggaggttatttatttatttattcattcattcatatttttattaaactaataattttttatttttaaaaattgatttatttattatacataagtaaactgtagctgtcgtcagacacaccagaagagggcatctgatcccattacagatggttgtgagccaccatgtggttgctgggatttgaactcaggacctccagaagagcagtcagtgctcttaaccactgagccatctcttcagtcccctaaaatttattttaaatatacaattcagtattgacatttttaagtcatcaaaacaatttataatagagctgggtggtagtggcacacgcctttaatcccagcacttgggaggcagaggcaggcagatttctgagttcgaggccagcctggtctacaaagtgagttccaggacagccagggctatacagagaaaccctgtctcaaaaagcaaaaacaaaaacacaaaaccaaaaataaataataataataataataataatttataacagttaaatgcctctcaaatatatgatatcttccgaagctaaaagtaatatgcactcaatcagtttttaaaatatatttggaacattaaacatgatagaagtagaaaaaaatctcttatgaagtcctctatgaagggaaattatgaaaagttcctgattagacagaaactgttccatctccaagggagaacactaagtgtaactatggcttcatagaatgaattgtgtagtgttgcttctgtttctattttgtggaatagtttgaagagtattagtgttaggtcttctttgaaggtctcatagaattctggactaaaaccacctggtcctgggctttttttggttgggagacatttaatgactgcttcgatttctttaggggttatgggactgtttagatagtttatctcaccctgatttaacttcagtatttggtatttctctagaaaagtatccattttatccatattttccagttttgttgaatatagaattttgttgtaggatctgatgatttttttggctttcctcagtttctgttgttatatctcccttttcatttctgattttgttaatttggatactgtccctgtgccctctggttagtctgcttaagggtttatctatcttgttgactttctcaaagaactcgctcctggtttggttgattctttgtatagttctttttgtttccacttggttgatttcagccctgggtttgattattccctgccttctgctcctcttgggtgagtttgcttccttttgtcctggagctttcaggtacactgttaagcaggcagtgtacgctctctcatttcttcttggaggcattcagagctgaactttcctcttagcactgtcacactagcttttaagaaacatatacacatgctaattagatcagaggcatgtttttgtcatcttttctacaattatgttcgtattttaatttgcatccgtttaacaagctgttaattgtgtaaaactcacagaaagtattttggaatttatttgttcataagtcataagttttacactgttaaagaaaataaatttcatgattagttagagaggggcaattaatattttctttatccaaaactctgaaataatgaggcaatgaagataatcattagaaaggctgtgatggcgtgtaaggatgagataagctaacagcctatgacttgggggaccatgaccagcagctcttggtcttagtctaagccatgttaaaatgctgggttgaagtgaatagtctagcgagtgaacagtctgggagtcattctggacgaggaagggcaaaagaaagactgtaggtggtgcgggaggacagagccttcacttctgggaagcaacacacactgacacatagctgcatgataagtaaatcaacagacaaagctgcccctaacagcctagagccttcatacccataaagaaaggacggaagacagtcaacaaataatgctggagaatgagattgctgtttccaagaatctgatatcaatgttggattaaatctccttataaattcaaagcatttccagctgaattaaaattttttttgaattcttgtttgaaatccaaaacatacaaaacaaacaaacaaacaaacaaacaaaaaaaacctggaatagaatatactttcagcagtgggttgaaaatcactctcaaacacaaaaacaatgtaataagttgttaagaagcacaagttacatgttattataaaatgccaatcttaaaacaaaaaaccaaacccaaatgaggtcttgcctttctacttgtggttttcctgtctcagtctcccagccttgggatcacagtcctgagccattcctgctgggtaagagagtaccaaccgtggagtaaacccatacaaggaggggttcgaggctgagggaggagcagcagtcagactagggtaagagatgaagtgctaaggtttgcaccagaattacaacagtcacagtaggcttggacctgagacaacttgctcactagtggccttgacaatcaaggaacagttaaacttggtactggggaaaagaaaccacatgctttttaatgaaggtcttcaggaagggtgggacactctatccattgggaaggctggagaaactatcctttcagctcctagatactgtgtctacagtctatgaaaattacaagtccttaaaaatgcatttagagctttaaaattaagatactggcattaaagtttaaaactagtgattagcaaatatttagcacacaaaatgttatgctcatttcattattcattaaatataatgattttaatattatttgaaaacaattcagtatttttcactttgtaagaattcccaagaatgcgcagtacctgaaatatgtctatcaaatgataagctcagtgatttattatagaatgactgatctttcaaaagaaagattgcacaaaaccctaaaataattctattgggtaatattcacatatttaatatgatccactgtgtagggcagtcttgggaaatagtgccatgcaaatcttaaagtagctctggttaagggaatgcatttaaagaggatttttgtaaccaaaaactgaagagacgaggaaccacaggtgaccagaaaagcgaggagatagctaagctgagtcgactgctctttaaaggtgcaacagcaaaaaacacatatatatgtttaaaatgtaactggacaaagtaatgcaacatatggcaaaagtatgaacctgcggtacaggattttcacatcaaaagggacacttgtttaaaaacatctttgctgtcttcataattgtgtccatgctcaaaaaaagtaggataaaactacaagttattaatagctgtattctttaattaaagctgtcagcctagttaaacaaagactgttcacagtttattatttgtgtatgtaattcaccatttgaaacctaatagtttgaaacgcattagcaaagtctcagggcatttagaagcacattgactgtttctgaatgcatgtgcacgaagtttctatttataaaccacatttacagaggcttataaactagccagagatattcatagcacgaatacttgagacttacaacacacagagaaattgtaaccaaaaactctaggagagataaaaatggaccgaggaagactggcttcagacaggattctggccctgatatcactttacattctagactattattgactacaacaaagaattgtgtaagtgaagtataattacataaacttagtgcattagaaatttaggcataagtcattttggaaaaaaatgaacaatttataaaaacaatcacaatactgtccaagggtcagaatgacaccaatcagcacccgagcacaggtaccttttagcttctcaactgaaattcatatcccatctggttccctccaggggatctctagtttgacatttttcttttttaaaaaaatttttttactacatttatctacttatctatgtgtagggggtgggcacaagtttgccctgcatgggtagagtggtcagaggcatgctgggagttggttctctcccttcaccttgggatggatgtcagctggaggtaagcatctgttcttgctaagtcatctcatccactctcacactgacactctttaaattacaaaccagaagagtggaatagaattgaagacccagaaatgaacccaaacctatggtcacttgatctttgacaaaggagctaaaatcatccagtggaaaaaagacaatattttcaacaaatggtgctggttcaactggtgggcagcttgtagaagaatgccaatcaatccattcttatctctttgtacaaagctcaaatctaagtggatcaaggaccttcacataaaaccagatacacagaaactaatagaaaagtaagtggggaagagcctcgaacacatgggcacaagggaaaatttcttgaacagtacaccaatggtttatgctctaagataacaatagacaaatgggacctcataaaattacaaagcttctgtaaggcaaaggacactgtcaataggacaaaatggcaaccaaagattgcgaaacgatctttaccaatcctatatctgatagaggctaatatccaatatataaaaagaactcaggaagttagactccagagaattaaataaccctattaaaatggggtacagagctaaacaaagaattttcaactgaagaatatcaaatggttgagaagcacctaaagaaatgttcaacatccttaatcatcagggaaatacaaatcaaaacaaccctgagattccatctcacatcagtcagaatagctaagatcaaaaactgaggtgacagcagatgctggtgaggatgtggagaaagagcaacactcctccattgttggtgggattgcaagatggtacaaccactctggaaatcagactggcgattcctcagaaaattgggcatagtactacctgaggacccagcaataccattcctgggtatataacccaaaagatgttccaacatgcaataaggacacatgccccactgtgttcatagcagccttatttataatagccagaagctggaaagaacccagatgtccttcaacagaggaatggatacagaaaatgtggtaaagttacacaacacagtactcttcagctattaaaaacaatggactcgtgaaattcttaggcaaattgatgaaactagaaaatatcatcctgagtgaggtaacctagtcacaaaagacacacatggcatgcactcagataagtggatattaggccaaaagttcagaatagccaagctatagtttacagaccacatgaagctcaagaagaaggacgaccaagtgtggatgcttcagtccttcttagaagggggaataaaatactcatgggagaaaatacagagacaaagtgtggagcagagacttaaggaaagggcatccagagacttcaccaccatcccatatatagtcacaaaacccagacactattgtggatgccatgaagtgcttgctgataggagcctgatatagctgtctcctgagaggctctgccagggcctgacaaatacagaggtggatgctctcagccaaccattggactgagcacggggtccccaatgtaggagttagagttccttaaggagctgaaggggtttgccaccccataggaagaacaacagtatcaaccaaccagatcccctagagctcccaggtactaaaccaccagccaaagagtacacatggaaggacccatggctctggctgcatatgtagcagaggatggcccttgtggagcatcaatgggaggagaggcccttggtcctgtgaaggctccatgccccagtgtaggggaatgccagggaggggaggtgggagtgggtaggtgggtgggtgggggaacaccctcataaaagcagggggagggggatgggatagtggggttctggggtgggggaaccaggaaaggggataacaattgaaatataaattaaaaaaatatccaacaaacctgaagggacaccccattttttcttttgtttattattttttaatgtattcatcattttgtttgcttacatttcaaatgttatccctcttgcgggtcttccctccacgaatctcccaaccctcccctttgcctctaagagggcgctcccccaccaagtcttgcctcacccctctagcatcccccttctctggggcatcaagcctccacaggactaagtgcctcccctcccactaatgccagacagtcctctgctctatgtagtgggagccatggatcaacccatgtatactctttggttgatggcttagtccttggaagctctgagggtccctgttgtttataaatacaaattcaaattcctcaagttagtattcagttccattgcttacacttcctaggctagatagttctaatttgcatgttagcttccatgaccttgactatgctggtctttcttcaactgtgctgcatgctcatctcatttacacattagccttacccgtcacgtgaggctctaccattactcagatccttttacccttctttaccacagaaaacatttcttggttttgaattcctacgaaattgatttttcattccatgaatttaagcggttggcatatgttgctgggtatcatttatcttatccttgcagaaagagaaaatctaaaaaatgaattttgatagtcactctactcatatcaaagcattttgatgactgcataattaatgtcatcaactcgtttctaaaatgtcactgaatctcatgttccactctgcacttgagagataagcacacttgcaattgtaatcgtggtcttcacaaacatagaggacttgtgttttctacacttgccgatgtgtatttgcattatgaccctattgtttatatattacaaaaagaaataattcatttgataggcaggtcttaatctatcaccaaagacaatattcaaaacaaactaactccatatgctctgtgtctttgggacaaaaataaataattaagatgtttgtatagtagtctccttacagtccatcattgtatacaataaatgaaagtcttaagagtacaacttcaaaaatttaagttgcaattttaaaacatatttttcagtcacaacagctatatatttgcaggcaatctgcacagagagcagggttactcgggttccactatgtttaatgtcttagaatggtgaacattttctagcactgatgaaacaatatttgaatatatattagtttgctatgctgtgcaatcgcatgaatttgacaaatgcataataaaatgtatatgttgttgtagttctatataatagtcccctgattaaaattccctgctttcacatcaatgctcatgtaagggacttgttgctgttgttgttgttgtttttgtttgtggcctgatatttgagttctaaaaacactaaacaatattccagtgtatgtatgtaagcatagttggaccattcatcccctcttgaacactttggttgcttcatttctagctcttatgggtgaagctgctttaaacatctatggtcagatttctgtgtgaacatgtcttccactcagtagagtaagtgccttggcatacagcatctgtgtgttcagtttctaggaaaccatctgcccagtgtcttccaagttggctgcactttgcgttcccactacccaggaggagtctggactgggtggcatctttgccagtggtgtgtatgagctgtcaggcttgctcacgctaatagctgtgaggaggccctcaagactgttccttcttcaattacaggacgaggcacctttcctctcatctgctcttttgctatcatttcttcagatagcttatctacttttaatgatttttgttatattgtcatttaaacttctttgttcttttagagatattaaatatcattttgcaagcatgcatttaaataaaatttattgttaaataaaatctattcccttaaatgtaatataaatattcagttgttaagatttcttgctcaagacaatcctgatagaatatcctaaaagttcgttatttaacattaaaattgtgggattttgttgttgctgcttattttagttcttagggttttttttttgtttgtttttgttttttgtttttagttcttagttttaatgtgtacaaaaggtatacttgatcaaagataaaattaaatggtctaattagcctaaccatcaaactacttttttcatcttcgaaatgtgtattattctatctatatttatatgtgcttcccttgaaaccttccagcataatgctttaaaaagtgttaggaaataaatattaatacgttggagtagaacaggtttccacataactattggaaataattttgaaagggaaagttatagtactctaaatcatgaagctactgacaataacatggagctagtatcagtatcgagagagagtgcaggattaaaggagtacttgtaattttgcaagtagatagtgggagaattttgtttaagtatagcgactaatcccagggtttcaaatgtgacacaagattaaagaggcaaaaaggtggaatgatggaattttggaaatagaaaagctattagtgtgtaagctagacacctaaatcatgtcatgttattggctaggttaatgggtgatatacattatatattgtcttaatctttatgtttcattctctctctctctcattatgttaaaggtctggtacatctatgtaatgcaatgtgcttcatctcattggggatgagtgagttaatttgtaaacagaaatatcaatccacagaaagatgccatcttatatttgccttatataagaaagcatatataccttttatttattgtatattaaaatgtcaagaacaattaagttattctggtagataaaatatctataagttacgtgtttttatattttctgaaaatctttcaaactcttgttttagggtggaggctaaattctagaagtctggacagttaaggatcccacaggtttttatagctattggaaagaactgcattcccactctgcccgtgcacaaacaagagacagcgttaatacttccaatttccaggtttcttgatttcaaagggcccagcagacagggtgtaacagaccagacaatcagggctggttccccatcgtgcttcttaatgctatcccgccgaatgactttaggtctgctcatttcctggtatgaaaaaaaaatccttttctttttattgtcaggcaattaaaaatacaagtacttagctatttaaagcatattcttatcctatttgaagcaaaaaaacccttacaattctttttcgtatttttatcctgataagattaacaatgtttatcactgattggtgtcaaagagcaacaacaacaaagaggtggacaaaggacatggcaggtgggggttgggggaggaatagaggagcttctggggacaaggtgatatgactggtcctaaaaggcacagagcccacgtatcacaggaccagtaactgtcattcaacagttacgttttgcggacaactgttacataagaacctgaggcgggtgcttgtctctgaattgagcctggcatggcagtggctctagggaagatctgctgactgttgtgtgactgtgtcagcgtcagcatcgtaccctgtcgtgagcttgtcatcgatgtgtaaagtttccatagcctcttcaggctagtgttctcctgaaagctttcttctctttcaagtaaggtgtttctacaggagtgcttgtgatttcaagtttttaatttgtttcctaaaattacaggatttcatgcatttcacaacacttcacaaatacttctaatgcacattcctttgcctttgcttctgagatgccagtgtttcagctgtgctgctgttccaggtacctctgactactgctgttcacacacatgacaaatcctgagtaggcatgatcacattttcccttcctccaactcctcccagatcttctctacctgcccacccacccaactccatattctttttctcttttaaaaatagacaaaaacaaacacaaccaannnnnnnnnnnnnnnnnnnnacacacacacacacacacacacacacacacacacacacacacacacacacatcctccacaaacccacaaactccaaaatataccagcaaaagaccaagaggacaaaacaaacaaacaaacaaacacccaaagcagaataagacaaaatgtctacaaaaataccaccgagttcattttgtgttagccaactactcccgggtgtgggacctatcctaatgtgtggtttgtatacctggtgaggttccactggcaatgggtatcaattagagatagcttgttggttaggggtgggagcccatgtttattccctgcctcccagttgctgagaatccatctggcttccctgtgcaggctctgtgcacagtctctgtgagttcatctctgtatcagtcctgctgtgtctagaagaagctatttctttggagtcattcattcgctctggctcttacagtctttctacatcgtcatcatagagccctgagccctgaagggagggatttgatgaagtgctccaaagtctctcactttctgctcattgccctagagtgatcgctgtgttcatttccatctactgtgagacgcttccctgaggatggctaagcgaggctccggtcctctatatcatatataataaaagagaatacttggctaacattgtaaagtacctgtttagtaaaataaattccacaaagattaaaaagttaattacaaagtatataatcttatgttaatatgatttttataattaaattttgaatcatctctatgcattaaaacattgagtttaaaacaatcattttaaaagacagttggttttccttgctataatttataattgcttaagttgtaattttaaagatagtcattttcagtgaagtcaagaactatttatcagtaataatttttaagataaatatagacaaacatgaagagcaacattgttaggtgtatccttcctttttgtattttaccatttagcagctgtcaggcttcggtagattacttacttctctgtgtattctcagatcctcatcaatgaagtggctatagcaaggatgcctgccctacagtgtgtggtgatgactgcacaacttcatacacaggagggatacttttatgttatgagttcagcaaatattagctacattgtcactatggtagatttgaagtattactctaaaggataactctgaacatgtagtaaatgtccttcttcgtgtaatacatgtatcggtttgcagttctgtgtttcatgatcacactgctgtttgtggctgtgtgttagggaaatatgtctccagattcgtgagtaatgatatatgcttgtgtgattccttgcagacatcatggaaatcaggaccgtggcagttggaattgtggcaatcaaaggggtggaaagtgaatactatcttgccatgaacaaggaagggaaactctatgcaaaggtattaataactgataagttattgttcaaacctactctatcaaaattatctgcttttctgaaaactgaaattagttttattccaccggtgcaagtggactattccattaagccactctttactccagcactaaggcaaactattttctgtatgacctgagatttttatttaaagctacctggatgttatatgcttcatctgtaagatgacttggaatgactgatctctagggatccttccaattctaaatcccttgtgcactattgacacttggaacctaaaatttgcatctctgagtattaaagctctttttgtgaggatccacccaatttgcaccttgctgacatgaaaattcttgtaaaaaattttgaattgttcagttcatttatcaacatcagtctcccagttatggcctttgaactctaagcactgacatcgtttccactttagtatgatggaaatatgtgaccgttcatcccactgtggtaaagcaaaggccattctccattgtgctcttgtagctctgcagaataatgcctacgcaggcaaactacagagtagaggctcaatcacatgagcacacatctctgcatggatgatcaaactaagtaactttttacttttgttacaattgaggctaacatggtagaaagtgaagtcaaatttactaaatagtccctcacctgcaggagatagaagctaccccctctacataaatatctggtggatagagaatgaagagatttggggaccccaacattaaaaagagtagaaatttactgcccaactggacataactaaatgtgttttatattattatgtttttgttaaacttaagatgcttttggcctacagcagtatgtgccataagtaaaaccactaaaccacatcagctctgctcaatctgaggcttaaaataaatctcatgtatatcacctctacagaccatcatctgcttgtggttagtttgattctcctgcagaatttgctttaataattgtgtttgttttttggcttgtttttatcagaaagaatgcaatgaggattgcaacttcaaagaactgattctggaaaaccattataacacctatgcatcagctaaatggacacacagcggaggggaaatgttcgttgccttaaatcaaaaggggattcctgtcaaagggaagaaaacgaagaaagaacaaaaaacagcccattttcttcctatggcaataacctaagtgtacatggtatttgagaaaccagtttcattcagcagggagatttctttccagtggacttttcttctctctctctctctctctctctctctctctctctctctctctctctcagtaaccaagaaaggctggaaaactactgaaaactgatcaagctggacttgcgcatttttgtttattttaaaagactgcattaaagaaagatttgaagaatatacacaaaaatcagatttagtaaaggttgtaaaaagttgtaaaagtggttgtacaatcatgatgttagtgacgtgatatttttcttaaattaatttacccttaagagtatgttagatttgactatctgataatgaatatttaatatcactatctgcttataaaatggctgctataataatattaataatgcagatgatgttatataaggtatgtcagacctaaaggctgctgggatgctttgtcagatgatcaagccccacacaaactacagacgatgagcagtgtttgaaagctttccagtgagaactataatccggaaaaatgaatgttttcaacattttattatagaatagaatctacaggtggttttacaaaatcacaggcttggaacatgcctgtactgactaatatgaacaaaaatccactcaaattgaaaaggtattgctaacaggatgttttaaaaatctgtatataaaatagcaataatgatgataatattgtatttcatctcaccacaaaataatattttataatcccttaaaataaatttcagaaatctttacatttttttcaagtaaatctatctgttgtataaatcacatttgggaacacaacttttagtaaatgctcttcccacaaataatcatgcttatttccctctgtgattacagcattaaactctactttaagttgtatttgaattttattgttttgttatttaagtttatgttatttataaagaaaaaaaccttaagaagctgtatctgtttcatatgcttttaatttcaagggagcaacaaacccgactggctgcagtgcagatgtcccctcccctggtggctgacaccatgactagcacacaacacttggctagcaagtgctggatggcagacaaaaacgacagcctgtagccatgctcacaatagatgtctcacagagaacaatacaaatatgtgggagagattttacacaacgctcgtgccaatgaatttggatcatatacgtaaaaaagaagtatttagtgaggatgtatttttgaaaataggcatatttaaagttagcaatttgatgtctttagaagtttttgccatacaagatatgccaacattgaaatggcaagagtgaaactccaatagaggttgtagtcagccttgaggcctcaggttgggccacaaatgacaggcttaataagtagatgaatacttactccatagttctgcaaccagtagatggatgctgacataaatttatgaataagtacttatgaagggaagggcaacatttatttaaattgttggtatattaattaatgcggtatcaacttcatagtgcttgtcattaaagtttctttatattacatacaacactttttggtaatatgtttatatgttaaggtatatgataaagccttgtcaacaaaaaagaatcaattgactttgtgtttgtccaggcatccaggctactggaaggtcagaagtgttgccctttgccacatacactgaaggacacacatgaggcaatactttgtattagcatccaattcaagactacttgtaatctagcttcctagcccaggtactgtaactggagtcttgtacacataccaaaggtagaaaaagactgttcttcttagttgtttcataggtgtctagctgattatgactagagtttataatcaacatatatatgtaaatccattaaataatattttccaaggaaaaggtgaaatgcaattattcttactaaaagtttaaaaactcggagcaaagcataatcacgcagaagcttaaacagaagtagtaaccatacacagaaggtggctatagtgattaccaaattagttactaagaaaaagccattagaatattggacttaaattagacagaaccaatattgagtagtaaagccattcttagtgatatgccatgtacaaaatctgcccacaagcactaacatttttgttacttttagatcatgtgcctgtgtaaatgtctttatgggtgtgtaaatctagtgtggacagtagtcatggagttgagcagagggttctaggagctgagcttgggtcccttgcaagaacagtgtgtgttcttaactgatgacccatctcgcctggcccagttcttatttttaacatgcaatttcaaaaacacctgtttagtcaaatacatttagaattctagagtcttgaaagtctatgaggccttcatcttactcctctttcacatcaggaaactgaaatttttaacacactgggtgctggatgaatgcaggttaccttggagtctcagacactaagcttgtgtcttagtctcaccttgtcagtgatcaccttgttttgcttgattttaatttccatcaagatgtcatctttttatgtgagaatacttgtggtttgcttgtcaattcacttagcacgtaatgataccattatgatttgactctaatggagaaaggaatgtggtttccaattctgattcctaagcagcttttatgtgaacttctttataaatgaaaagtatcacacaagacattttcataatcatagtattcctttctaaagtgttctttaaaaagaaaaccatatcaactcatggatttccccaagctggtaaaggactaagtaagagaatatgactcgttaacacaataagtaaaatgatacttccagtacaagtgaactaaaacactccaacagataagctataatgtagaccactgacctttgagttgttataaatccaactcagatatgaaaaagaaggcaggctagaggttctatcacttagagggtttctttctagcttctagggtgccaaaaacatgaagagtgattatggagatactctgattcatgatcccccacatattcagttatagtgtagaatgaaatcctaagaaaccttataaagatggctttccaaggtggctctgctgaccctagtgatgagggcacaggtgagcctcaccgggtgtgataatgggagagctgtccccaccagctgcagcagttgggagagctggccctgcaccttgactgggcaacacagtagaactggtttgtggtggcatgtgtggggtgcaggtgaggtggccctgaagtcatgaaagcaggagagccagtcttgttctttgtcagctgcagcattggtgagctggctaaggcagtactggggagcttgtcctggtggtgtgatggtggggtcaggagagcttccaggctgaccaactcagctaccatccaggcctatattcagaggtttgagttggcccaccctaacatctacctcatgtatgagctgctggagcacatgaaagagccaatcctgcagatccaaagctgtagaagcaccatgatccggggcaaccaaggatgtctgagaggagtcccagtgaggattcagtactgaagatgcagcagaagccagaggcctcaagccaagcccatagctggctgcagcgaacacgtacaaggaaagatgtgcagacaaaagggtgtactgtgcgcacaccgggccacactgcaccttccatgacagtatttcggtttagtttttttattatttcttgttattttcttttggaggggaggttgcaagggtggaagggttggggcgatgagtgggattggagcaggtgatgtgacattcacaaagaaccaatacaaagcaaaaggaaaaaagttatctcccaaagacagaacattttacatttaaatttaaaatctgttttcttgaaattcatgtgagttttgtcttttactctggtaatacttatatttgctttaatatgaaaatgtctccagttgatgtcagcgaaccaaacggaagttttcagtggctatctgaacttattgcaaagctttgctttcacccttaccctgtgtcacatagatgagacaaatggttttctatctttcatagtccaacttcacatacaaataatacaggcataaacaaacaaaaattaagccaagatcattttgtaaaagtgtgattttaaaaatatttaacacctaatgtgggtggttattagttagtcaaaatacttcattgattcttaatgctggggagagacagagagaggcagattcctggtgccttcctgcagccaatcaggccaatagatgagctacagtcccagagagagacccatctcgaaaaataaggtggagagtgctacagaaagatactcaacctcaggcttctgcgtgtatgtgtgtgtgcattcgtgtgtgtgtgtgtgtgtgtgtgtgtgtgtgtgtgtgtgtgtctgacacgggcctatatgaatatcagatattgtcatgtgtggccattttaaagataaccttaaagtaggtggttagagttcttagaatgttcttactatggagcagcttgtaaaaggtgcccatgcaactgtcagtggtattgtcaggttactctttgcttactctactacagtcaacaaaattttaatattcaatgacagtgacttattctatttcactcccatttgctctccaattttgaaaattttatcaatttattttcttttgaattgagacttgacaggaagcaagaaaatcttactatcttaccaacacctccttaggagccaggtaattactctcatgagaaggtgtctcctagtttcccatttgcttcttggctgtgacagtcctatttgccaaatcaccatcccgagctttctgaaagttaatgccattatatgaccaggaattattcctttcttctgtctggatgcagctatgtattagttattatggtgtataacatgaaaatttaataacacagcagttcttttgctttataattctctggatgccccgtctgcaagccctcataaagttgtaatgaaggtattagccagagaggcccctgatctcaacactcagtgctgagggaaacccagcaccacctttaccggctgagctgcaaacaccagctagctcctcatttcacagcactgttttcccaaagaactttatttcctacaaaacagtgagtcagagaataaaatttcctgaatggaagccagttttaagaaacgatctctagtggagcctgttcctcgaactgggccaccttgtctggcctcaatggtagaggatacgcctagtcctgcagttacttcatgtgtggggtgggggtgagggttgtgggtgatacctagaaagggggctccccttttcaagggataatgggagtgaggaatggggagagggtctgtatgagggaggagatagggactgatattgggatgtacagtgaataaataagtttaataataatctttagtgtgatgttacttctatacacacacaagaggaggaaaagaagaccactgtaaagtatctattgcaagtcattcgttagatgaccatttaaggctttaccataaacccacatgttttacagcctaataaaaccaattcaaggcattcatagagaaacagatgaaacaggcgtattttctgtggaaaattggtcctttcttccacatgaaaatgagagaaagcttggatcctatctgtttttgctagcctgcattgtgccttcttaggtctaacatgggaggagctgacaatgacacccgggttccacaggaggacagcatcatgtcttcagactcaacccaaaagtaattctcttcttatcttcactaccttaagagaataggatcatagatgtcatttgaatttcctttaaggcattaagagttttgttccagaaggcagaggcacttaagcactcatagttgcccaaggccatctaagtcagtggttctctgctcctttaggcccacaggaccctttcaaaggggtcacctatgaccatcaaaaatccagatatttacattttgattcataacagcagcagagttatagtcatgaagcagtgacaaaataatgttatggttggggtcaccacaacatgaggaactgtgttaaaggcattaggaaggttgagaaccactgtcctaaacaaaatgaaatctgaagacccgaaagctattggattggtctccatgcagaacgcacactggaatcaccgccaggacttttcttcctcttgaaacagtgaggcacaggctttaccctaggtcagctctgtcagtgaatacagattggggagtgtcatttttatattccccagaactctctactgctcttgttgcaatgagaactaacaagacaagtagaaaaaaccaaagcaagcacctttctagcctagtcctggctcattatctcctttttaacacagtgacaagtcttactcctcaccaacccaactttccaccatgttcctattgacagttagcactagaaggaacacaaacttgagaaagagctatcatcattcttacaatgagattattatggaatataaggtgaataaaagcccattctccaaaagaacatgcattagatatgataaaatccctcttttcacatttgtgattggtttccacatcacacagactacaatcttaaattgcatggaggccagcagggcagcagtggaacaaaggtaactggttgaaaaccttgctgctggttaagcaggacaagacaacaggcagaacgacaggcagaacataagcatatgttcagtttgctgagcaggaactgtcaagttcattaaaaataccaaaaatgggttaggtcttttgggactcctgaacctgaatggctgtatctttgccaagattagggatgtctagggttattgttttacatatattttatactttccctcttctgagaccccaagactcagatatttgtttgtgtaatggtgcccacatgtctcgggctttgggtttttgtgttctttgtctttcctcttttttcttctactttctctttttttttcatctgattggaatattcacaaaaactgtctttaagtgcagattttttttttctgctttagactgctgttgagtctctcagctgtgtttgtatttggcttgttcagttcttcagttccaagggttctatctggttcttctccatgctaaatctggagagctctcgttctaactcatggcatttttttctgttatttttctctccgtagttgctcatgttttattgactttccttagaatcaatcctctgaacatcttatcaggcgcctcatcggatttaaggttagttgccagaaaattactatgctctatctgttgataacatgtctgggaaagttctttctaggcatgtcaccataactatataaatactcttacctttccctgtctcatgtctgtcacttatccctggttttaaaaagtacatttccaaacaagcacagcagctattgagtgaggggacagtctaccctctgagtaagtgctgccagccacagtgtgaaagcatgcagcactcctgctccagtgcctcagagacagcatcattagggaaagcaagcatttaacgctgtttgcttgatggcgctctctgcctcaaagaacgtctgtctcttaggcccagaactccatgttgataggctttcacaagatcatctcatactgcccagcttttcccccctcctcagttatcttctgtatcactgtgttgctaggcaacaattattcttacaattttacttcaaattttgttggccagtaatgttcattgttaagtgttgatgtgctttataaagtatgtactgtatgtatgcatcactgagttcactattaatttgtccagtgttgatgatgcttcccaatgatggaaagaggaaagtgttggcttcatgataagggaagtccaatcagctatatccataactctaaaaataatagtataaaaaagtatattgatgcaggagagatgcttggcagttaaaaataattgctgctcttgtagaggacctgggtttggttacaagcacccacattggacagttcacaactttatgagactagttcctggggatttgatgtcttcttcaaggcctctgaaggcatggtggttcatgattttaattccagcacccagcaaaggcaaaagcaggcagacctctgagttgaagaacagtatgttctatgtagctaggtcctgtctcaaaaatactttaaacattttaaatttgggggggattggagagatgggctggtggttaagaacactggctgctctcctagaggttttattctgctctggggctcacaactgtccgtaactccagttctaggggtctctgagggcaccaagcatacatgtggtgcttagacatacatgcaggaaagaacattaattcacataaaataaaaataagctataaaatgttacatttttcttttacagagatgtatttatcataatctaatattgtgaattaattttctgcatgtttatgtattgtttacattgatatagatggtccttatgatctgagagtaattgtcgacagtattttaaatatttttatgtttacattatttaaaaaacttgaatcatgtttaaaaatattatatatataatgttttgataaaatccataattctattctctctattcagtttacccaccaaaatgttcccattccaacattacatgttttctgtcccctctttaaataacctctgagagcatctagtgctgcctgtaactgcatgggtgcatgggtctcagatcatctgagagcatggacagtctctccagggccaccccactgaagaaacctgacactgccttccccaggagccctcagttgccaatattctcttctacagctccttactcttcctgctgggattttggctagcttgatcttgtgcaagtcttgggcacaaagtcctagtcactgtgagttcatgaatgagataccgtttcatgccagacatctctctctttggatcttgggatctttcctcccaatcttccatgatgatgctgagctttgagaggatacatgatacagatgtctcatttagagctgagcttgccagctattgctctcagcatgctgactggttgtgggtcactgtattcatcactgtctattacaaaaagaatctgccagatgggaagcacagctagctctggcctatcttcttccagttagacagatatttgttaagcatcaagacagggcattaagtgagggagggggttgccatcccacagtcaaaactctgacccatattttttcctgtctgaaagaactccagggatggaaatggagaggagcctgaggaaaacaaggtctagtgacatgcccaaagtgggatccagctcaaggggaggccccaaggcctgacactattactgaggatatggagggctcacaaaaaaagggactaatcaggatgtactctgaaatacccaacaagtagctaaaagagtcagatgtagatatttgtacccaaccaatgattaactcctgtagttgaattagggaaaagctggaagaagctgaggaggagggcgaccctgtaggaggaccagcagtctcaattaacctggacccctgagatctctcaaacactggaccaccaaccaggcagcatacaccaactgatatgaggcccccaacacatatacagcagaggactgctaggtctggattcagtcagagaagatgcacctaaccctcaagagactggaggccccagggagtttagaggtctggtggggtggatggtgagtggtgggtggtgggtgatggggacatccttgtggatacagggtggcaggaaggaggtatgggagggtggagccgcaggggaataaaatctggagtgtaaataaataaataaaagattaaat

SEQ ID NO: 120 - DNA, 585 bp, Mus musculus
atgcgcaaatggatactgacacggatcctgccaactctgctctacaggtcatgcttccacctcgtctgtctagtgggcactatatctctagcttgcaatgacatgagtccggagcaaacggctacgagtgtgaactgttccagccccgagcgacacaccagaagttatgactacatggaaggaggggatataagggtgagaagactgttctgtcgcacccagtggtacctgaggattgacaaacgaggcaaagtgaaagggacccaggagatgaagaacagctacaacatcatggaaatcaggaccgtggcagttggaattgtggcaatcaaaggggtggaaagtgaatactatcttgccatgaacaaggaagggaaactctatgcaaagaaagaatgcaatgaggattgcaacttcaaagaactgattctggaaaaccattataacacctatgcatcagctaaatggacacacagcggaggggaaatgttcgttgccttaaatcaaaaggggattcctgtcaaagggaagaaaacgaagaaagaacaaaaaacagcccattttcttcctatggcaataacctaa

SEQ ID NO: 121 - protein, 190 aa, Mus musculus
MRKWILTRILPTLLYRSCFHLVCLVGTISLACNDMSPEQTATSVNCSSPERHTRSYDYMEGGDIRVRRLFCRTQWYLRIDKRGKVKGTQEMKNSYNIMEIRTVAVGIVAIKGVESEYYLAMNKEGKLYAKKECNEDCNFKELINHYNTYASAKWTHSGGEMFVNQKGIPVKGKKTKKEQKTAHFLPMAIT

SEQ ID NO: 122 - DNA, 85341 bp, Homo sapiens
tactgttctcatggtagtgaataagtcttacgagatctgatggttttgtaaggggtttcagcttttgcttctctctcattctctctctttacctgctaccatctgtgtaagacctgacatgctcctccttgtcttccaccatgattgtgaggcctccccaaccatgtggaactgtgggtcgattaaacgtctttcttttgtaaattgcccagtctcgggtatgactttatcagcagcataagaacagactaataacagtctccaacatacatctaactactcctttccatctcccttaccataattagtctaagatataatctctgacctgtatttcaattatggcctcctaaccagtctccttatttcaacttttgccatctcccaaacattctccaaaaagttttcagaatgattatacccattatacttgctaattacaatctattatacttaggatcaaatccaaagtctttaatgttagtatcaacgccttatgtacattggtctcgtgttgcccaactttccctttgttcagtatactccagttatactatcttttggtttctagaacacaacaagctcattttcacctcagaacttttgctcttgttacctttatctagaatgctctacctccacttctgatttcttctcatgtatcagatctgagcttaaatagcaattctacagaaagacattttgtaatgagatttgaaacatccttctcctttctgtgttaaatgataccatagtaacctatttatttcctcctgaaatagccatcagagttatttttaatatctattatccaccccctcctccaataatttaagctctaagtcagggaccttgcttatcttattgaacagtatgtcataatgcacactattcgaatacagagtaagtgttgatttaaagtaattagctgagttatcagttaactaggaccaaggactttattgcatcattaaaaactcaatatgtaaaatttcaaaggaaatatctgataattggttacacaactcttgggttcctcatgcagactgaatatataagagaaagagatggggagatagggagagaaggtagagagggagagaatttgtaagggggatttcttctctgttagtccacttctctaccaagaggtgaagtgtgtggggggagggaggggggaaatctccctacaccccaaaccaagtgagagagcctagtgtttgggggatgttgaggatcatagagggcattggaaacagtagtctgcatattggaaaaagaaaagtagagttttatttaggaaaaatggggatgttactgatgactttggggcagagaaataacatggttgcaattatattttagaaagattaatctcataacaacatttaaaatggattggagattggggagagaagatacaaagaggtggattaggaatagaattaatgtgaactataacaataacttgatctaggatgtgaaagtgataattgataggaagaaacaggtgtagaagaagttgtggtagaattgacattttttggaattaattagaggaataaggaggactcactatgtttgaattaatattaaaaactatcgagggaaaaatataagttgtagctgaggatagaaataacgtttagcttgaagaggagcttaagcagaagtataaacctcctttctcatgcataagttattgcgatagccaccagttttacacaaatacaaatttttactgaatacttggcttttcatggatgtagctctataattaaggtggtggactccctaactttctttttcttctttactatcataattacttttactctgcctctttttctcacttttgaacatgctttgaaagctaatgaattgaaaattaagccagttttgctactaacacattgatatccaggaaacatttttaaaagaaaaattgctattgctagttttacccctcattttgctgccttgctacatagacaattcatgtagaaccaaataatgacaatttagagctaacaatgtaataacctcaattgcacaaggtctttgtgtttgtcatgatgtccttctagggatgaagcaaaattctctctgtgagaacatttttcaacatttagaatggcatgaagctgtcaaaactaggtaccaatgtaaagcacttactcaaggaaattgattgtttcctaaagttaagcagtaacttaaggggaatcaagacaatcaagaatgaattacataatatgctttcattatatagaaatgtacaagtggaaaaaaaaacccaaactagtagctccaactagagattttgctctaggtctaaagttgtatcacaattcagtaaattcataatataattttaagaactttaaatttagattagcatttcagataacttcttacaaatataaaattaaagcataaatttttatagactcagagatacaagagtcaagtaacttttgtaaactgagatatttatatatttgagtcaccagcacaccacaattttgaacatatgactcatactttgtatcttatatacagttagttttaaaatgttagggcattatgccaagggtaagcacaagtttacataattgaggatttatagggacctcaggcttgctcaattacttttgggattttatgccagagtttaaactactgtctttgaccaggcccatcaagtttgggttgacgtgtccatactacagcctccttttatattaatacttagaataaactcaatctcctattaccatgacctacaaagttcattatgatctggtccctgcctacctcttcaggttcattcacctctcactactttttccatttttcattcatattagccttcattcagttcttggaacacaccaagatccaccccaccccccaccccccaccaatctacttgtttatgtttgttctctcactggaatgcatgctctgttagggcagaggtcacttccagaatattcaccattgtatctccaaaaggccagaacaacatctggcaccgagtatctatttgataaatatttgttagatggatgaatcaaggaaataagtaagattggttatatggcatgacccagggttcaagctgatttatggaatggggtggacagaagaaaagaggaagataaattcatagtgtaaggacatctctgagaatgtagtagaaatatgtcttggacaaagatgccctctctcaccacttctattcagcatcgtatttgaagtccgagtcagaactctcaggcaagagaaagaaataaaaggcatccaaataggaagagaagaagtcaaactaccctgtttgcagatgacatgattttctatgtagaaaatcgcatagtctctgtccaaaagctctttgaattgataaataactttagcaaagtttcaggacacaacatcaatgtacaaaaatcactagcattcttatacaccaacagtcaagctgaaagccaaatcaggaacacaatcccatccacaattgccacacacacatagacacacacacacacacacacacacaaacacacaaatacctaggaatacagctaaccagggaggtgaaagatctccaaaatgaaaattataaaacattgctcaaagaaatcagagatgacacaaatgcatggaaaaagattccatgttcatggataggaagaatcaagatcattaaaatggccacactgcctaaagcaatttatacattcaatgctattcctatcaaactaccaatgacattcttcacagaactaaagaaaactagtttaaaattcatatggaaccataaaagagcctgaagatccaaggcaatcctaggccaaaagaacatagctggttgggtgcagttgctcacacctgcaatcccagcatgttgggaagcccaggtaggcagactgcttgaggccaggagtttgagaccagcctgggcaacaaggaaaaatcctgtctttgcaaaaaatacaaaaaaatagcctggtatggtgatgcatgcctgtagtcccagctactcaggaggcgggaggatcacctgagcccagaaacttgaggctgcagtaagccatgattatgccactgcgcttcagtctgggtgactctcttaaaaaaataatgacaaagctggaggcatcatgctacccgacttcaaactatactataaggctacagtactaaaacagtatggtactggtacagaaagagacacatagaccaatggaacagaatgagcccagaaataaggctgcacacccacaactatctgatcgttgacaaatctcacaaaaacaagcaatgaagaaataactccctattcaataaacggtgctgggataactggctagtcatatgaagcagactgaagctggaccccttccttgcaccacgtacaaaaataaactaaagatggattaaagacttaaatgtaaaacttaaaactataaaaaccctggaagataacctagtaaataccattctggacataggaactagcaaagatttcatgacaaacatgccaaaagcaattgcaacaaaagcaaaaattgacaaatgggatctaattaagctaaagagctcctgcacagcaaaggaaattatcaacaaagtaaacagacaacctacagaacaggagaaaatttttgcaaacaatgcatctgacaaagatttaacatccaacatctataaggagcttaaacaaatttataagcaaaaccaaacagccccattaaaaagtgggcaaaggacatgaacaattttgaaaagacatacatgtgtctaaaaaacatatgaaagaatgctcaatactgctaatcattagagaaatgcaaataaaaaacacagtgagatactatctcagatcagtcagaatggctattactaaaaagtcaaaaaataaacgctggcaagcttgcagagaaaagggaacacttacacactgctgataggagtgtaaattagttcaaccattatggaaagaagtgtggcaattcctcaaagaactaaagacacaattgccatttgacccagcaatcctattactgggtatgtacccaaaggaatataaatcattctaccataaagacacatgcatgtgtatgttcattgcagcactattcacaatagcaaagatatggaatcaatctaaatgccctcaatggtagactggataaagaaaatgtggtacatatagactatggaatactttgcagccatcatgtcctttgcaggaacgtggatggagctggaggccattatccttagcaaactaacacaggaacagcaaatcaaatatcatattctcccacttataaatagagctaagtagtgagaacaaatggacacaaacagagaacaacagatactggggtccacttgagggtggagggagggaagagaaaatataactatcaggtactatgcttagtgcttcggtgataatctgtacactgaacccttgtgacatgagtttacctgtataacaaatctgcacatgtacccctgaacctaaaagatcaaaaaaagaaaaaaaaagaaatatgtgttggaccacaatttcagatatgcaaagaataacatataaatttatatttataaatataaatcaacctagctttaattttgagaattctgctcttccagtttggtaaaaaacttaacttcagttattctagggtttccctcttctgtttcaagatgggatagatttcaagagttttatgtatggccaaagctaaggcatctgggtgttgagtcattcgtctaccctgattcctcttctggggtattcattcactctgttcacacagtttctacagttctgaactccctcctacttccagaattattttaaaatatgggaatgtttatgaggggtccttatggacctatttgttcagacacatgaggcagccctgattctctggagtattgctgcctctgctatgtgcggtggtgctgtgtacagataaatatacaagcatggctccccaaatatgggggccataaattttctctatgctcccaggtccatgggactctgtgatagcttccctgggctgcttctcaaatgcactctagtgcttcctttattttcagtgcgcttggcatgaccttttgaaagggattcatgttttaccctagtcaggaagcatttatgacttttttccctcaacctttcctttccaatatctttttgaaaatatgaagaacagaaaaaaatgggataaatgaacacagtttaatatttcataagcccattctgccaataggaattaagttttgaccagaacagaggcagagtaaaattctgatcatgtcactcttctgcttaccatattataatggcttcctattgctcctggaatacagatcatatgccttaataaaacacatggagatcctgcctgcctctccaacctcttcatgcaccacagtcccttctcattctctctactgggaccaaacctgtgtttcactgtgaaaaggacaggtttttttattattattttttttttattttttatttttgtatagtacctcttcacctggttaactcccattcatgctgtaaagttgcagctttagtggaattcttgcagggaaagcttacatattgccacttattatagatactcatggcactatgtatcttttctttgtagcacttgtccatgatggttaccttctctcataagaagagaaatgcaaaggataactacaatttaatggcattttcacttgtcagactaataaaactccaaatgttttcacaataaattttttgaaataaatgagtactcttacctactgctggtgggattataaaactagcacaacctctgtggaggataagttggcaatatcttttttttaataccttttgtcccaggcagtctacttctggaaattgatcctatagatttattttcgtagtataaaatgacatattttgtctttattcattacagcatttctttggtaatagaaaagtactgaagaaaattaaatgttcctcaataggaggctgctcaaatacactgtgatatacccattcggtggaataccctgtagctataacaaaaacaaaaatgtgagaagcttcctaaataatgagataggaagatttttctgttaaaaaaaaatacaaaaaaatgcatatgacgtgctaccttttgtataaaaagggtaaaagtaaaaaataatatgtatgtgtatatacatatacacacaaacatatgtatccagtttgcctgtacaagcatagcgaaactctgaaaagatacacaagaaactaataaaaagaattatctatgttttggggaagaatgaaaactgacaggatatggaacagaataagatgtaagaatgaaaagtaatgaaaatatttaattatgttcccttctactgattatattatacatgattatgaacgaggcaaagttttgtttttctttttcagatggagtctcgctttgtcacctaggctggagtgcagttgtgcgatctctgctcactgcaagctctgcttcccaggttcacaccattttcctgcctcagcctcccgagtagctgggactacaggcgcccgctaccatgcccggctaatttttttgtatttttagtagagacggggtttcactgtgttagccaggatggtctcgatctcctgactttgtgatccatccgcctcggcctcccaaagtgctgggattacaggcgtgagccaccatgctgggccagttaattctttgaagccagcaatggtgtgttaaaaaagaaaattcaatctacaaataacaaaaaaaagacaatagttcaaagtattcctgtgcttaatctatcactataggtctattaaaacaagagcaacaaacggttgccaatgtataacttaaaacatccagagggttaccccatctacagttgcctaaagttattcttagttcctggagaattcatttagaagcataagcataataagggcacagtgaaatctaagtttggttctccattatagctgtggtcctaatgaattgtgggcccatcctgaattaataattctccaataaaaatgataatcaaagaatttaaaccattgatacagttcccttgttgatattaatctgttcattaatattacttggatcatatttccaaattacagagtgtaatagcatctaatgcactttcatagatcacaattttattcttttgtttcccattttacagttaatcctatgtagcagatattaaggaggcactaagcactctttgctaacaaactatccatttctttcatttaagtatttagcacttagttagcaaatgtggacttctcacttactgatttcttggtttaaaaactgtaggttcagtatggaacaaatggatttagtagctcttgaatatctttacactgtaaacttactattgataacttttatttctttagaagcaatatctaagtcctaggaattctgagcctgctcattattgttacctcccaaactagcggagtgtgattcagaacacaataacattatattttctttcctccttctcttcctccttttagagaatacatgataggatgttttcagctttctagctttcaacagatgcaatgatcaaagagtctgtccccctctgctttaataaatgtggaacattcaacatttggcatatgaagagtaactgggtacatctgaactattctgtgctcttcattctgttccctaaagggacagatacaaagagaaatcacataaactataatccagttgagtagatttaatttccttttcctatttggtctacatgcaccacctggtggtaaagtagtgcatttcacatagagagagagagagagagagagagagtgtgtgtgtgtgtgtgtgcgcgcgcgcgcgcgtgcacgcgtgtgtgttttgaggagtatataacatgaaaaagataattttaatatactttcttaatactgatttagatagacaacacaattattctacaccaagaatctaatacaacacttgagcactacttcatgtataacagaacaggaagtaaaggagagaactcatgctggaaagtaaaatagctttcacttatttaccttagcaatacatattataattccatctctaaattaacatttattgttccaatattcttattgaggcaaaaatcaaacactgataatcaatgtgaaaccatttcctcctttttaaagaataacagcttttaaaagtaggtgccctgttccttatattagtagtgagtataagtcacagatcacagaattgtaaagcaccatagaggcattagaccaatacaccaattttacaaatgtagcagctgagactctggaacagcaggtaacttgcccgaagtcatactggtcattagtggtccaacacaaataagaatctagatcttctcactttcagcctaggaatataatacataaaaattgtacttatattcatattcaatgaattgtctctgtatgatgtgataatattcaacttatctacacagtgctttaaggcactcatatgttagttaacacataccagttttgttctaacattctgagcacaaagaagtaattgaagaaatgcatgtatcataaagctatggaaaagattttctaagtattaaaaaaccctatatatatgttcaaatgaataattttccaagtataatacaactgctatattgcaaagaaggtttaaaaaattccctttccccttctaactgcttcagaaccagagatctgtttctacaaagtaggtacccacttgtagatttaagcataaaacatgttcatagctccctctcatgaccattgaatactatacaagcctccttttattctcgctgttgtattcaactaacagctcactggctaagttttaattgcttccaatgaggtcagcaaaggtatttatcgaaaagccctgaataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaagtaagttactgttatttgtcttttaaaacaatgctgaatgttttctaaaagtttatctctttttctgattttagtactgagcaggaaagtaaagttacaagatttttgagccatgtaactatagtaattatgctgtagaacataaagataaggttgaagttctccagagcaatcctgacatttaacttaaaaaacctgggcagttcaggagaaaataattgattaaccacaaatgtaaaagcatataataaagaagtctagggagaaagcagttacactttgttagcagtaattgtaaaaacttaatttaaatcaatagttctgagtgcagtatggttctcacaaaatagcaattggaatgaatggtacagtcatattctgttttgtctctactcatgcataaattttataaatctacacataaagtggtaaagattttgacatcctctgtgaaggctgttttaaatgtatcttcaaagaataacctatactgtattctaatgctactacttacccactaaaatttacacatacaattttttatcttcctctctcctcccctccctattcttaatctctcattgcaaacagaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacagtaagtaattttaagtactgctcatgaaccttagcaatctgttaatggatcaattttcaggtgatatgttttctcatcttccttttgcttcttggaaaaaaaattaaataaaatgtcacctaatttctctaaattgaactatgttgaactatgcccctaaaaatatctcttttaacagggcaaatctacttacattatagttggacctgataatccaagccaatttgaaaatatatactccttgtcctgaaaatgctcataagttaagcaaaatgtaaataatattattcacaccaaaatgtgacttaatattgtctaagcaaaactcattaagatatctaatttagaacttcataaattatcactaaaagctatttatcactagtttaaagagtagggaaattatttttattaatttgattttctttgaaataatattttcatgatgtaaattaaaatacttaatctgtgctaagatatgcattcctttgcaattgtgtataatgataaaatagaagggaatctgtggtatccttattcatttgagtcataatgagcttgtattaagttgatgacttatcaacttaggcagaaaaacagatctctcctaacgttttccttaactaaatcttttatgtcataaaagttctgtgctatcttaagaaaaatgtaaaggtgaggggaaaaaagtgggctggaagagatggtaattccatgtttttcaatttaaagccttacatttttcccaagaatcagttattcttcttatgttaaaatatcagggttgtgttttgcatttaatggttatgatgaataaccaacttcaatagtattaaatgtaatggaataagatacacacctcaacatgtacattaaggatttaaaatacttagtaaaaataaattttgtttacattactagcactcagaaaacattgttattaatatataatttcatattaattgttttaaagtcatttgaaaaagaatgcatggggagactggtgtaaacatgtgcaaatcacagtgccaggcttgcagcaattactcaaacttttgttgcctgtttactgaatgacttttagggttctgaactaatcaaccaatcaatgggaatttcagagaattatgtttccaatatgaaaatgagaagaccttctttttaaccataattgatatagaatgttaaggccattttaatgactggacagttatggttttattattattatttattattattactgagattaataaaggtatcatgttagttctagaagatcattcttattatactaaagtttatctaaggaaatgactatttggagaaaatttttttgatatctacttctatataagcaacagaatttggcttataattaatttatttaaaagttgctcagatttatcatggataatatcatggatataataacaatattatatattatcatggataatatatatcaataataatatcatggataataaaacctggtggagacgacagagcctaggtaaaaattatgacacatggggcaactccctgtctacgaatgatctggggacaatttctttgtttttctgaccctcaatttttcatctataaaatgtgggataggtacagatgatttccatgatactttccagttcttatagtctattctattttaaaccacagaatatatttcataaatataaagaaacctaaatacccattgtataattatctcacacaacgaatgagatgaaagtaataggataagctgtcagaactaatttcaaattatagcaataaggttaccaaaccttaactgtggaattctacatgctgactactccttttgaatccttttaccaagtaatgaaaaagcaaaaaagtagatgtaaaatccagtgaaaatgaatagtatgcataattatttaggatcaacaatatcttcaactggaatacatttgcatatgtaaattttattttgtttgtgttaaaatttcttgaaacaatgaaactcaggtagtacacatgcataaaatgctaaaattattttatagtttgaaatacaatttagtgctaactttgagtaaccctaaagccaattttgtaaaccatctcctctaacaccaattctatagcacaaaagaaaaaaaaaggaagtcgccctatattgttataaattagaatgtcacaataccagtgtactaaaaagacaagatacacatcatgtaaataatttttacttctataaactttttaataggctgtatatatggtatactttcttgatatcgttaattatcctggaaagggaaactttcatcagaatcctttaagtaaaccctaaaactgtcgtaaggttatgtggctatcttattggagaaggagtcagtaagatttctccaaagttaaaaagaggataagccactcttttttttctataggaagtccttaggtacagagggaaatgctacaatgaagaatatatggagaataacatgttagaagaaaattctgatagccatttcctattatttgaagggtagccttactataataattttaagagtgaatgtccaattgtgctaattgacacatgtgaagttgaagctgctatattaggaaatctaggttcaaaaaatgctcagaatttgtttaaaataacaagaatggaaacttgaaattatgacatttgaagattgtttacattcctcaatcattaattgaatgaatggacaaataaatgaatgaaagaatgtttccttcctattttcattaaaatgagagaaaaaggtaattggattgtctactagaatgaaatgcagcaggattctgattaaagatcagaatcaaactcagaatttcattttcaatgttttgatgccttaaattttttcaacaggttgtcatgtcaatcacctttctttggaggtcttttaagttagtatagattttagtgtcttggaagataaaattttacatgaaaagtaatatgccagctatgcaaaatataattattcttctggttaccaaaagaaagtccccaatcttttctcatgacttttttttgaatgactgacctgagaatgtcaataggcttcagaggactactcacttcaccagcagaagcaatgcttccacacaggaatgtggttttttaagatactagtaaatatggattggagctagcaggagaagtaaaatatctagatgtataattctgcttccacaatgttttgggctcgggtagatggttggagggcatggagaaagaaaagggagtggtgggcaagtggatgtgactgctcatgtctcataactttagggaattttaaaaaattacttaagctatcctggattgtgaggttgtcacttactttagtcttaccttaattactgtgttgttttgtaaaatattttaagtttagattagaatgaatatattacagaaagagtgcatcaaggaacccaacggaaataagacttgtattagtagacatataaataagaactatgaagatgggggaattcatgagaggccaagagatactggaccacatttctgactcttgaggggacagaagctgctactagagaactggtcataaggattgtgtactactgttacccaggaggcagaaagtctctcccctttacttatctctctggtggcttcacatttagcctaacagtgggtttccaggtgatgaaactagtatctaaccttaactaataataagaatactaaaagcataaaatgtccctccaaagtacacattcaaaatgaagtaaatattcattttctctgcagaagaagaagagcattgagaacatcataaaagggtgaaatgaatggtcgatacttccacttttgttgtcagaactctccccatggggacaagatcagagggtgaatttagattactgctgcaccaggcagtccaacagcagacagaggctatcattctgcacctgacagaaataacactgctctttaagctgagtattgaggtgccgagtgagagaaagcagcagtgcactgggcactcagtgaccgccttgagagacagatgtggaagacagaatccaatccctcaggataattttcatgcttttggtatccaattactaaaaagttgtgctcttcccaataatagtcaatatcatctactccttttaagaatttcttgtcataaattgcctcacttgattataatgaagcactgttagttccatagcaagaaaagggttagccattctgaaaactggccaatgatttggcaatattctcttttggactgttagactgtgatgggatatggcctaacaattggcaaaaggcaaataaacacagcgttgctgaatttgactttggctacaaaaccttcagcgactcatttgtcaacaattctttggataggctcctacttaacaataatgtgttagaagctagcaaatacacatattgcctctgaatatggagatggtaaatttgcttatattctaaacagttcttagcaagttatctaaaagaacaataattcacattatcagaatcaaaaatagcaatgtaaggacaacccctgcctttaaaaaaatagataataagtaacatatctacgcagtcgaaccaaaatcctagcaattatagacaaggtagaatcttgtagaactggtgacccgcattcccttaagtaacttgttagggctttaaattatgaagaatggataaactgctggggagcagatttgaaaatattagccattctttgattagtttttaattttataatcttttctttttggctatcacatgtgcctggcacttatgaagtgctaataagttcattcattgccacgagtgcatctcttatcatctcttttctcttttgtaaatcctcatctagactgacccttatgactcagctgtacaataactctttaacctacagttctagagcattcagaggcccaagtgaattacagagaatggaagaagtcagctcttagatatattgaaagggttgcctttctacatttttctatctctcaaccttgtctaaatattacaatcagctggggaactttaaaaaaatactgatgccagtttccacccacaaaaaatttttcattaaattgatctgaggtacagtctgggcatcaggaattttaaaagcttccccagataattctgacatgctgccagggatgagaaccactggactaaggggatcacattagattactggggaattaagtcagaatctcacaaaggtgggaaggaccaggcattagtatttgttaaagttctccaatgattctaaagtgcagctaaggttgcaaaccactgcttatggagaacaagaattctaattcagcctggaccacctcaggggtcttgggaatgtttcagaccctgtagagggattcaaagttaacttgaaccctagaggattttgaaataggcttgattaggcataaatctctgaattatgcaccaagagggttcttctgggctcatctgacctctctgacaaatcttagtggctccaacatttggtgaactggcctggaaatgtacgtgatgatagctctgtagctactatgttaagaagactgctttggtgaatgagttagctgcagggaagaataggttctgtaccacagcctcacaatgacaggcaggtctgcatctcttctgacactttaaagtggtgttgcagtagggtacttgaagtacaggcctcaatgtctgcttattctgcacttaaatgagccaccttatgactatgaactcagatgctcccagattaggatctcacctctcatggccacacaaccaagttcaaaggcagaggtttaaggagacaacctctagcctaggaaacccagggggagagaaccacaattctagagggttggcttagtctgctttgtgttgatataagagaatactgcagattggataatttataaagaaaagaaatttattcttcacagttctggaggctgggaagtccaatatcaaggtaatggcatctagcaagggcctgcttgctgtgtcattccatggtggaaggtagaagggcaagaatgtatgagagtaagagagtatgagacagacagggctgaaatcattttttctaacaacccattctcttcataactcacttctgagaaaatgacattaatctattcaggaggttgaagccttcatggcctaatcacctctcaatggtcccatctcttaataccatcacaatggcaattaaatttcaacatgagttttggagaggacattcaaaccatagcaagggtctatccagatcagagaaaagacataaagctagaggactgttctctttttaagactggaatgatgcacaacattagggcaaagctttttttattttctaaggatcatagctttcttcctttgtatcacacaatttttggtagcacaataacttctctaacatcactattggaatacaatacttttccatttttaaattttatatatctcacaataaaattatgtatacttaagtaatatggagaaaaatgactcttgttcaatgaaatagactttaatataaactcctttactaaacaacatctaacatttttacccctcaaataggttgtaaatgaaaatcctctgccttccacatgatttggaaaattgtgttaaagagtccctgaatgtttaaccgcttttggaccaagttttttatctgcatttgagattatatctggacatatctttagtagagaagtcgtgtcaaattcactaacaaaaatgtcattaaagttccttaactatgtgtatgaaagggtttgtgtagtaatatgtaaagacaaagtgattaagatggggagtgagagaggagaattatccagtacccatgcccaagtaaaccttgtctttaggcaggcaacatcattctcagaggaaaaaaatttgatgtatactggggagaattggctctagagattctccagttgcttaacttccctccagaagaaagtaatctcttctactggagtggtcatgagtacttgatagagtcattagctagtgtccatctaaaaataaagaggaagaaaatatctttgtgaacaggaggaaaaagagcaaaagagaaaaggaaaaagactttacataaaaattattggattttaaatcttctgtaaacttaaaatgaagcaaagtttctcataaaatatagccccactaactttcttgatgcacttaaagaatgagacaatggaatgacaagatagtagaaggaagaaacaaaaccactaaaatgctgggggttggatttaactagaaattgaaataacaatttcagataataatacagaggggttgaaatgataataaattattacaggtattactcaaataggtttgaatctcttggttgattttgtgccgaaaactgtaataatctttgcttatttatcagaattattctgaaactgaatttatttttaagattaatgtaagagaaataagacatgtttcaatatcctcaaatatcacatttgttatattctattgtaatatttcccattttatctggctacttgaactttagatgtaactgtaagtaatgctaagaaaatagtttgagaccaaattcagaatgaactcagcttgcagaattttcttaaggtaatatttccaaactgtgtttctttataacactagtgccccctgagatattaaggctgtttcctgtagcacagcttctctaactaacctgctgagaaatattaggttaaataaaattgaacaattttctttcagcagaatttctctgagtctatactatactaatgagaatttttaaaactctaggaaaagagtatacatgatttcttaaacttatttgacaacataacactcctcctctccctcacctccattcttagtccctggtttgggtggaatatttaaattttattaaatttcaacttgagagctattgtctaaggatctatctttggtgttgtcaagaactaaacgaagttgccactaaattgtttgaatcaaataaaaaaactatacaattgacctgaaccaacattttaataatgaccaactaagcatgtatgccaaagtcagaagattatatatgatttcggactattagagtaatattttgtgcatgaatactggacagaaatccagggatttgcagtgggatttaagcctaatttaaaattctttctgagttctgagcagatttataggaccaccctcctgtaacaagaaatgatgcccaacagctattatttgggccaccgataaactaaccaaaaacatttcctatgctataacctaaaaatgctttaggatcctaatatgattgaaaaattcttactgtatatatctaaaacaataaatttttacttttcgaaaaagtagttggagcaaaatttgttgctatttcaattatttcaataaagaaatgtttcatttactggctaaaaattatttagaaatttaacataatctgatgaaaggactacaaatttaatgaattaatctccacattcttcaaagaaatcaattatttgagattttcaatacagagccagtaatggtcttattctctttctgtgccccaattgcttttctacctgtgtacagcacatctgccttgtcttatgattctttctgtttgcatttggcactgtcactagaatgtcagttctgagaaaataagtaccatatcttactttttattttttttaatcttccagtggtagaagcagcagcacttagcccagtgtaagaggtgaaagggtaaaagaggggagaaagattagtgatcactcaatatatttatcctttaatttattacacatttaaaattagatgtaaataagaaatagattactaaattatcatgaaaatttaaagtgggcaagaattaaaagccttgctgaaataaaagagaaatacacctcacttccctctcattctctatcactaaaaaaaaatggcctccagaaccaatttgatttaatgtctttctaggtgatttcaaggaactggtggaaaatttggtttattgtagaggccaactatataagcagacacagttaccactggtgacactggaaggttgattggcagggcatagtgaagaccaattctagaggagctgtggccctccatgacacccatttttgttcccacctgactgccagctaatccatgcatgccaaaaactataaacagaaaaaaacagtaattcatagttgatattggtttaaggaatatctgcattagagacaaaaagagaaaaagtctttaataattaaatgagctatactagaaaacaagcagtggactgataattttggggcaggggtctgcctactaatattgatcctggagttggtgatcagcactgaagggaggagagggcatatgcataggaagagagaactggggagaagtcaagaaagttggtgaatccactctcaattcgttttagtgccagtagcctgatcttcaggagtcttttggtatcttacggggtctctaactgtacttctgaccataggcctagtttatctggttcatattgaggcagctctcataggaaggtcacttgtaggtgttacatagtttcctcctttgtttgcatgaataatgaagatatgcaaaattttaaaggttaatgacttttttttttaattaattcaaccaagttatttatacctccttttgctagactaagaatgcaatagtaagcaaatatacagtccatgcttttacagaattaacagttgggagtcaagggagaactccaagtcagagtgagtaagtttagggcacatcgcaggttgtcaaacccaacacaaggagaagggcatggaaatcttttctgagaggaaatagcctgaaggatgaaaggacaaaagatagaggacagatgtattatcctcagaggaaatgctttttgtagatgtttggtagtaacagtactgcaagattgggaaatgaaaagtgatttaacatctttccaagtatcaatgctaaactcaccaaggtaaaggttttttttctattaaaaatataagaacatttactctttattaatttgcatgcttcgaatgattgctatgtttattaaaaacataactaccagcaacttaaattaaatctaaaaacatagactgtgaatttgttcactgtgtatgctcaatctggcaagggaaaacatcaataattaataaaaaactaattaataattaattaataaaaaagagaaccaatttctcaaagttcatacaatgtttttcctttaaagggaaattttaaaggcataattcaattggaataatatattttttctgaataactgcatatttttcacttttttatgataaacagtatgttgtgtgtattttacaacaataaaaatacattcatacaaaacagtaatgttcatttcgaacacatacaaaatggtatacattaaaattgttgtgtatgaagtgagaggggggtacatggggaaaaggcataagtgtgaaaaaaatgaatgaaatattttttactttttaatgccttttcaatctttgaccataagtgtaacttacctatgtcagctgttgacaaataatcactgtaaaatcgaagtaatctttatggagttttttccctaacagtttctaaaatgtgagaaaaataattttgagtcatatgtttggcatgtaaggacaaaattatgaaggttatctaccacattctttaagataagacatacttttactaccatgagcactggatcacctgtttcaactatgtaatcaagacactcagtagtcaagcagctgtgcatagttttatgccctctaattcatgaagtatgctactttcataaaactactgatatgtctttgtttttgcaaaattaggctcacctcccttcttgtataaataatgtgttataaaataatgttggatgtttaacaggcacacagaagtgctttcagctttgaaaagattctggccaaatttggtcttcaaattttctcttaactggctggaagatggccagatattgaataataatagataccccaaagaagatgagcataaatctatatcatagttgctatgttgtaatttaaaatttatgatgttttgaagtactatttagtagtttattagatattcaaattaatattaccactaaaatcactgcactgtatagaagtaaatctgttactgttgccataaatcttttaatttagtctgcaaaatcttacaatgtacaactgggaacatttttattgagtgaataaatgtaagtatataattaatgttaattctttaaaaatacatatgccaatattgaaattggtacagagtactttattccattctgattaattctcaaaatatctccatgctgtaagcttgcaattacacagttacttcatttcacggaagaaaaaaaagaccctcaggaaactggccagcttaataagtttgctggtatataaattctaactgttttaaaattatacatgggcctgttttacttcctatttagatgttgttcattttagtgaagaaagattggtgttcaaaattagccagtgtttcagatgatcctatcaaaaacctttgcatacaatgttgattgttttctgaaaatatttgagtagtcagttaacttacaaagattagatattgcatagtaggtctgatgagtccattgtgtgattaacatcattgtatattaaggagcaagaagttcatatatagaatcttgctttaaaccttccagctttccttttatcaacacaagctggttactaaaagactgtgtagaggaaaaatgagacattcttaagtaaattttttccctcaatgaaaacatgggccattagtattaagataacaaaaatgactactacaacaaaaattaaatgtgtgagtggtttctgtgtgcctggcactgtgttaaacactttatatacattatttaatttaatcttcacagggctcttattaggtgggcagacttatgctcatttgcagatgggggagatttggctcacagaattaagtaacttgctctaggttacatagctagtaactgtcaaagttgggatgtgaatgcaagtaggtttaactccaaagcacagctttagtatcatcacatgtatcactatactgtcactggtgttattaaaacatcgcatattactttgtatcaagcagtgggataatttgcatctgaagaaatacaaataactgaagttttcttctctgtaatatgacctaatgaatacttggcattatcttcagcttattaaataaaaacttactccaagtttccttgtacaaaatatatccatctgtcttcccctgagaaggcgtagcaaccttcagtttattttgcttacacattgctaagatgctacaaaatttaacttggttgtattttaaacacattcctgacatttattaaaactatttatacttctgttctttagggtctggaaaattgttatagaatgcataataataattatccagacactacatatattatatattaaattgtatatatacagtttaatttcagataatctcagataacttagtcatatttaggaatgcctaaagataatttccttccctaaagccactaaatccaaatacaaagcaacacaaaaacaaataaaagaaacagcagagagtttgttttaacaagcatgtctgaaggatggtgaaaaagaaacagtttactggcaaataggttctttcttttgtccatgtccttagtttatttttaatccttttaggactgcgctccacaaaaagtaagaggcaaaagaaagggaataaaaatgatgaattaatccaaagatagtatatctggaattctattttaaggatttttttggggtgtgattctgggtaaatcatatctctgtttctcaatatttttctgaaaaccagacatgcattatttgtgacctgattaactttaggttctttcagtgtcttaagaatatcttagaaggtttgtattctgaaagttgcagtggctctttccagcaattagaatactatttattgcaatatttactgagcatatattacgtattatgtactgtgtatgcacagatacacaatgcaagcacccaccattgaaaaaattcagcctatgtgtggataccaacaccaaagagtcaatttcagtagaatatagtaagtactgtgaaaaaggtatgttcagggagttagaggactctagtggaggccagctaacagaacctgggagagaaagggcaatactctcaaaaaacatattttaaccacatctcaaagagccagtgggagtgaatcaggctagagaagagggtaggaaatggggaagggagtcagaagaaagggtatctcttcctggaaaatagtacatgaagaaaaagctgagttgtgtgtcagtaggtttgtatgggaattagtgtttcaggagtaccaagttcaagataggaagtaggaagagataagactgcagggaagtctcatatcttggaaagttgttttagggaatatgaagctttacccataggctataaggagccattgaagaatagtagaagcactaactaatcaaaaacagtcatttacattattcacaaaaatgacctggatagttaatatcaattaataactcaaatattactttgttaaaaatttaacctttcttaccaaatcctcttaccagaactacccacaaagcaatgaaattaactcgtgacaatgaatatccattgctttgttccacccagtctttgatacagggatttataaatggaccagattgtcaattgcagaagagaaaagggagaaaagtaggctagaaaattcaccaaagagttatcagtcttagcttatcacaccaatagcattattttgtataaatattaatacacattatatatagcataggagtagattgagttgataagaaagtgagagggagcacgaggacaaggaaataatactgtatcatatattatggaacctgggtgttaatcctttttcttccaataattaactgaatgaccttgggcaaatagttgactatcctaggcctcagtttttgtttttgtatttgttttataaatataaattgaagagaggtaggccagatttcttgaatagattacagttgttaaatgttaccaatagtgctaagcaactgagagagagagtgggtggtaaggtgagagaaggaaagataagagagagggagaaaaaagagagagaaaaagagagagagagaaaattagttatctattgttgcataacaagttacctaaaatttaccagcttaaaacagtatttattatcttgcagtttcagagggtcaggaatttgggagtagcttagctgagtgggttggtcttagggactcttacgaggttgcaatcaaactgtcagctagggctgaagtcttcttatgtcttgactggggctgaaggatctatataaagcattctcacattgttgttggcaggcctctgtttctatcaggctgttggccggcaacttcctctttgctatgtgggcctctcgacaggcttcctgagtgtccttataacatggcaactggcctccttcagactgagcaatgagaggggtaggagagagagagagagagggagggagaaagagagagagaaagggaggcagagagagagagaatctttaagatggaaattgcagtgtgacgtaccatcatttctgccttattttattggtcacacagactaaccctagtaaaatagtaaaacgtggggggagggaactacccaagggtgtgaatagtgaatactaagtgttagggatcattggggccaaaccacggactaactaccatgcatggtttttgcatctgaagaatttttagtcaagttgaaattctaagtacacataaaattaagttaaagcaacaatagaagagaaacagagcaataagtttgtggaataagcttgtttctgaacaagcctgagaagtagatagctttccttattggaactgctaatctgggttagggtctcctcaggaggaacgtggctctcttctcttactgcagacagagggaggaaaccttataccatgtgttaataccccacttcgtagcattgagaaagaaactggatgatttgcttgcttaaaatcacactaatggttgtatgaaacaaagacaactccactctggaattacaggtctggaaggaagccatgagatcatagagtccagagattttgacatgaagtttgcagatagccctcagggaaactggaaaggaaaaaatatgcacaaatattggggacaggattcaaagcgtttatcacattatcaaaagtatctgtgtttccaataaaagtttaagaagcactgatctagtctattatgcttattttatttgatgagggaactgagtcacgaaaagataacttttcaaaatgacatcacgaattagtggcagtggtggtttggactggaattgaagtcttctggtttttagttcagcatacttttagttaaacccactgtgtaaacaatatgcattattactgtggtttgtaacaccaaaagcttagctgatttccttctgtttatacactcttacaatttggatcatttccccttttgttctcccaccaaatgtcaaaaagttgatatatttcttataagtaaaagagtcatcatagaggggtagaatattgctccaaagtatttatagtgaaaagccaatgtttatatatataggaaaaagagatcagcaaattgattatagttggccatctataatataaaaccaaatacttaattgaaactgaaattgaaactacttaatgtcctatttacataaaattatctaaaatgaacatattgttgtacagtcatacagctaaaataaaattaaccaaattaatgcattaatatttattaaacagatgggagaataaaaacttctctttattgggtattaactatttgtcaggcacagtgcttggtgctttacatgatttctctcatctaattccattttataaatgaggaaaatgaggctcagtttgacagtcagagactggtttggttctagtaaacaacagagtcaggacctgaactcagggctctacagaaatgaaaagccaatgctctttccacccattgagttgttttgttatataacattctgaagttgattactgaggtattattaaacattctaatattttaacattttaagttttctatcaagatgatactggttataagttggtttagatggaaaaaactgtaacaagaaaactcaacctgcttactgcttagagattcattctttttggcttaatgttttatctttcaaagtgtaaattaccaccaaaacataacacttaaatacttatgaatagcttacaactttaaaatgaatgagtaaataagataatttcctgaatgtgggatttgattgggtagaacacagagaacatgagattaccttaaaaggagaagagaatacagaagtggaagagactgcagaaggaggtcagaggcctcaccaaacaatactgccaatgttgcctgggtgcccacaacttagattttcaaattaaacactcaattcatacttatttagcatcaatttaagtctgcagtgttataggctcattaggggatacaatgattagaaagcataacatatgtcttggattcagcccctaagaatccaattttagaaataaaactaatatcaacacaagatgaagtaaaataaaaataaaattagagagacattaaatgctaaatcatatggtattggccacagttccaacaggagctccagaggactgaagtagaccaggaaagtagaccaggaagcattacagacaaagtgggacacaaagattagttaggatttccatatatagagagaaaaggagagtgcatttcatgacatggtataattttcttctgattcaccacagcagtacttctcaggggctccacatcatttcatatgttcagcctctcaaataacaatgataatgattataatactattttattttattcataattcttattctttattacacattttcataattattattcttaatagcagtattgtgtaaagtttttaaagaaaatgtattatctcattgaattcctatcagtcacatgactaattgcatacagtgtttctcagtggtcagtaggaggagggagcaaccttctcattgtacttatgcatttatttttatcattttgtgtagtgctcaagtattataattatttgtatatgtctgtctggctagagctccttgagggcggggaacttttctttttcatctttttatcaaaagatccattatagtgtccagcacattaggaaataatgtgttcaagtaattgaattaagtaagaagcaataaaaacttcagtgaataaaggtattgtaaggcttctctcagctcatcattaagaaactctatcatttggctcttttttttcttttaccttattttctactgtttgctaatggaaagattctattctagccagccaatctattcactatttttcctagactataaacatccatactttttcactctgcatgacaatattgactagaatttttcttctcagtatctacccattcttcagggcccagattaagtctcaactctccacgaagctccccttggccatttcagtccacccctgcacactgctgagtaccttgtgagagtaaaatgtgagaactgtaaaacagtatacaaacataaggcattactgttatgattttctccttagattactgtattctcctagactttagaaccaggagttggaagtattataggtctttccatctattatattacctcttttccaattcccttgtcactctctcccctttccttatccctcactcccatctcagcattagaatagtgctttgcatagagtagttactcactaattacatgaatgcagtgtcttttattgttgcctgccattataaagctgcaggtaaaggaaatctactagcatggttatttaaacatttgacagaaaaagctcagttctaatttgttactatttacactagacacttcaaatacccaaccactggcttttcttctttttaattccgtttgtgcttccacacgacacctatatacctactaagtcactacaattcaccaaatatgtgctgctcacaccactaatgattaggttgattaggaaaaagagactggaagtgggagagtcaaaggctgttggaaatcatgtgaaggcagaaatagtttctatctcgaactctgctgtattgcatctcacaaaactagcacaattcctggcacatattaagtgtttgaaaatatgtagccaatgaatgtttgaatatatgggattagttataagtagggtgaccatatttggtggtctgctgaagctccttgtactggtccatgagagccaattgttaaattttcaaaaattttgttaacttattaaatacagccattattaaacatttaattacataaacttagaatgaaataaattacattaaaagaaaagtaataaatactcaaaactctttactactgaatttctttactattatatatgtttttgaggttatttctaatgtatttatatgatggaaatactagataatggtatgcgtctgtatatttcttcccaactctgttcagtgatgttttgttggtggcttggacccaactatgataagagcacctacaccacataaattggccaatgctacaaatcagggcttgattcactattttgttgatggtctacatttaagcgaatgatacaaaaatgttaataatgtagattaaacttaaggtttagtgtctataactgtttcattgtgaatagaacaaaaatgagaaaatagttttctagtatctctaaaaactatgatctaattcagcaaagaagtcactcatatcattgagaagtgagtgaagttccaatatacatcttcattcatttaccttcttcttacttattaacataaatgaaaacatcaacaaatattattgtcagaactatagttgttcctctattacaaccatggtttggcttcagagaaaaacagaaatagtgaaagcattttgtgagtattatattttattatttatatgcttgtgtgctatgcttcctttatatcagtagaatttgtaatgaactatgtgtgcatatatatgtacactttttttccctgagagtcagttgttaaacatttacatcatgcttctacatataatctatcatccaaactggaacacttttgagagtaaaagattgtgctgtaaataaacacatcagaatagcaggtgtaaactaacattgtgctgggcaaacaaggatgcaaggtcacctttcttataaggatcttacggcagtgttggaagcaatgctggggtaggcagtggcattgctgggatagcagaaaactcatcaatgagaaccatatgtactatttaatttttcattatagtatccattctccctcataaggatttatgattgctctcaagacaatgaaaaaacggagaatggaaggccacaatccagctatttagcccagtgtttcttctttttaacattttaacatttcagtaaaacatgctactatgaaaagatttgaaaatgcacggaaccaaagttggtttaaacagtaacagattatgttttatagtatgaaaaagtaaaaaagaatatagatgatcacatatttgcctttaaaaacttttttaggataaaaagtaagtagacaaagaaataacattgaaattatctgcttcaaaacatcaatagattgtagtacgtgggtctaattacattcagttaaaacgctatgtgtgtgagagaacataaggtttatctcaagctgaaataacttggtatctaatgaagcctaatgaagcagatctaagttgaatcaggaaccttcttagcctaatattctgctgctgactgcagaccaaggaccctttgtgcatatgttccggggtctgtctcaaaggctagaaataaattgcaaatatctccagctttttaaatactctgcatgaatctatcattcaagaatcaatttaagccatcttgaatcaatgtttttgtgatatactttgagctaaaaaaataaatttacaacctaatgcataaagtttagcctctctttttttgtttttatcacatctcagaatactggtaattagaagctttgtgtgtaaacttaaataaaatactttagaacaaatattcatgtattcatattcattctgattcatattcatatattcatatatgaattcatattcatttggttaaagtcctaattattatatagatttcagacatatcctcaataatccttttctttccagactaaaatttcataatttaaaatggttggtgttttttcaacttttattttagattcagggagtacatgtgtaggtttgttacttgggtatattgtgtgatgctaaagtttggggtatgtatgatcccattacccaggtactgagcatagtacccaatagttaagttttcaacccttgcctacatctctacctcctgctagtagttcccagtttgtattgttgccatttttaagtccatgagtattcaatgtttagctcttacttataagtgaaaacatgcagtatttggttttctgttcctgtggcaaacttatttttatcatgctaaattttcctctctagacatttttcccacttgaaatgtaagttttctattgttttttctttagaacatttttatctaaaacaaacggaccttttgcttaagctgttttatattttgttaattttctcctagtttggttcagataaatgtctagatcacggacatactaattaccctgctctgatcactatacactgtatatatgaaaacatcactgtgtacaccataaatatgtacaattattatgtcaattgaaagaaaaaaataaaatatagaaaagtatatgatccatcaagttcagatgataatagctgtccagtttttaaaaactgcaggtatctgtttaaagtcctgctcatgttagccaagaaataatagtaaaagagtgtatttgaaactctcttatcaccagattccaattatcagataatttcaaactaaaatttagtatgatcatttgaaattagatagaaagtttactagacaaacatatctatactatcattaataacttcttgttaaaaatgcccaagtatcagacttccccatctacattataattttatataaattcatgaattttttccttactggaatagacatatttacaatgttagttttcttgtacattaaaactatggtgtatttctaaataacaatgttttattaaataattcactaccttttaagtaaagatgaagtaattagtgtattataattgggagtaggctgacaacaattttcattgaggaaggcttcactcactgataaatatgggaacacttttttctttttaagttaagagccactcatcttagaaaatcttaactgaatgttacatggaatcaaagggcaattagatctagttcattaagatttaaattagtgcagttcaattcagtactcatagagcaccttcgatgtacaggtgacattgtgtaataatggatacaaagataaacaatgtgacttttacccttaatgtactgccataggaaataatttggtaagttacgatagttgctagtaagtttcatatgaacaaaggagtgataaggagactgaaagagaatatttctgggtgcacctaaggaggtaaagaactgggaaaggaaaatttcctggtaaaggtgcatttgcttgaaggaaggattggttggaggatttcatagagggtaaagagcttttttaaagaagagaacaaaatgtgaaaaaaaggtgcagatgcattaggacaacagtgaggaatggggatctctgtcctgtctagctggagaatatgatgcaaagaaagtggtaacacagacctagtgaacagataaaatgcttcaaaacatattttaacttcatattataaaaagagaagatagcacaaaacaaggataaatgggagagacagaattaaaggaaggatgttaggaagtaaatggagaaagatacaagcagggggagaagtgaggaaggagtgctcactaaagagaaggaaaagcaatacacagatatatcaagaaatcaggagagataaaaggcagagaaatactccagaagttctgaagtttctagagattttgacaggtataaccagaacactcactggaatttgggggtgcgggaactcatcctgaataaatggactgtgattctactaacattaccctaaacactgaataaaatcatgttaaaggtcaaatatgcaagcctgtggtttcctacactgatataaggctttcaaaaagtattccttgtaataataatttaggtggacaaagtgttattatataatccaccaggcccattgtaaataatcttgcactatattgttatttcttttgatacttgtaagagcttgagaatattaactaagaaactctgtaacatggctggcaaaatactctcttatcactttgaactttacttagaggtaaatacattttgagcttctgtgaggttaagaagaagtaagcaaagatcacagagctagttagtgatagagtcagatttggaacatatgtttctagatacccagatgtgcattacaagagtcaaatatggcagctagtatagaaatcatgctagaataagagattctcaatcttaatgtgatttaattactaagtcttggtagcatatgcgttgatgtattgtttgtcaggtttaaaatacatgttcaccatcagtggtgtatttgcttggggtgaattttctggtaaatttatgcaaattgatagatttcaaagctatctccttcattactgaagaagatgatttgggtaaaacatgcaatcaattcatggataattgttaatacttgagaaaatttttatgtggaatgactttgtcctcattactgcttgctccaaactaattcaactaactggtcaccaacatgatggagaaaacatgaaaacataaaatccaagattcacagaacgagaatgaattgaataaacaataggtttgacttttgtttttcatgccaattaatataaggtagaggtagaatcctcaggctcgtgtcctttaaagatctagcttttacttctgcaaccagagaagaacttcatcattcaaaagctgctccagatatcttttgatttgagagtttgaaattattttaatgtccgagagcatatacagatttataatcagtaaataacaaacttatcagaacttcaaaagacagaaatatgaagcaacatattatgctcctatttacataacatatttgagggccagatgaatgagggttatctcaggatatctatcataaattactagaactttcttttcaaccttctccctaacatttcactattgttgtccccccaactcttctgttttttctacatctccttccaaatttgtcttctttcctgttaccttttctccctcttttcttttccttattcttttttctcttcccttctctcctttctttccatttaactcttttaattccttttctccatttctttgctttaactaaccacaatatagaactgatgtgtatattaattgttcattaaagtgactgggtaaattccttgtgcttaaatttaaaaagcaattttaaaagagtatatttattgttttaaaaaactcctaacataagttaatcaaaattcacagaaaaatgattaaaaataaatatactagattacaatagttatatttctggttattctcttcactttttttcagtgatttccaaatattctttgatgagcatatactattttttgatgaacatccacatatgtacatatatatatatataataaactatgttgcttttaatacatgtggctgtcaatttcctctcagtcacactctgataagataaggaaggctcccccaaatacccagtagtctaagcaacccaagacagataactggcaaaacttttcttgaagctctccaagaatgaaccctctacaattttctttagcagtcgattccaatattatattaccctaacaactggatactttctcatatctagggaaattactcctgcttcagtttaagcccctttcctcatgctcttttttttgcatatgaataatatggatatgccactaaaaaaaacactttcataggagaaataacattcttttctgtctgcactcatccccttgataagtaatttttggctatttcaaatgctggtctggcttacagataggaattcaaacagagacttgaatgataccttcagtctgtagagaactgctcactctagcactatctcagactgcattactaagtctaagtttttcttgttacctaatttccacctgcataggctcatattgggctcctagtatttattgctagttatttttatatggaataaagcaatcatgaaatcaatctaaaataagaccacaaatcagtaaatgttttttacttctatacctacaaattgtcctctataggacagtgattttagtatataaagacagttatatttctatttaatcttatcttctctaggctaagcaatgtaaattcactcaaccattacacttaaacatgatttctcagattttcaccacccaccagtcctctaagaataccacctaaaataggatacccagaatgcaatgctccaaattgcacagggtggggccagaatcagcaagattactgcctccttggcaaccttatacttctattaaggcagccaaggttgccttcccattaatatagtttaaggcaaatatgccatactgtcggctcatcttaagcttgtccaggtccctttcagatgaattgctgccaagttaggtctctttcgcttctatacttgtgcaattgctttttgtatttacagtgccttgcttttctctttcttaaattttgttagcttcatcccaatatcatagtcaattataaataaagatacatgtaaacgagatcagatatccataaagattacttaactttagagatactgtcatcctgtgaattctaatgttaaaatttctgagttggaaaacaggtttttagaaatgtatggagggaacactccacagacatatgcaaagaaaatgtcatgctcaatcacaaactagactgtgatgcgccattcatacaaatgtggttgcatgagcccgtaaggaatggatcagcaatgcatgtgccaaagttgtataaatccataagactgagaagaaacaaattaaaacggagttgtggaataaacatgccttcttacagggaaattcactataaagaaatttgcaataatggaattagaatggcagaagagtgaatttagtttctatatcaagactcaagtgacagaagaataacaattgaacaactgatgaagtgtgttcatttccctcctcatcatcttttagcagtttcctgtcaatacaagataactctttcttccaaatcttggaatttttattgtgttcctgactgtctagagttcatttctctggcctatgtcactgattatgttgctaaagatattttttttcccttatactgacccttcaaaaccatcctgaatgccattttttaagcccctcctcttagccagctacaccattagagagccattttataaactgacattattaatggttaatagctcaatgtgtaaactttctcagaaatatttactctttagttatgtgcccctgaaaatatgatgcttaatgtagagcaactagtttccagtggtacaattcaagggctgcagccagcaagagtctggataagaaagacatttcagagaacaaaaacttccttatgcctcttgattcccacatcacaggttttcaattacattcttgatctttaaatccagtttaacaaaactaataacactgcgtttgttatgatagttcatttaaaaataaacctcatctgttttactgtaaaatctgttacaggcaattggatagcttaggttttttgtctgaagctgcccagttattcttttccacatgtgggctgaacctatttgggaaaaaaactaaactagagatatagttagtatagctacagctaatcaactcctttgaatgctccttcccccaaaaatatatttccctggtcagtgccatctgtatgtgtgtgagtggggaaatatatgtctaaaaactggtttttttttaaatgacagtttaattcaatcaaaattttaagtcagatataatcccatgacctagaaaaagtatatcaaaaaccaatttcctttagggtttatatgtatttgtttccaaaatattaactaagaatatggatacttacatataaaataaataatacggtcatttaaaattttaaccaattagagcttgccaatttctacagaaagtgtgacaactacatatattgcatatcatagaggctaaggttttgtgagagaagaaattataaaaactaaaaaagttttattaggcacaaaattagtatcataatgataaagtattttttcttctgtaaagtgttgaatagtatatatttttaagcaacattcaaaattacagagaagtctatgcattgctgacagacatatatgtatatatgtttgcttaaatctatatgtatatatagattataacatcaacaatgagattaaattctgaaatctcaactttactaaaattttagtatttatatttttttctaaatcttcttagaattcctcttcaattcacctttaaatgtactgactacacattcattgaccttgataatttcagtaaacatgaagtgaaacacagcacaagccaaactgaactctaatttttatgtacgtctcaaatcatgaaacatgtcttctaaatttgaagcctttattggggattaatactcctaaattttatttagaatcacttgttaagtaagttttaaaagtaatacttatatagcaatcaagagcggtcaagtaaatcttttacctaggaggaaaaaactaagacccactttgtaatctcttaggaattattttacatgcggttcttccagtaagtccaggatccaggatgctctcagaatttgagagactgtgtttaataactagtgaaaaaatgctatttgagaaactttctctcaatatgatatcttatatcactacttgacatagattcaaaatttgattcaataccaaccagattttttttttttgagatagagtcttgctctgttgcccaggctggagtgcaatggcatggtcttggctcactgcagcctctgccttctaggttcaagcaattctcctgcctcagcttcctgagtatctggcactacaggtgcatgctaccatgcccagctaatttttgtatttttagtacaaatattactggactggggtttcactgtgttggccaggatggtctcgaactcctgacctcaagttatctgcctgccttggcttcccactgttctgggattacaggtgtgagccactgcacccggccccaaccagaattttaaatgccagttaccttactatttcatatttgtgaaaattaaaatgaacccttgttaacatctatttctatacttgctatgggaaaaaatgtttggtaaacaaattaataagtaaaaagctgccagagaaactggatgttattttctggttcttcataaaaagatctatgcagattttttaatgcagttacaagttattattgtttatttaacttaagcaactaaagaaagctcttttggatgcagtctttaggaaatataatgaagataccttagtttgggttcaaatctgagatttgagagaaatcctattatttctgggcaaatgagtcagtctctctgaatcttggtttctttattgggtgactgagatagtatctaatctatgtgcttacaagattattaaaataatgaatactgtatatgtgaatcacagcacagggtgcaggataatataagcactcagcaaacgttagctgttatatgccttgcttactatggtataaacaaaaagatgataaaactaaatttctttgaatattttacatatttcaaagtcaggaatttatcactttaaatttttatcactttaaaaggttttccttccatagggcccaaattcacaaaattactctagttaaaaattgtactgctaatataataatcacttttctcctttctcttaccactgtggaaatgtaatttttataaataatcttaggtaatcatcctaaaatattgcattgaggtcaacaaaaagtggtagtagcatgtttggttcccattttatattctctgtaataacaactgtatttttctttttttaaaatttgaatatgttctgtttaatctaatacgtcatttcaacacataatcagtataaaaatatatacatattttcattattattattttttattttaagatgggatttcaccatgttacccaggctggtctcaaatgcctgagctcaagccatttgctcacctccgcctcccaaagtgttgagattacaggcatgcgccaccgtgcctggcccagtataaaaatattaatgagatattttacattctttctttttgtacaggtccttcaaaatccaatgcatgtttttcctttacaacacaccttaattccaactattcacattgcaagggttcagtagccacatgtggcacatggctcttatgcaggacagttcagtgtagaccatgtaaccgtcagggaccatgtgttactctgctcatgacaaccatatttttctgctcatacattccgaggtaattgtatctagactcatgacttcaattatgacccacgtgctgtttaatctgaaatctgaaatttcatgtctcttccttttcttgagctcttgttacatgtatctaatggtcactagatagctctcctgatgacctccaggaaattcaatttcagcacgttcccaattgaattcaggatcttccccctcaatcctgctcttaccttatacattttacataagagttctgatattactcagttgaccaaagtggaagccttgcattcctccatctcttctagctcccatttttaatcaccaagtcctactattctatcacttgaaatgtgatagaacattttaatattctcttaaactgaatcctcaaatctcctaggaagtttatatggctggggaggcagtgtggtgtaatagaaaagatgtgtcagacaggcgtaggtttgaaactctgctttacctctaattaatgtacaacatagatggggcatacttttataaaagaaatacagagtgaatgatttattgaaggttatatagttagcattttatcatcagaaatacagactaaataaattgcactggaatccctgaaatataccatggatttccagaagtttcatagggggcagggcacttgttaggtctctcttgtgcattttcttctcttttccccctttccagtttaattccagaaacacatcatttataaagtaaaggaaaaaacactaatatcatcctaggtaaaaatcctggtaataataagagccaatatttattgagtgcctgctctgtttatagaaaatatttacctatcagcatatcctcaagtaaattcagttctgctgtggaactccctactaatgagaaaacattggttccacttaacttatctgtactttaagactagaagaggtctccaagatctagatattccccataattatactctttatttattttattttttatattatttttttgagacgaagtctcgctctgtcacacaggctggagtgcagtggagcgatctcagctcactgcaacctctgcctcccgaattcaagcgattctcctgcctcagcctctcaagtagctgggattataggcgcgtgccaccatgccccactaaatttttgtatttttagtagacacagggtttcactgtgttagccaggatggtctcgatctcctgacctcgtgatccgctcgcctcggcctcccaaagtgctgggattacaggtgtgagccactggacccagccataatatattcttaaagcactctctgcaggccttcagtctcaccatgttccattagccaattccagggattttagtgaggtgggatggaaaacaggtaccttgcccctaaacagcagtatgatttaaagtgtagttgggggatcacctgtattaggatcacctactttacttgttttaaagcatattctctaggcctcaaccctcacctattgagtcaaaatctctgctgttaattggcgtctcaggtgatttgtatgcatgcaatgtgacaggcacctcaagtctggtgatattcctgttcacctgtgtgtcaggcattctgctaggtggtgaatacacagtgttaacaaagcggccatggtatccctaatgtatagcgcttatatttgttatgaattcatctagcatgaaaatcaaggtcaatctgtatttatacacagctttcattttaagaatatctacttcatgatgaatactgtgtgcagaaaaatgcataaaaccccagcatttttcaaacaaattgtatgttttcttaagtaataaaattgtagtaaggcaatgttaaaaataatgggcatgataccatacgggtgctcaattgcactactctgaaaaagataagacaaatactctttactgaatttctgggtaggtccatcgtcagttataaaaaagtttttggatttagataaaagtctttaaagaaatatttttaacaatttttaatctaatgtcctatatttctaaacagacatatttttaaatggcagcacttaaataagtgattttggtgttttaaacatcaaatgtatgctattttcttgcttaaagtggagaaaacaaaacgtgctccactttgggtatggtcaatagaagaaatttttcagtttgtctcaagtagcttatcttatcactattgggtattattgaaccatggcttttttcttttttttctttttgtacccagaaatatgctcctcttaatttttcactctagagctccaaatgtgttggaaattactacagaatgggaactatgttgtttaggggagtatcagaaacactctagaagagctttctattgacataaataagaactagctcaacatgctgttacatgctttaatgtgaccgcatattggtgccacttctgccattcactaacttataagacattctaaaatgttaaaagtaagtctagactctgtattataattttgttaaacacatttgattgagatttttttcagtttttttccagatatgctatatttcagaattaattctttagaatttcattttttaccctatttccctctgagacttgaattattaccccagttcccaaaatgtgtttgatgatcataatagaatgctttgtgaaagaagtacaaagtgcagagttctatttagaagttgaaagaaataatggaaagggaaagcagctggacagtgtcttatatgacaagtcatttctgccaattaaaatttcttgacagggttaaggaaggttaatgtaaaatgtaatgctatgtgggtaacatacttgaagtaaaatttctcaaccattatatttccatttattcaataaattcagcatttctactatatgcaagcattcaactggatatatataaaaataagactattcaagaattactttttttcctttgcctttctcttctcaaggaataaatgtttgagaaggagagataactaacatagtaactacaaaataaggcaggataagtgttctttctaaaaagagtcagagatactttattttgtgaatttctgaaaagaaaaaaggggaaaggatcagggaaggaacttgagtctcactttgaaagatgaacagggtattgacaggtgatgggaagtcacaaataaacaaaagatacagagttgtgagaatcagtggcagtccaactttgttgatgaaaaataagaccagaaaaagacaggcaactgtttttactgtgttaagtgcattacaattcaatccaatttaatttttaaaaagataccttcatattatagagaagggaacttagaattgaaaaagttagtcactttgctcaaaatcacagagctagtgagtggatgaatctagatttaaagccatgtctcaaagccagtatcatttttactactacaccaccatgcctgtcaaaataggaagactccataatttacagcaagacgtttgggtttcatttcatgaacagtagagaactactaaaacttttaacagtgttttttctttgggaaagcaggaagcagtttattggattcattggaatcaggagaaagtaggcaaagagagaagagttcgtttaatactataatattccaaatgcggtaacaacggtgttagtaatagaaatggaaaaaaatcaaatcagcgtgtaaactaccctgtaggtggaatccatagaaagtggtaattagatatgggttatgagagataacttttttaaaaagcattcaaatttcaaagctgaatggtttggaaaattatgatgccattaactaaaacaggaaaatcaagaggactgaacttttcagtaaaatataaatacttgagtcactttttcttaaaaatctataacattttataagtaactacattatcaaattccttagagaacagaaacttttctacttccatttctcaagaggaaagaaaacttgagtacagacttgaaaaatgagtctataaaatgagtatgatcttagagcagaatctttgaagtggtcccaggtcccagtgacaatagatttccaatgtctattacttcagtatttagaaaatagatgacaagttttgaggctttatttagtatatttaaaattaaaagaattgattaatacattatattagagaataggaatttttatagtcatcagttaaatggtatacttttggaaagcgttcataatgatataaaaaacaattaaatgaatctaatcatttttgtgctaattttagcacaagttaaacatttaattaatgttagaaaaattaagcctttactgatgttatttatctttcgttaggcatcactttcttgattgataatattttttccccaaaagcacaatattcactttatagcaagattgttgttggggagatcaaatgacataaaacatgtaaaaattctctgaaaacttagtgaaaggtgctgaggtagggcttcagcttgataagatggacaagtgaaggtatttataatcactaacataaattattgatatgagtaggatcttagagcaggaattttgaagtggtcctcaggtaccaatgacaatagattttgaatgtatatttattcatttatactgaattaatatactctggagaaaaagaacccccccacgtgccaaatagtacatttaaatagtcataatccacaaataagctattacttggctttgagtcatctttaaaggtcacttaaactcataaacatgcacgtccagcatagttaacttgtgtttctaattaattctcatttaaaggttttggttttatttggattatttttcatccaagattttcctgttccctctttaccaatttaagattcaacacacttttgcattttaagataatactcactagaagaaactctttaagaacaggatgactaaaaattgctttttaccattgccaagctcttgtctttatagaaatcagagggaactttatgttcccatattttctgactttcatacaaatgggaatctaatacttcagaaaacaaaactcaaaatcaacttcataataatgtttcctaaaagcaataggattagttacagttgtggatatttctgaagttcctaaaatcctgtcttttagaaatttattctataaattcaatttataaacaaaaaataagtcttgcagatgaattcaaagtatttcccccctgcaccagtattttgtctattttttctagactgaccaacatctactactctatttagtaattattttttacgagactagttgataaaaatgaccactgcttataaaaatattgatctgctatccagaacaataaagcaattcgtttgattgtccttcatttctattaaaaaacacacaaaatctactgtcatataactaatactcaactaatatatcttccttctctagtgatataaatacaaacattactgaatatcttctgagtttcccagaaagtttcaaaatgctttgaatctttgtccaggagaaagagtgtgcgtgtatgtttctcacaccacattgtaattgatgtgcagatgtcagctgtcctggccagaggaggagagatttgtacatttgactactttcaaacatggaggagtaggctcccaataggttctctgcattaggtgctttctaggggagcagcacaccatgtgatgcctacaacaaattcaaaaactctcttagaatcagaacacctgtaattagtatgtttattccatgaattttctgaacctcctagtccatgtgttgtacatttttgcagtgctgttttctttcttttcttttttttgagatataagagtgaaaagagattttttaaatgaacctgcatttcagcattgtgttaagtgcttttcttttcccatcctctatctttatcttaattattttaaagtcctcttgttttatctcttcaatattttgcaaatattgcttttatgtaaatttatagagtttgaggaataattaaaactagtatttctatagttctctacactattattttatgctttcaaaaatgactgtacacattttcaggggccaaaaccaggctatagttcatgacataagctgtgcttgagacttgtagctggtggtgtgctggagatggctcatcccggctcctgtgtgcatctctttccaactccacattcatctcttcccaataccatgttggtatcttgacatgggcataaaactggccatggtggaggtatttacacaatgtaaatgggcaaatgccacacattagagacatttcttttcttctggagagtctgttcttaaatatttttatccacccacacactgtctgtagacgaaatttccacagctatcactttcttcccttgacaccacacctcaccactgcctagtttgtctctaccaacaacaaactttatgtttttgttagcactgtgacaacctgtgcaaggaatgtcaagccagagcatcaggtatcatggaagaggcaagccccaagagaggaagaaaagtgatactatttttcctagtacctgccaaagttacttctgaagccttaaaaaaaaagtccaaaaaactcagtgcccctagaagtaggtaagctgcacaattacttacatagtacataagtactgatccacccacagataacaatatgttgagacaaacatatagccatgcttatggaaggtgaagtttgattttagtggaatgacatataatttacttaagtgttttagttgtgtagtgggtgtccatatatgatctctgattccactgcaaagtctgaatgcatgtgctcaaattagctcaaattctaaatctgtggtaccaggattccttttgaaggactatgtttttactacttatattttgacatttcttcacagttcaggcgatcattaccaaatattcgaggtgggagtactggccaatcccaaaaatgttctagcaacagccaagtcagaaaacaaatattttaacccacacacattgtattcattatagtctgaaaaaaataggactcttgataccagtcatgtatataataattaaacaatctaaaacccctctggcacttataaaaactgtgcagcttctttgttttggcaatatgattttctgtccttagcagagacatattagagggcaaagctttgtgtgtgaggcagatatcaaagaagaacattgtttgtttgattatgttttgttttgtctttttcagaatgcatttggtttgtttttaatttttctttcttaaaggaatactgtccaagccaaattccactatgtcaaagctcagtgttgatagctggcatccatgtagaccataaagaatgagtgatattcatcttgtggggccagccttcccctgaaaatactacccttcatcccacctctgccatttttcttagtctatttccttctagtatgtttctccctgacttaaatatctcttccatcctgatgaacttcttcttcctatctgttgaagtcctcctcgactagactagtgacagatcttttctcttccttactactttgccacttagagtcttccttgtcatttgggctaattgcaggtctcattatctcaaaaggcaattagttcctcaaagatagagagctaacaatttattttttgtattccctgtaaaaatccatgcacaatgttagatactgagtaggtatacagtcaataactctgcttcattttatgcagatttgaaaaacattaaatacatattccttggccatcatccaaactataaaaagaggagtggcttatctgacatcatgtctatttttcaatgcagactttagctaatctgagaaactgcatatttcatgctctatacttctcctacttactgctagatgtcttgtctatctctttgaaagagccacgtacttctgtttaatttaggcatatgaagttaatccctgcaaatactggctagaataagttgtacactatgtattcagatagtgcaggtacaatatgtacattctcaaagcatcaaaaagaataagagcaatccttatttttttgaggaaaaatttttatactccattaaaacttaaagagataccatgtgaaattcaagttgaattttcttatgctaattatggtactgatttaatttcaaattaaacaactgcaagctctctatctacatatggttactagggtaacctcatttatctaatacacatagctttaagactgattattgcccaggggcagtggctctgtaatcctagcactttgggaggccgaagcaggcagattacttgaggtaaggagttcgagaccagcctggccaacatggcaaaatcccatctctactaaaaatacaaaaattagtcagaaattgcttgaacctggcaggtggcggttgcagtgagctgagatcgtgccactgtactccagcctgggtgacagagtgagactccatctcaaaaaaaaaattgtatttaaaggcagtatgagagcatggtgaaaggagaaatgtgtgaggatctgggatgacttaggaggatctgggatgaaaaaaagattgattattgcttttttgtactttaatcatatatgagtacactgaaagtggtctcattatttaaaatatcttgtagaaaataatttctaaacatgtattttgcaagataaatagtaagctcctaacatatatttactaaatttagaaattttcggatgatatttcttaatcacaatgctttttccccttgtactcactagagagctggccttagtccagaagtatttttagtccagtctcataattctcttttccagcatgggcaaatataatttctaacataatttgttaaaaagtctctactgattctattttaactttgtatctttcattcattgtgcatgatccactttcgttggcacagaactggaaagtatagagtagggaggtaagggtaggctacagtaactcttaccaagaagaggaaagctaactcactgttgctcacagattctatgactgctcttccttcctctttctctcattcaatttattttacttccaattaagttaaaatacaactttgaaagataagatatgatatatcagattatgaaagcagcttagactagtgaagactttggcatgtatagaaaggatgactgtattctgaaagattattgataaattataaacgatattacattcaaaataaataaatacattttattctctaggtcctaaggcactttatacattcaattttggcagaatggaactgtgtcatgataaatatagcattattggattctctaaatatcaacaatactttgaggtctttaaagagtttgtgtcttaaatcactcaaaatagattcaggatctatatgaaccatttatggaaatataacctgtttgaagaaacaagttcactctctcccaatcctgacgattcttgccctggagtaggcctccatcagctcctgcttagatcagtactacaatctcttcactggtcttgcctcttgccaatttatctcccacactgctgctagaagtatttttctaaacttttcagtggcttaccatcctctacagaataaaaattcaaattcggccaggcacagtggctcacacctgtaatcccagcactctgggaggctgaggtgggtggatcacctgaaatcaggggttcaagaccagcctggccaacatagtgaaaccccacttctactaaaaatacaaaaattacctgggtgtggtgatgggcgcctgtaatcccagctacttgggaggccgcaggagaatcactggaacccggaaggcagaggtttcagtgagctgagattgtgccactgcactccagcctaggcgacacagtgagattccgtctcaaaaaaaaaaaaaaaatatccaaactcaactagctgcataagttcttaatggtctagccctgcctatatttcttatttcttttcctggaagttcgctgtgtataagttgcaagcacaccaagttaacccccaaatgccacagtgttttatgcttctgtgcctttctcacacagttccttctgtctgattttctgtttcactactatgctgctacaaagtacttataatgtttatggaatagattctgaggaaaggcaaggcagcttctgtaaggggaaaattgtaagtatttgctaacgctcttataagcacagaaatatcgttttttagactacttcaaactgatttgatgtggctcaacaaacaaggtttttgtttgttttttgtttgtttgctttagagttactatttttatcctaggataaagctgatctttttcattggcggaggtgagacactttttaaaacctggctttgaataagttgtgatttttttttccatccccaaacacctgctgtatggacaataattctattagtttcattggctaactactgtgataagcctcatgaaggatgggttaggcaggggatggattttctaaacgagggtgtagggagggtaggtaatcagaatctccacagagtatgtgtagatttaaaaagcggtgattctgacactttatttcccgaaggatattttttgcccaacaatttctgcccccacctctagtctatcatgttgagaatcactggttcttaaaagagaaacagaaaaggaattagtttgaattaatattttaaataaaaatgtgttaacagtgagattcctctaaaatgatccaacttagttgacatttttataaatgatctaaaagtatgtacgtgtagtgaaaattctaagtttgtaggttgggctaacatctctaaattcatgaactaagctaatgatgataaaatgctggaagacagaacatttatatataggtaggcaaaaaactggcagatgacttttaatgtattgaattttgtaataaaatttaaattatacaagataaaagtcactgaataatgattttcttgcaaaaatgacaccaataaatcatttcagatgttcccataaaaatgttatcttaatgtgcagtggtcccaaatgaccaataaagtaatggacactatcaggaagaatgtaagacacaaaacagaacacatagtatctccgtgtaaacagtgtggtgcatctacatctggaagacagatgccattctccttgcttagcgttaataaaaactatacagtacaatggaagcatcctgcaattagaatgaataaatgaataacgtaagacatacatgacatacctaaaaaacattttggctatcatctagaataataaatgtttattaaggtgataataaacaccttaactagtttctaattaagaaactataatgttataaatgtctagttaagaaactataatggactgtattcaatgtatataaaatcataatatggataagaacagaggcttggataactcatgaaatattagaagtagaatgtccttcttaattttatttttattttattttttgagatggagtctcgcactgttgctcaggctagagtgcagtgacacgatctcaactcactgcaacctctgcctcctaggttaaagcgattctcctgcctcagcctcccaagtaggtgggattacaggcacctgccaccatgtctggcttttctttttctttttttttttttttggtagagatgggtttcaccatgttggccaggctgctcgaactcctgagctcaagtgatctgcccacctcggcctcccaaagtgctgggattacaggcgtgagccaccatgcccggcctacttcttaaagtgttaatgtgttaggagcaagatagataaatagatatgctatcttacagagtacatagaaaacatatgtaagttgttacccataatatgagtgttgcatgttgaaaatataaatagattcaagagagatttagccaaaaccaaaaaagagagacctataattgattgaaaaaccagagatatttggggttctctcaacttttttgagttggcatcataaaatacaatctgagataaagtattatttaaattaaccaaggaattttgtgcttatttaattaaactccaaaatgtaatgaaaattagaaggaaatttagcaaatacttttgttattcaatctaaccttagtttttcgacatttagtatgattagaaaacttgttaattctttaatcttggaataataacaatcatatgccaacttataatttgacacactacttaatatggtgtttttgtcatttattgagggtgtgtcaaatacaaatccctgtaccaagtactgggggttagctgaagcataagatagtctcttcaaatagtctacaacctagatttaaaaacaggcaaaatttataaataacaagagaacaatagaggtgggtgctaattaatagtacagcagtatgttcttaaagtaaaatagatgacaacagattaggaaactactaatcactatggagaaactggaatttcaatttgggtactcaggtaggtggaagctgttaaaatactaattatcaagcttcacctcagacctgttggatcagactttctgaggaacgggaactggaaacctgaaaatcttttagagttcatcttgtgattccatgcaatcagtccatgaggcaatatttgggaagtacttgagtagagcattctatgtaattccaggaactggtaggcagagcaggtagagactgacattttgcatgggagaggaagacaattagtaaatctgtttgaagtcaaaggatcttctaagttgtagaagaaaaatgggagaaaattatgtaggctggagtcagattttggagagctttggatagtaaataaaagaggtttttgtttgcttttgtttttaatagagtataccactgaaacttttgaagcagaagagtaacctttataacatatatcttatgaatacataaagggttaaagtcagaagggctggaggcaaaggtctagctaagaaactataataatagttgaggcacaagaaaatgaaggcctggactaatgtgatggcaatggaaacagaagagaacggctggatatacattggtaatatagagaggaaacataattgtttctggtaagagcttgggggtctttaaccctttttaaattttttaattatctttttaagtaaactcagatgtttttatttctgcctctttttcctttcactttcatttctgtgaaaaaatattaactactccacataagaattccttgtttagactgctagcaaagagcatatgctttaaaagtgctaagaaagccaatgaccaaaatgactttaaatcgtgctttaatttttccatgctgatgaccagcatgatttgaaaccaaaatgtttagaattatcttatgcctgggtagcagaacatttagacacaagttaaagagggagggaagaaagattacattatatatctactggatggtaagtttcacggagtatattagtatttaaaataaagggagaaagtggatgtgtagtttatcatctaagctgctgtctctgaattagataaagtgtagcataacatgctttgtgactcctagaggtagctatgaacaaaacgttaatgaaagtttctataacttctttttctgaccattttcccccttcaatttcactcttagtgcccttgtgatcactttcttctagccccatcaaattctgctctcagagaaggtatagtcacttatacacagtataaatttatgcataggtgttaactcctccctggtacatttgtattttgaaacttacctctcatcctatgtaatgaaaatctggtttcctgctgaagatattttagactttaggaaaatccagaaaatggaagagattttctagatggtgggaagagattgcttcaactatttccatttcatataaaaatctgatactttctcacatgttctgggactataatatccacacctattctgataattttggagccatttttaaaaaaacacagtgttgtatttagcagatgtaaatagtctacattgtcagacaaataattctttctgtataaaagtttagaatctttagtgattagagagtaaacaaagagtatttcctcctgtctgattcagggaatatatcttctctggcccaaaggagaaaggtgggtcccttgcattcctgagaggccataaatgataaggaaaacgatcagtaaattggtatagaaatataagtctgtgcaatacagttcaatgatgttcccatgacattcttcagtaatatgctactggataaatatcacactgtatattgcacaaccgaatagtttgcttcaaattctgatatagttctaacgctgctgaaacaagctgctgcaacttaaattctttcaaaagaaagtattgctataattgtaccacatgctgatgtactttctaaagattttctaatgttttattttcttaataaatccctgaatgaatgacataattatttttggttaaccagacatgtcatttaaatggtttttgacatcattataaaatatatatgggattaataagaagtatgtttgatttattccctaataatgaggatgatgtggaatcagttctcttgttgcaggacatttcagttatacttgataccagcaattatgcaatcatgtggaactattttgaatttcatgctgatttgaggggaattatactttctgggtttcagtaataatttatctacttgtgtttctttcttgcaggcttcaattagttttctaatttcttttagtgtattccaaggttctgacttaaatctgttatttaacagctacagggcatgctttcttagggtaaagtgatccaacgacaagattagtattatcaaccatatgtatcattgtgtttttttacaatagtggacttcagggttcatgggaaaagagaaaaacctggaagcaggttctgtatccagcctgctggaggtcactacctccacagagtcctttgtgttgccccttcaaagtgaaagtcaataaagaaatgtggagaaagtgaactcaattctttcctaactcaaacattgaatcattccctccaggcagcaaagccaacatgtgcacagcatatccagttaatggtcctatcccaatactagcactgacaaaagaggtttgtcttccgtgttaagcagtcactctgcttaactgatggaacaagtttatttcaacttcagtgctcataatttgggctttttctatttcactgtcacttttgaaaaagtcaattttgaataacatgcatacattactaaaggtcatttgcttatgtttcaggttgacaccttaaaaaaatacagctacatgttttatgtatatgtatatatcttacatgattttgacttggttcatgatggaggtaacttatacaagttgtttacaagaaaataaatgactcataaaacatctgtaaaataaatgtaagactgaatgaaataaatgtaaaatggtacttgagtcatttattttcttataagacatttgtctataacagttgatataaaattatattactctgttttcaaacatattttcttttagagaaacatttcttggttagagataattataccacttatcgaatactgtctatacagaaaactgctgtttattccagggatactcttaaaattaaattaaatttaattctatttctacttgaaggatatggagcattacaattatatttaattttaatacattatatgtgatttataagcactatctttacttcattctgaaatctcagaccaacaaatcacttggcttttcatggcacaatttttactccctttcttagagtcagaacaagaaaaatttatttctgtagtcaaggccaaaacagtggcttatgaattaaattattaggtgttgcttcaataaagtattgaattgaaataattcaataaagtatttacttaaattccttgattttactataaggcagacaaaaagtagccaaggaacttcatttgcaagaactaattagcagttgtcagagaatgaaataatcttcattatcaagacactggttacaactaagttatgcctttaaaagtgattgataatagcagtaatgagattgagaagctactggctgaaacatattgtcattatctttcaattttttacgactctaagaagtcataatgataagcaaactcaaaatgagaaatggtgataaagagaatggagaaaatgtaaatccacatcaaaccaaagaattctcaccttcacagtacaattaagagtttaatgattccatcttttcattagaggatggcattaaatagaaatggtagctatgctttaacatatttcttaattctctggtaaaatttaagccctgcatacaaccataatcaaaatgggacattctaatgttgctccatcttttgaagaccacggtattatgatcaaagcgtggaaaatgatggaattctaaaatgttactgtagattgtaaattaaagaggaagacagggatagaaaaaccacatgtgagaatactttaagtggcaccttataattctttaacactgggaacactgggaacactgagtacatattaaatatttttaaaattaaaacactatcattatcactatattttaaaaagtcagatatgaaattttttggtgctgagcaaatttcttttttattaccaataagcaattctgttgatcctacatatctagtacagctacaatttcactgtggatctagatcacaaagtgattttcttatgccaaatttaggacaagtatatacaaaaccactatcacttcaaacttaatatcttcataaaaactccaacacattatcactcccacctagtaaaaatagcatccccttaacttttatgataccttaattctcaaaatgacctgtgtttgaaatgatatttgacttctctaacttcttttgctttagcctcaacatccattgggcctggaagttgaaaaaatgggcatagcaagaggaatgtgtaaatgtgatagaaataatttggatcattgctgttaagtataaatgagtatttgtgatctatcatatttgctgaagtttgacattaaggtggtacattccagtattatgtatcactttctagaagatcaatgaagtagaaatgcagtgacaagggtgtcatctagaaagaatgaaaagaaatacatccaagaactcaaacagcttgctgggagaaattccaggatgtaaggacaccaagggaactactgcagcccacctggaacatatttgttgtgtttgttccacatcttgtgcctgagatggttaccaattcatgtataatataaactgtttttcttgagtagatgtgaaagtgaaaagtcttgttgatactcttttctatgctacagcttattagaaaagataagtacttttaaagggagtagaaaaactaattcagaaaggaagccaagaagaaaaattctaaagaggctagggaatccaaaccatcattaagaatatggcaaatgtgaggccggatacagtgactcgtgcctgtaatcccagcactttgggaggccgaggtgggtggatcacctgaggtcaggagttcgagactagcctggctaacatggcaaaacccctcctctactaaaaatacaaaaattagctggtgtggtggcacaacctgtaattacagctactcaggaggctgaaggaggagaattgcttgaacctgagaggcggaggttgtagtgcacctagatggcgccactgcactatagcctgagctacagagtgagactctatctcaaaataataataataataataataataataataataataataataataatatggcaaatgtaatgaatttatatacagaagaaagatgacagatatgtagagtactgaacatagttaagtaatcaatgacttgttttattcaaaaatggaaagttatgattttctaatcaagaatggcgaatctggtctttttgagagtgacaacagcatctcatgctttatgtaacaataatgagcatccagaaaagctagctgacattaggtaatttcttggctaggaagcagctgaacacaggtttgacagtttgctgagtggggagctgtggtcttcctgacacgtgtatcaagatctaaagggcagccagaaaagacgtatcaagctaactaaatgctgacacatgcaggaataaatgacagcaccggaagaaacttggaatccctcgtgacagtgaagttctggataagaaagtgaaagacatgacagcacaggtgttgttttcattttttcttctagttttatctcatgactttagaagtgaaaaaaaaaaaaagctgtgaaagtaaacacctggccattaacaacagtgttgaaaataagacttgtctttctggctgttagcttagaataactgaaaaaataggctcctggagttttatgtacattttatgaagaacgcatttgaagtaaagtgaaattggggtgcattagttaagattcagtttggcttaaaaaattgtttatttctccatgcaataaacatctggaggagtgacaactctgctccacaaaaacatctggaagtttccaagtccatttagctcaccgttccataatctctttgttctcataacccaaggtagaatccaaattccagcaggaaggtggaataaagtgattaaaagtgagcataaagggcttctgctgggtaccttttatggaagacttttggaagttgccataggacacttcagttaaatcgcatcagctaaaacttggtcacatggccacattaagctgcaaaaaagactgggaaatggaaagtttattttgtgcagtcagctaaaaattctattgctatggaaaaaggagagaataaaagttgggaacaattaaaagtctttgctcagaaagttggggagaaaaatgcgtacatatgattgaaggaatgaacatcacaatgaatgacattatactgtcataagcttgaagacttaaggggcaaagatatgacaagaagagaatagaaagcttattatgcctcataagaaaagggctagaatcaaaacgtgtaacttcaaatgggtagaaaaaaagcacagatgtaatgataaatagtagatggaaaagttacatgacattacagatgaagacatttcccaaatttgctaatgacaaataagagaaaggagtatctaattttttgggtaccatacattttaatatactcatgtatcagttatttgtgatttattccatgccaaattataaacagaattaaagtggctgaattaaaactcaccatttcttaagcaattgtatgtggaccactcatgtttccaaaggtacttgggggattaatttaactaaaggcatactgtaatcttttttcaactgaatattttttaaaaacatttttgtattttttcaatttagaaaagaatggtttgagtgcctccacaaacatatcaaatatgaatgccaggaatttagaaagatgagacagatttactcacagtttagttaactcatccttttgtcatttaatgaagtcatgatgatgttcactattatataaataagttcattcattgtcatatgctgctaaatttataaccttaacaaaccattggttaacaagagaaagtataaagaacattgagttaaatataagttattagaagcataaaataactccaaaattcgcttttattttttaaattgatgtatatttgacaatttacagttaacttttagataattttcttcagatcactacagtcctagtgccaagaatgggtctggcaataaacactcagtaaatacttgttaaataacttgtatgttacagaaaatattgtgacaatcatattggagttggtctcacgttttggaggggtataatgactctctaccccagcaatattttatttatggagcactatttacaaatagaagaataaaactatttctcttatttcaacatttggaaaccaaagaaattgtaaaaataagtgagctaatttttttaaagcatagaaagaattttaatgattagattccaaaactagattttgtcatctttgatgttataacatttatatttcaacatatatttatttaactcacttttaattctacacatgctgtatgaggtcattttaaaatgtattttttcaaaaatcatgaggtttttaaaaacataattaatgtaaagaaaatgaggaacattcatcatttgttgcaggggaacagttgacatttgcctttatatataatacatatttaaacaaactttataatataaccttgaaaaatatactaacctaaaacaaaatgtatttttgataggcgaactttttattatattcaaactctaaaataatgacaggatttaaaatatttttaaggagatggtgagattgtattactgtaaaatacatttatggtctatatcaaggaaaataatgaacactattctgtcttaggctatctatatcagcccagttcttgctgagatacttatttttagtaaataatgtagctggtaaagagtctggaattcataccgtatgagaaagggccaaagaaactaaggataatgggaagcatgatcaatgtcttcacctctttcaagggctgttatgtggaaatggtattgatttattctgcatagcttcagaggatatattcacgtataattggtaacacaatcagagctacttgtaaatgtaatgaaccacctgaaaactggtaacctacaataaattaatgagattatatagctgacagacaggtaaatcaatgggacaaaacagtcaataaaaggtaaaagagaggcatcagtaaaaaaaggaatagaatgtttaataaataatgttgaaaatactagatagctatttcaaggaataaaatatcagttttcggcaggagcccccaacccctgggctggggaccggtactggtccatggcctgttaggaactaggcggcagagcaggagatgagctgcgggtgagcaagcattccacctcctgtcagattagctgtggcattagaatctcataggagcgtgaaccctattgtgaactgcatatgccagggatctaggttgcgtgctccgtacgaaaatctcactaatgcctgacgatttgaagtggaacagtttcatcctgaacctccccccggctcccgtcccctgactgttggtttagagtatcatctcacaccataccccagaattaattccagatgaatttaagataatttgaatttatatttaaaattcaaactataaaagatagaataaactatatttcagacaatggtatggaaaacatacttttaagcatagatacaatataataaattatcacaaaagatctatagaattggttacacaaaaattgatcagtttgattaattttttcaccctgcactccggtagtgtatgattagtgaaacatgagaattaggaatagaacaaggagtgtgaagtgagccaaacagtgcataaaataaagtgttactgaaagaactcttggatttggcaattaggagtttattcatgagcttgaagagagaacgccaataaagagattagaagttaggatgcaaaagttaaattgaagaaaaatgagcagattctggctacgtgttcaagaaagttggtgctagtgaaaaggaaccagggtagtcctttgaaaagatttcagagttaagggcagggacattttattcatttgacctataggcacagagatgggagcctgtgaaaatttcaaaggcttgcaaatgtatttaaactttaatattaagatagtgacagtaaaatttgaaaataaaatatacagattagcagatatttaacaaataaaatattatgctaactttattatttattaaatttattaattttttcataacatctaaaaacaatttgatattttttttactttgtaacaattcccaagaatgtacacaatttgcagaaaatttacagctggggcgggcacggtggcttatacttgtaatcccaaccctttgggaggctgaggcaggtgaatcacctgaggtcaggagtttgagaccagcctggccaacatggcaaaaccgggtctctactaaaattacaaaaattaggcggtcgtggtggcgcatgcctgtaattgcagctacaagggaggctgaggaacaagaattgcttgatcctgggaggttcaagacccttgacaatttggccctaactctttttccaccctctcactattttgttacacttcctattccagacatacagctctagtttcaatcttctgaacatgacttttgaatctttgcttccatggccttgcacatagtacttttatctctcaattagcatgtttccatcttttctacctatgtcaactctattcatccatcaagatctaattcaagctctatctattcctcaaatcctccgttgaccacttgaccacttctttcttctgaattcctatttattttgctgttttgtttttttgtttttggtttttttttttttgcatttggcatatactgccaggtatcacttattttattttttctgtggaaaaagaaaatactaactgaatttttgtatatatttattaatatccagataggatatcataattaaagtaatcagatcaagtttctaaaatattactggctcttgttttccattcccaaacacctgagagatactgtacacttaacaagtgaaacagtggtctgtatatccagtatttgtatcctacaatttccaaagtgtgtttttattatgaccttactcctctttactgtccatatttcacaaaaagaagttatccattgggtaagaagatcttaatccattaccaaagacatttttaatagtaattaataaatcacatatgttctatatattttggacataaataaataatgtaaaatgtcggtacaaatagtttctctacactcaatgatattatattattaaagtcagctgcatttaaaaattagtagactttgtattttagaacacttttagatttacaaaaaaaattgagcagataggccaggcgtggtggctcacgcctgtaatcccagcactttgggaggctgaggtgggcagatcacaaggtcaggagattgagaccatcctggctaacacggtgaaacctcgtctctactaaaaatacaaaaaaattagccgggcgtggtggcgggtgcctgtagtcccagctactcgggaggctgaggcagggaaatggtgcaaacctgggaggcggagcttgcagtgagcggagatcccgccactgcactccagcctgggcgacaaagcgagactctgtctcgaaaaaaaaaaaaaaattgagcagataatagagttcccataaacaatctccatttccccccacagttcctccattataaatatcttgcactaatgtggcacatttattacaacagatgagccaatatttatttatgccatcagtttatactaaggtccacgttttgctttgtatagttctatgagttctgacaaatgtatatcatgtatccactattacagtattacgcagaatagtttcactgatttaaaaatcccctgtgattcagcttttcatcctttttctgctctcctcaaggcccttgccaccactgatactactgtctctaaagttttgcctttgccagaatgtcatatggctggaatcatacagtatgtggctttttcagactggtttctttcacttagcaatatgtacttaaggttccccttgtctttttgtggcttcacagctcaatacctttttattgctaaataatattccagtgtatacgtgtaccatagtttgtttatccatttacctattggatatgtgggttgcgtctggtttttgatgatacgaataaagcttctataaatagtcatgttcaggtttttgtgtggacatagttttcaattcaattgggcaaaaacctgggggcatgactgctggattatatagtaagagtatgtttagtttttaagaaactgccaaactgtcttcccatgtgactgcaccattttgcattcccactagtaatgaaagagttttggttgctttgcatccttgccagcatacagcactgttagttttttggagtttagtcacgctaatagttgtacagaggtatctcattgttgttttaatttgcaattcctttttaaataatttcaacttttattttagattcagggggtacatgtgcaggtctgttacctgggtatattgtgtgatactgaggtttgaggtatgattgctcccatcacccaggtactgagcgtagtacctaatggtttttcaacccttccctcatctactccccgccagtagtccccagtgtcagttgttgccatctttatgtccctaagtacccagtgtttagctcccacttataagggaaaacatgcagtatttagttttctgttcatgtgttaatttgcttaggataatggcctccggctgcatccatgttgcaattctttaatgatctatgatattgagcatcttttcatatgcttatttgccctttgtgtatctttagtgaggtgtccagattttgcccactttttaactaggttttttttttcttattgttgtgttttcagtgttttttgtatatgttggatatattgatatattttttgcatatatgtatatgtcggtgtattttagtgatgtaaaatgaatggaatctatagccttaaacataataaaaatatataatagttaagatttcccactcaacaatccaggcttgacagaaaatcataaaatgtatttaaatttaaatgtttttttctttgttgatactagttcttagttttaacatgccaaagagggtatatttgatcaaggacaagattaaatgttctgattggctaaccatcaaaccactgcctccactttttttccaacttgaaaataatatttagttatcatgctagcacagccatattaatatataccccttcaaaactttaaatataaagctttaaatgtttcaggaaaaagaaatattaatgatgctgagattggtgggcatggattctgtgtagtgagacactaaaaagtaatttttcaaataggaaagttaaagcactttaaaatcacaaagctattggtaattaaaaaaagaattagtatcaatttctgaaatacaagattagagggacacctaaaattatgaaagattttagagaatttttttaaaaagtaattgcaatttagatcaaagtttcccatttttcattccaagtgtgatacaggtttaaataataaacagacaaaaaggtttagataaattcatgaattattgaaccagaggataaaaaatagggaagctatttagggcatagtctctagtgtgtaagggtgacatcctaaataataaatttgtgctattattgacaatattgctgacaaggctaaatggtcaatgtgcttgacatattgcctggtttttcatgttctattgcatgagctgattctctctctcttttatttatatttttgaactctaccattatgctatcatggacattatgtcaacaatttgatgcatctatgtaatatgctttaaatctttggaaataaatttactgggtgctacttaatgtgaacaaacttctcttaagcacaaatggaaatccacaaagaaagacagcctcttctatttgttttatgtgaggcaacggatacactgtagacaaaaagaccaagtataattaacttatattggtaactaacttaatatctgcatattacatatttttctattatgttttctgagcaacttcgtggcttctgatttggagggtaggatttcatagttaatacctctgtttttttttttttttttttttttttttttgggaaatggagtctagctcttgttgtccaggctggagtgcaatggtgaaatctcggctcactgcaacctccgcctcccaggttcaaatgattctcctgactcagactaccgagtaactgggattacagacacccaccatcatgcctggctaatttttgtatttttagtagagatggggtttcaccatatttgccaggctggtcttgaactcctgacctcaggtgatccacccgcgttggcctcccaaagtgctgggattacaggcgtgagccactgcgctccgcccatagttaacacttctataaatatttgtgcatattgaaaggaacatcactccccacactgcaagtgaacaaaagagtgataatgttaatttctttattcttgagcttttcttgaataaaagagggttgtaggacatggaacaaaatagactagaaaatagggttgataagctactgattctgccaacactgcttaatgctcttcccaagcaattgtcttttagatatgttgatttcccagtgttaatggtattttttaaatatgtcaagcaattaagaatataagtctattctcatctcagttaaacgtagaatctttacaaagaatttttggtatccttaaccctaatatgtggagggataagattaaaaatgttcatcaccttatttttatttatttatttatctattattttgagacagagcctcactccacccacactggagtgctgtggtgtgacctcggctcattgcaacctctgcctcccaagttcaagtgattcccctgcctcagcctctcaagtagctagaattataggaatgcaccaccatgcccaactaattttttttttttttttttttttggtgagacggagtctcactctgttgcctaggctagagggcagtggcgccattttggctcactgcagcctccgccttctgggttcatgcaattctcctgcttcagcctcctgagtagctgggattacaggcacccgccaccacacccggataattttttgtatttttagtagaaacggggtttcgccatgttggccaggttagtattgaattcctgacctcaagtgttccgcctgactcggcctcccaaagtgctgggattacaggtgtgagctaccacatccagccatcccctttgtaaagtgcagtaaagaaacagtgggcaatagacaggcaggggatagaggaaaatgttttgggagaggggcaatatgaacttattgtcatgactggaccaaaaagggaagatgtctgcctatcataattaataataactctatcagtcaacatttatgttttacaattgttctgtaaaagaaaagccagcaaacattacagattccagtccctaataactgatcatgaaagacactctaaacttgtgcatcagcattctctttttatctaaaagaaaatatattaaataaagggaggaatggcaggagtaaagagacttgaaggaaaagaaaatattgacttcttaatgatattttacaatgctaagatctttagaaaccaactattccatatgtcttttaaatattaggttggtgcaaaggtaattacagtttttgtcataaaagtaatggcaaaagccacaattacttttgcaccaacctaactgatacatttattccattttggaggtattgcaaatatgttgaatcaatgaatttcttcagtatttttcattttattagtacaaatttaacctaatagtattcttctgcatgttatttccctttgtgcttcctttactgcaatgaagttgtagttaccaaatagagtgctctaaaagggcaaggcttgtctgtgaattaagcctagcatagaattggctctcagtgaagatgtgttgaacgttacatgaatgcatcaacatcataatccttcatgtgcttgtaagcaattattaaaattttctctagcctattcaggcctgtgttcttcaaaattcttcaaaatatatggacgtgtttgctgtttctattaggttttaacttctggtgtcagaaaccagggctgtttttcttaatttgtgtcctaaaaccacagtagggttgtatgcattgtgataatgcttaataaatatataaaagattaatatccattcatttgcattttcttaataaaacccaatttctagatgagtagctgtgaaactctcaactggacgagctctgactagtgttaagtatagtatattgggaaaagggcttctatatgcaacatatatgtgaggcaaatgacaaatattagctgggctacattaaatcccaatgacatgaatagaaattttattatccaggtagcaaaaatgaagtaaaaaaaataaataagagaatgaagtgaaggtatggggcaaaacaattagttttttctttaagtcaatattttagaaaatagtttttgaaggcccaatcacacagataattgacactttgacttttctttgcactgtgttagacataggtaaaagaatgtctcaggactgtaccttcatgtagaaaatgtaattaatagcaaattgcataaaagtacattaaaattttaattattacatcattttaataaatatcttgagattttactttatttagtgtgtcattaaaacacaggatttaaggaagatatatataataaaggaaaatagtaagttaccattcttgtgtaaacacattttgtaaatactatttcaacaaagatttaaaagttaattacaaaggtataaagttatgaagtattatataaacaggattcataattttgttttaaatggtcttttaatgtatcaaaatactatcagtttaaaacaatcttttttttaaggcagtaggctctgtttaccatcatttacacttgctttaattagaattttcttcactttcagtatattcaagagctattctgttggcaataatttttaagataaagtttatccaaatagaaaagtaattatataatgattaagagccagaatgtctgggttcaaattccagttctgctacttatcaggtataagaatttgggcaaatttcttagtttctctgtgcttcagtttcctgatctgtaaaactgggataacaagactacctgtctcaatctgtggttatgagtaaatgagttaatacataagagcaatgcaataatccttggcatgtggtatgagttcaataaacattagctattattattatagtaaattagaaatttaattctagagaataaaaagctgaactcaaatatgtaactatttatttgatacagacacattttctacaaaataaaaaaccatcggtttgcacttcccttatataatgactatcttggtgtttgtgtgtatctgttgtgggtcaggggtcttgggctgagtaaataatcacattaaaaattttaaaaacttccgattaaaacagaaataagaacaaatggccattcgtggatcatttgcaaaactgaacgaatatttgacatgtctttctgtgattccttgcagatatcatggaaatcaggacagtggcagttggaattgtggcaatcaaaggggtggaaagtgaattctatcttgcaatgaacaaggaaggaaaactctatgcaaaggtattgataattgatagcttaggcttaatttttaaaactcatttttgtcaaaatatctcacctttctgaaaagtaaaaatggaattaatttatctccaactgtataatttaatgattttattaaaacactttatactcaaacgttaagaaaaaatgttttctgtgtgactttggacaaatggcttgttctttggattttggtttcttcatctgtaaaatgagttgaattaactgacctctaaggatccttccagctctaaaattccatgtgcattttagatatttaaaatccaaaatttccatttgccagtattaaagctctttttgttaaagttcacccaatttgcacattgctgacatgaaaattcttgggaaaaaatcttgaaatgtttagttcattcatcaacatcaatctcacaatcatgggcattgaaatgtaattattcacattgtccccacttcactacaatgcaaaatatgtaacagttcatcccaccataataaaatataattggctttcctttgtattcccacagctaggcataatgatacaggtttaattgaatgaacaaatggttgcatggatgaacaaacaaattaaccttttatcttccattaccattgaagacaatgtagaagtaaataaagttgtgaaacaagtctctcacctgagggaggcagaggttctgctaattataccaaatttccagtggttaaagaatgagtgatgtgggaataagtaatatgaggcctgttacttagggggaaataggtcctaatttaaagaatagttgacatgaacttccaaaaagctacacatatttcataactagctgtgtattatgtggtgtttttatttcaaatttaagatacctttttatgcaaatatactacataagtatagctaataaaccacattaggcctgctcaatctgagggttaaaaaaagttgtgtatgtttcaattctaccaaatattacctgcttactcttcgtttaattgagcctctctaaaaatcatttggataatgtctgtttgtttgtttgttttaacagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaacaaatatttgttttctcatagtttatgtggctcaggagcctgggcatggttcagcacagtgtttttggtcagaattcctcatgaggctgcaatcaaggtgtagaccagggctgtagtcatctatctcaatattcaactcagaaagggatccaccttagatcctcactggctgttatcaggacctatcacttcctaaccacatggacctctccatagcactgcttacaacattacagtctgtttcccacggagcaagaaatcagaaagtgtgagatgaagtacccaaaatggaagccacaggtttgtttttttattttaatatatatagcctagtttcaaaagcgatgttacctctgcctacactcatgaggagggtattatacaagggcatacataccagaaagcagggatcactggaagccattttacaggctgcctgatccaagtcataaactaggtgtttttaatgtcactgccataaactgggattctacagggtctaataagagtaattcatggctttcagtgggcatccattcatcagagaaagagatgaaatatgtatattctctgtggaaacattcttgattcttccttgagggatactgcgtggtccattcctacaaaggataattaacaaaaggtttgaaccaatctggacttcctcttagcctgagatgtggctacttagaactcccaatgtagctgcaaaactaacaatatccctttgcctccacatgaagcaaattaccctgccatcagactcaacatgaagataatcctccctttagctgccctacctcaagagaataagatcatagatgccagctggaattcctctaggccatagagtgttttgttctagatgctgaaggcaatcagccaccacttacccaagaccatctgagaataagacctaaaaagacttgaaaacaattgatttcaatggtaggtacacactggtatcccctgttctatatatatctatagatatatagatatatacagaacaggagatatatatatatattttatatatatatatatattttatatatatatatatattttatatatatatatatattttatatatatatatatatatatatagagagagagagagagagagagagagagagacagagagagagacagagagagagagagagagacacctaggccccaacgcaggccaattacatcagtgtatatgacaggtggcccatgcagtggtattttaaaaattccccagaagattctaatgtgcctctgcagttgagaactaattaggtaaatgaaaacaacaacaaaaaccaaaaaacctcttcagaaactatgcctgcttcttcatctttgtcccttctttaaacaccttgaaaggtcttattccctcccagcccctcctgcccctaggttttcctagatgcctccatatttctgctattcacaactggggctcacaggaaatgtagacactagaaagagagttacaattgtttttgcatcagaatgattatggaatacaaagtgcacaaaagttctccctcccccaccacagtccattctcaaacagagcagccaaagtgattctgttaaaatatatttcagatcatgcatcctctgtttaaaattgcaattgttttccatattcttcagaataggagcctgtccttatagtggctaaggagtggcaatggaagaaggtgagtaattaaaaactttgctgcttaattaggtgggcaaaacaacaagaaaaagtaataaaaatctagagaaattatgcacttaagttgtttggcagatgtcactgaattcttagttcattttaaagaaatggatactggatactatagacaatatttaatgggtataatcattattagaatcatactcagaggaaagggcatagctctacatcgaaaaatgacgaatgtacctttttatgtttgaagtaaatatatttagggcatgtacatatcaccttaatgattctccacttgactgaaatttttccattaatcaaccaattaatagatacaaccaggctagatgagagggcttctactttactatcacttctttattatatatctccgattgttgattatttttggttatttcaattattttatgaagataaatatgaacaatttatatatgtttctttatatttctgattttcttaggacgattacaggaaataaaattgaaaaactgattttctgaaagttttttccagaatatattctaatcagcagtgccggaagtaaatattctcacttttatactcaaaatttagtcagctcttattcttgtctctccttccctttgactctgtgaatatggtaaatcaccaacactcagctaacttctttctcaacatccattcagattcatctctttcttcatcctcctacagctttattacttcatgcctagaatttagcaatagctccttaatctttcttgtttcaaattccttcccatctcatatactgcctaattctttaatcttcctataatactactttgactatttcagtcaccaattgaagacccatattggctcttttttgcctgttgggtttagtttaaatctcttaaactagcacccaaagctgtcaaacaattggctctaactcgactgtccaatcttctcactgttcaatatacacctagtagtttctttagtccattgtatttatcatgatttacacaagttgcaaattgattctgcctctgagttttgtctatactgtccccactgcttagaatatctctacttcctactgtcaatcaatccataccctgctctgctcttaaggacaaagctcaagtttaatgagctattcccaaacttgcccctgccttataacaatttttttccttctctgaatcctattgcactctaatatagtaattgattgcacacacacacacacatatgcacacacacacacatatatatatgcaatgtttatgtatatgtgtattcatctacttcagttaaacaagcatatattgacaattctaccatgtttgtatcaagcactgtatgataaatatatgttgagtgtgataaaagtaaaagtaactattgcctttttaaaattccccatgtaatctggtaaggaaatagaacgtcaaaaagtacttaatactattaatacttgcttactaactgatccatattaataatctattgataaaatatataataaattttatatacaaagatctttccagtcttgtcatcatgcctacataatcttatctattgccatacaaaggtctgtgttatatattggcaagtcctttagaatctgtttttaaaaataacttatttaacaaatgcagcaatcactatgtgaggtaaaaacacatctatacttttaaaaaattctgtcagtcacaggtttgaaagcacaagatatttgatagcattgatagtgatgctagtcctgtatacaatttaaatagaatccatcaggaaaagcaagagatcaaaactttttgcttttgaagtacttcatcccttatccttgaaagcttagtgtgttcagcagttcacgctcataggccttcttagaatgaatcatgtaacatttttcagcttttctcccttttctttattcctgtctgttattgttttgctaggtggcagtgcttatctcaattcaattttaagtttctatagtttacagcgttaattattaatttttcatatttctcatttattgtacatgtcactcaactagctattcatctgtccaacttttatgatattgctctataatgaaaaaagaaaaatgttactttcttgctaataaatcttcctaattatctccattcactgtttcaaaaataatattggaatttttattccctttcagaagataaatatttaccatgccttaatgttattaaggttaaatcacaggtgatattttattgtcttctaaatacttcattttcaaattttctacattaatatatatgatctttataatcagaataacaatagcaaatgtggtttaaaaaattatcttcacattcagtttttatggagctggaagagtgggatgttggtgcagcattgatgtattaaatagcatggtcttctacataaatgatcaaacctggcacccacattgctcatctcattcaattaactaaacttactgaaactccataatttcataataatgtagtcattgttaccatattttagtggtgactgtgtcctgaatcttcttcttgaatctgttcctttatccagtaatcaccaagattgctcaactcttcttacctaatgtccctcagtctcatctcttcctcactactttcatgacctcattaaattgtacctaaagtttagcaatagcatcctatttgtttttctgttccaagtcctcgtctcaattcctgtttagttacctaatattcctaaaatgtcatttaaactatgtcaattaccaattgtagaacccatgttgtctctctagggctcactgaatttgggtaaaattctttaaactagaaatcaaaaccatcaacaaattggttccatccatctggtccaatctcctcactgttcacaaacttcatagtatccttagaccattgttctcatgtcattttgtacacgcaccatacttccttgtgtctctgggatttgtctatattgtctctatcatccagaatgtctcaacttctcactatcaatccataccctgctctgccatcaagaacaaaatcaagattctcctctttaatgattaccagacttggtcctgccttacgatgatttttctcttctataaattcccactgcatgtcaatctatgccattaatctagcatttagagaatttttatctctatctcaatagaggatggataggcatacctgtatgtctatctatccatccatctacacttatctacttaagcaactaggcatacctgtgtgtctatctatccatccacctacactcatctacttaagcaacacaaatacacacacacttatgttatatatgtccacatctatttcagttacacaaatatataaaggggtctgtgtatgtatgtatgtgtatatatatatatatatatgtgtgtgtgtgtatgtatgtgtgtagtcaatagtacagtgtcaggcactgtaatagtgttaataaaatccatgcttcaaaatttaaaacaattacatacctatagatatataatcaattttatgaggatcagatttggaacaaatgagcctttggaaccactaagaaccataagtgatagctgacagactgtcaagaaaaaaacttcctaagtctttagcatgtcagttgtagagcacatgtataagttaccattgtgctttgaccctaacagtaattttaatgcttgagtcttaaatataaatatgcatatattaaacaactgccaaaccagtatcaactctattgccttagtgggagacacacaaacacacacacacacacacacacacacacacacaccctaaacatagagtcagcaataaattcaaaaaattcagttgaacaaagaaacgtatattgtcaagaactgcaatttcagttttgtttttgttgcaaactttctggttgacttcattctgtgtttaacaaggtccagtattgtcctggaagtccatgttacaagacggactttattagtgaaaacttttcctaacattttgctagatttatacattgcactgatttactctaatgaaaacttagctgtcctcttaggatactgcttcccctgcaatcctctcagttggaggctcttttttttccctcacacagtattcataccagtctagaggtgtatggtaggtatatgtatgcctgctacacattctatgtaacttatttaatcacacttgttggttattgtctgtctctcctcactagcccataagttccataaggaaaaggatactgttttgttcccttatgtatccgaagctcctttaagagcagctgttaagcactcagtaaatatatttaatactcaggaaatataaggactcagtaaatgttcattgcactcagcaaatatttattaaactaatggacaaaccaattccaattcagtgacagaataataagcacacctcactgcaaagagtcattctaatacctaagcatgatacaaatgtcattgttgcaaatgaatagaaatatatcacattgttttatgcaaactgatgactaaatctctcaggtattcaaagtcttatcattcacttctccataacacagcattttaatgtcatttagtataatatgctaataattcatttcataatataatggaaacctgctgtttcaaaattaaacccagcccctctgactaatgctaccaaccaacagaccaatatatctgggggaggtatttgcaggcgatcttatggtagacatggaaaattatcttggaagttaaataacttgaaattgcttggtgagcatggcatcaaagcaaaaggagagaaaacaggtttgaaatatacatattctccaaattatgatgaaatctaactcataataatctgaatagttccgttaaatttctaccaaatttccggttctttgggctactctgtgccttatgttattcactctgcttctgttcatatagtctttctctacacagtataaaatacaactaacaacaatatgacttaacaaattgctaccactttgggagtttgtatgtctgaccatattaatagcatatttctggggtttcctcactccttagctgtgcaaatttcttggttttcttttaatgatgtataatgaaaagcataatgtggaaattttactggcttagttctcaaagtgctattttatatcctacttctaatggtttcttttttattatccctgagcattgctaatagtgaagaggtagcaaaattagaggtgcaaactaaaatccgggccgggcatggtggctcgtgctttaatcccagcactttgggaggcaaaggtgggcaaatcacttgaggtcaggagtttgagaccagtctggcccacatggagaatccctgtctctactaaaaatacaaaaattagctgagtgtcgtggtgcatgcctgtagtcccagctacttgggagactgaggcagaagaactgcttgaacccgggaggcagaggttgcagtgagccaagatcccaccactgcacttcagcctgggtgacagagcgagactctgtcttgaaaaataaaataaataaaataaataaataaataataaaatccaagtagctctttataacatatggaatcctaaagcatctggctattactttaaatatttctgtaacatgtcatttgctaaatatcacctagtacttgtgtatgagtaactactgtgtttctttttattttttatctccttacagtgccaagtacagtaatgtgtactaggtacataaaagtacatgatagttaaatataaggatttttcttattgcttgcggtttaagctacagtttataaaaagaatgagacttgttattgttttagctttaaaatccaacaaagagaaaaaactgaatttagaaattgggggagaggtataaaaatagtttttaaaaatgatctttatttgagttcaaaagcttaaatggtattgtaccacaataaagaaattaacattaaaattttagtcttgtaaataatctaacaatacactgcttaagaggagctggcttataaatcatgagtcattccagatactgaaattctataactgcttacattccagtcctaaaaagggagatatcatgacattttgtttggaaggcaaattttaactatccactgtgtgtttatttcattaaaaacaaaacagaaagtcctctttgtaaaattctggaaaaaagttaactccacattacaataagcatctcaaatgtcgaaaaaaattatgttttaaatatgttttagattagaagaagcaatcctaagacagcagtatatatggaatacagaatatttcttttaagtcatatatatgtatatgcatgcatatgtacatatactaatgttttaccctagttctgctctttatctgccttagccttcctccagcacacagaataaggttttagtatacacaaagtcacacacacacacacacacacacacacagctatagagaaagaggagttctcaaatcatgaatcctaaaccaccagtctctattactaattacacctgaacagtcagcaatcactttggaagattattcagcacctatggatagaagtctttaaagaacaaaatgctggaaaaggggaatatagaaatattctactcacctcatttttcagttgtaaaaataaagctcagaggggttgtatgacctgctcaaagacattcaagttctttatgtgcaagttgaatacattagagcagatgaaacattagggactatagtataggaaagcctccaaacaaaagcatacttatggcaccagtaaatacatgatctgaatcttatgttcagagaattctccacaatgatgactgtgtccagactgggggtaaggtacacagaaactgtaaagcaacaagcaggatatggaagctctcagataccatgagccaagcccctttgcaatgatttcctataggataggaatgtttcagtttctcaccgtcaatccataccctgctctgccatcaaggacaaaatcaatgagttgggggaggcactcactgaccactaactgatataaaaacacagaagatagttttaaaagtagattaaagctctggagaaatatgagatgctcaaagttcaaaaaagaaactcataaatttgaacaaacttctttcttaagtagatttcctagtagtcacaatctaagcagaagattatagaaaaaatacctctttagtgatctttacctctttgaaatgttacaacaacttctcttttaattccaccatcaaaaacagcggtgtgtggtagacatgtaattctcaatggaggctgtgtttcttttagaggtttagaaattctggcccattgttgccattgtgcctctgcaccactttggccccaaagtgtgaattttccaagtcccctaaccattgcttgctatttctagagaaattcgtacacgaaactggaaaacaagtaaatttttgtccagtcttctgctacctttctggcctttctactagcatctttcctcattcaccctcatctattaaaatttaatccaggaaaagacctaaaaactcattcacatttgccataaatgaagtattaaggctatggtaactctcataagttacaatacttattctacaatgataattttaagccttaatttaattataagcctgtaaaatcaaatgactgataggcagtacgtgaagtggttatgagttcagactctgtggccaaaatttcttgaatttcaatttatagtctagcactgatcagttatgtggctttaggaaaattacttaatcaacttatattgtggttttgtcacttataaaaatgaagatgataataaaagtcacctgtcacataaaaggattactcatttatgagagtaaggcagttaatagagccttagctctcttaagttaacacactttatcaagtacatatttcaaactgaagattttcccaggttgaacatgaactattaaattaaaatttgagcaatgaattaaaagaaacagccactataacttggcccttgctcccacagcttagaccatctcatccaga

SEQ ID NO: 123 - DNA, 5114 bp, Homo sapiens
gctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttc

SEQ ID NO: 124 - protein, 190 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELINHYNTYASAKWTHNGGEMFVNQKGIPVRGKKTKKEQKTAHFLPMAIT

SEQ ID NO: 125 - DNA, 1992 bp, Homo sapiens
gctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacaaaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctg

SEQ ID NO: 126 - protein, 190 aa, Homo sapiens; identical to SEQ ID NO: 124

SEQ ID NO: 127 - DNA, 117328 bp, Mus musculus
  misc_feature (1)...(117328): n = A,T,C or G
gccacaagggcacagtatacacaggctgctctggagcaaatcagcatggtgagcctcaagttcatggcattctctgtgtgcttattataggttggtcctctgatcacactcctctaagaccagcagagccctgacggttcgcttcatagaggttctgtagtggccttggagaaagcatggcagtaacatcagagactatctgcactcaagaggtttgtgctcccagtgtctgcaaacctgtgcccctctcaggagcatgggccctgcaaagagcaggtctgagccaagcccacatgctttctacacagttgctaacacacaaaggaagtactgacccaggaataaatgagaacacatgggtttccaaaacagatcgcctttacctatatgggctcttcctccccttcttcctcttcttccttcctccttttcttccctcttccttcttcctccccctctccttcctcttccttcttccttctcttcctccttcttcctcctcctctcctcttctcttctttctcctcttcctctttctttccttcttcctctccttccttcctcttcctcttcctcctcctcttctttttcctcctggaagtagctgatttacccagagtgctacagagttataccacagctcgagctgctcgtgtttctgaggcaattgtacttcgttatccacaggttcctgcttagctccctaagctgaagcagcccctctgcctgtgtgacgcatggtgagcccttctgtcctttgtttcccgcctccgctgtctttgaggtctctcagacacactgtagagtgaccttctctacctgctggggacctggcaccatgtgaaacagccaacttctgcttctctgtcactgccaccagactgatgagaggagtgtcccacccatgaacacaggaaaccacagtttgggagcctgtgttttgccatgtgacagaaacaggccgtggttcctgaggctccctctgtatcctgtgcttgtgtccttgctctgcagatgaggaactgaagcttcgagggatgtccacacgccattgtggaccagactcagttctgctgccacggagttctcacactccccccccacacacacacacacaccatcctcacagagcaaactcagttgtcctattttgtaggagatgttagatggtttccctgaatagaaaattttaaaatgtcatatgactttcaagaggatatagtttatgtacaagacttagtatgtttagaataagaatcttggctcgatcttgtaatgtctttttttcctctgcaaaaaaaagctgattgtctaggctgacttataagtattcttaatgattatgaaaccatttctgaatggtctaggtagtttatctatgtgtctctataagtatatatcacatgtgtgcagagatcttgggagtccttggaggtgcagtcccaggaggctatggctgctgggaaccgaacctcagtcctcttacaagagcagtcatgcccctaacccctacagcacttctttagtttggggagagcatgtaactttcattaccagagaattgccgctaaaatcccatccttaagaacttgagaacacatgcctattctatttacatttataggaccaaagttatattggtgggcaaatacaaattgcaaaataataataagtttgcataagaactcagtcactaacaggaacagtagagcttaactgtggtatagggatgagtctaaagctctactgatgatatgctaaaagcatgttatgcataggtaagatccaattacagtaaagtctttggaaattatcctagtagcttgctcgttttaagcaataactcagacaagacaatactgcaaactacctttttaaaaatcttttaaacaacgctttttttggactcctgggaagctgtacttaactaccatttctttttctatccctgttaactgtgacttaaatgcattgctcatatagggtccacacacaagccattggcttctgggaaatgcctctagtgacccagcatggagcaggtggtcatcactgagcccgtgtgcccactggccaacaagctccatcttcccagaactgtcgcctgtgtttcatccagtcttctaatggccttgtcaaagaggctctctgattctcatttataagcagaaaactaggaagattattcatccaaaatcgcatcgataggatttgaacccagactgctgggatttgaacccaggcagtgtagttcccatgccctgtcctgtggccaggcagtaactgtggcaggtgttccatgttcccggccaggggtgggtttcatatacacaagatgtaactatagatacaaggctgtgtgcttccatccacagtgataacagattatggttggcatgtcagaaccaactagaagcacataaactcaaacactaaatgccacattagtatgcaggcctgagtggctgagtaacttatgccaggctagcttcctgccgagcaggctcctctctggttgagtgtggagggctgaaatcgacactgttgagtttattctgttacattctctgactgaagcctgctgtttctacagacaagagcaaagtacagcgtagcaaaaattagcccggatgccagatgctggcgagagcaggaggcgggcccaggaaattaggtactgggatacttactaacaaagagtggcatgcaaatgaaggtgaaagcttttgaagtctcaatgtagtctggatcctgtggtttccagtgttccaagtagttcatctccaagcagaacccagctaattcatgaaagcagcccttccctttagacagtgaaaagctccaatgaaaccagactgaccaaacacaagttgcagggggcagtgtagggacattttcaaagagctctcttgctatttattaagtgggagatatttggggcaaactcttgtttacaagtactcactcacaagtaggaagatacttggcatgaaatgcataggagaactggaggctgtaaggcatttgttgtgggtcgatttgattatagctgactatatgcatagttctacattgtggcgcaggtaagattgattctctttggtgtattagaggggcgtgtaaggttcaaggtcacccagctagctagtgaacaacagctgtacctcatctctgctgctggatctgtcttggctgagccagcacatgtccctttctgtgcccaaggacacagatgatgtcacagtatgtgccttgcctgactgtctgttctgaggttcttgagaaattatcctgacaactgaatgctgattgtgttcagataattgactttgctacaatttagaagtctttatagtcatttgccattcggtaaccttttttcaatattttaatgaaaggatacatgagtcaggatgcttccatagttacagaaatggggttaatgaatcttgggaattaagagagactttagctgagatttagtgagggtgctgaggccagagggtctgcaaatacaatgaaaactgtgtctagatctcagctctgctcccgagaatctggccgcccatcattctcacaaaagctctccccctacttgtaggctgagattgcccccagaatcccatcttcctacagctagccaatccagaaaaaaaaggaactatttccaagacagctccagccagaggcctggatgccccagtggaccaacttgagccacaagtacattctgtgaattgcaggagcacttaacccagacaccccacacacaccccagtggccctggtagggaaggaaggagaaggagagattgcccagagacaggtggaaaacatggtgtggattccaagcaagaagtacatgtgggagcagcaatgaccctgcactggagggaccctgcatttctctgcctgctcctcaagctgcacacaagcttgtaggatgttttcaaatccaagtttctgaaaagctgcataaatagatgagctctgtgtaacctgaatgttctagaactaatttttcaaaccaaggatgacaacccgtggtgaattaggaaatccctgttaattaagtcagtggggtcacagccagcactttcggatgagatggaatcaaaactacttgtatctagcacaacggagtgggttaggttttgcttgtttttatttacatagctgagtgtttacaggattccagtgtaaaatgtattcctttctaggtttgctagttcacccaccctgaatggacagtcaccccagttaaagactgagaactgagttgacacttgtgagcttcggggcgggcgctggagactcattagaattgtctagcaatgtccctcaagctgtgcggccttaggcaagccctccactgcccacatcctccagttctataaagtagggctaagagccaggggattatacggatggatgcaaaggtacactgagcagagtgacaagaactccatcaaagtcacgaggcttctgtctggtccacgataaggaagtctgcaccgggcaacttctggaacctttgtaacttagcaaccagcataggaaaggaaatcaacgccccctggaagccagcactcttccacagtactacttccaggctaccgaaccctacttgcttcaggaaaatggatagatttaagagtcccagctgctgcagtggccacaggaccttaggatcccctgagcagatgcttcgttcgttcacaggagggcttgcctccaggctcggttttagaagctgctgaggtcagcatgctggttggttggctgagacaagaggcagctgagagttagttgatggttagtaaagagggggaaagtagaggtaaggacctaaatacataaaaagggtgacgggttaaaagcaaatgggttggaaatgataggcaaatgtcaggtggagggatgctgtcatgatgcgattggtatcacaaaaagtcctctatctgcaaggcactccacataaactcgaagaggctgtgataaataaatgtcagtgcccccttatggcttccaaaggcttgaaatgatacagtggtagctggtggttttaagtacccctattttgccaatccatagaattaactagaacaagaagaggagctaaaaaagcactcagatacctttatcaaaatgaagcagtcgccgctctgcacatctacagctgcagataagcattcggtgtgttcactaagacaggccatctaactagaccattaaaaaaaagtctcttaagtacgcatgaaataagttaggaatataagttttttaatcaaaaattatgcagggacggggagattgtaagagccagaggaaacatgtctataataaaacagcagcatttgccaagcatgccgccacaattgcacacatgaactcccagtgcctggggaccacatacacaaggcttgcacaagaccaagccagccaaaatcccagcatggatgggagaggggctcaaagttcctcccctatctgagaagctattgacagctgctgcctgctaagggaaggaatgtcagttttcttcagggatggagttcctgagtctatccatcctccagtacatggtcccacacaatgcacatagaagacatagaagaatcactaaagggactcgtgtgtatgtgtgtgtgtgtgtgtgtgcgcgcgcgcgcgtgcgtgttgggagagaaaaggggtgaagagatggcggttgatttggtccaaacaaattctatgcagttatgaatattaaaagactgttctaaagtaagagtttaaaatcagtgatcttgccatctaagtggcaagatcttttccttctaagtagctggggggtggggagggggaaacacagcaaacctaaagaaaagtagaagaataaaaatggaatataatcccaagtagacattatctcaaaactgccatgcttttaaatgttcatactttttatagtttatccttaactaaaatgccaataagttgatgaaatctagcatattagcagaataaagaaaaacatgcttatcgtagatacagagaaagcatttgacaaaattcaacactcatctttgctttatttgaaagaaagaaacaacaagcaaacaaaacgaaggaaggaaggaagaacctcagaaaactagagctaaaaataaagagaaagatcttcaccctcaaaaggcgcatctatggccgggcagtggtggcgcacgcctttaattccagcactagggaggcagaggcaggtggatctctgagtttgaggtcagagtgagttccaagacagctcggacttcacaaagaagccatcttggggatgaggggtgtccaaagagtatctatggccacctcacagcccatagcatctgtaataacaagctgaaggattccttagaacttaacaaaaataacctgcttccaggtcttctgtaccttattatgagacactgcagtaagacaagatttttttaaaaaagttaaagtaaacctccacttcagatgacatagttatgtgactagaaactctaaagactattgaagctaatgaatgagtgcagctagtctatgggatacaatagtaaacatgaaaagataaaacatttgaatttctatgctcaataccatctggagaacaaacctttatgttagattcataaaagatgtgcaagatccctgcactataacaacaagggggagctacatatatgaagagatagattcattcatgaattatcaaaatatcacttcttcccaaaacagatttaacgtagtcctaatcaagataacagactttttctgtgcctatgtttaaaatgtctgtcttaaaaaccacagttctttgattttttaaaacggaaacaattcattacatccaaagaaatatcgaaaaaagaagagctaagttggagactttgcatttcttgacttcaagagctataaaaattcatttaaatatttttaatgggcataacaactagatcaatagataacggtcaaaagaaaagattcctgaaataaatgtattcttactttccttctcaataattgccattagaaaaagtgagtatatttttggacaaggtgaactttgtctcacatgcataataaataaactctataccacacagaccaaccatacaaaagtaggggagagacaaagaacatatgcaaccttgaaagcaataatataatgcacaaagtatatcaatcattacagactggaaaactggtctttaacaaaactgaaaactttgtcaggaaacttttttaaaacaagtaggtattccagagaagaagaaaaataatggtaataatagttgcaaaatacacacctaagaaaggactggtagtctagattatataaaacactgcccttcaataacagggaccattgtgtgtgtgtgtgtgtgtgtgtgtgtgtgtgtgtgtgtgtgtgtgtgtgtgtgcatgttgtatgtgtgtgcacatgtgtgcatgtggaaaccagaggggctctcactgaaccgagagttcactgacttggctacggaactgtggctagccagctccacttggccctacctgctcaggaggagtaggatgtcaaaagtccacagctatgctcatccttctgtatgtgtgttggggagctgaactctggtcctcacactgtgatgagcacattactgacttggccatctccccagctccaaaaccaagcttttaagtgggcaaaatagtccaaccatttacaaaagtccaatatacaaggtgtccagagaacacaaaaccccaaggagataagtttatgtgcctgtatacagaaggcttaaaaataaaatggctggctctgtcaacagtctataggatgtggacactgcattgttgtgggttagaaaaagctagtttgaaatgatgtcagtcggtacacttcaggaacacactttacacaagacacataactggttcttatgaatacagagacctgaataaacaaaaccaagttctataaaggagaaatattccatggtggaaaaagaaatcagaatagtggctacctctgcaggaatgtgggtggggatttactgggaagatatttgtgggagctttaatcctttggtggcttttagatgataagggagggaggccaccattgtttggctcccaaagttatcaggactcacctaatggtacaatgacatgtcattgcatgcaaattttaccacaaaagcaaaaatccgaggatagagctcttaataatggccaatactggctggagatggggtgaaagtgtgtgggtgtctacaaccattcaaagtgcatcctgagtgggttggtgactagaaaggaatgggtaaatataagcaagcctggtaaactgtcacttgtagaatctaggtggtggtgtgttgtgtcattgtaaacgtcattcgattttgatgtacttgagatgtttcttaaactagtaaaggtaattgggttactcaccctgggtgtgaactcaataccctctaaagttcttcctccccaggagacacaatgcaagataaacggtctgttagttactctcaccaaaatcatttgcatctattcaacagaactgcaagcttttctagttctgtttctggctagtatcgtgggtgggtctcctgggaccactctctctctctctaaaggcggagaaattctgtttagaccgtgggtggctatgaatccattccttcacacagctatattcgatcccctgtggctaaactgctgggaaccaggtgtgtctggagggcacgcagcgccctcttctggcctgagaggaacccacgcagaccatcgaggctctcgacctatctgttaagcaaccactccagggatctgcactccctggtagaagcatcgctgtttagaggtccaggcgagcgccagcggaggagacctgagcaggagactggccctgaggccaaggggcgggtaccgggtggagtcgcctcggttggcagctgcagagctccacctgttgcagtttttgagcactccacagagaaggcagctctgggcacggacttctgctctcagccccactgggcagggcaaggccacttgagaagggaagccaggaaccatcctgaacctgttccacagagcaggtgcgtttgggaaggtgagacgcgaaggcgacggcggctccagagctcatggcaagttgggggtctctgggtgggcgccccagcggttcacaaaagaaccttgttgccggcttacatgttgtagcttggagttctcagctcagcgccactgactgcgcaagaactacagagccgaggcgatcaaaaccgggtgaaagagatggaactcttctggccgctgtccttggccggttctccgggagatgggctggcagggccggcacgtgtggacagagaacgcccggtgcaggccctagaggccaagggcgatctggtatgggggaagtcaaggaaggctccctgggaggatgcttctaacttccttcactgttccaacctccccctctgttctcctccccacagcggtccgccctcgtgctgccgtggagcctgtgtgcccagcagagatccgagccggctgatctgcctcttcgcactgtccctgcgtccgtgcgtctgccccaaacccgttccgacctctgagccctggttattctggtggatagaggctctcggcagaacattgtcactaatacgcaacacagatccacctggagaggcaccgaagacagagaacagcccgtatcccagccatcacagcttggaaagcaatgctccgaggaacccggaccttgatgtgaagcttacccgccgattctctctggacccacgaccttttttttcttcaagaggagttcaagttctagggagtttgccttgaaggcacgccacgccccctccccaatctgagccgaattaggagctcgggtgaacccgggtcgcccgcaccctcgcaccaagtcgaagcagattctgtgtcccgaccctctggtcttcagccttaaggagaactccagagaggacagggaggcggcgacgacaaagcggattcgaaaccacgagtccaggcggacgtggggagctggctacacaggaaccaccgaggaggcggcggcggccgggagatccacgccgccttggggaacgcgcggcgggcatgggcgagcccgcacgcagagcaggctaaggtcggcagagcacatcctccccggggcgtgggcacaagtccgcgggcagcaaccctcgcggagctgtcctccagtgccatggctggccgcggttgcggctgcagccccggccacctgaacgaggacaacgcgcgcttcctgctgctcgctgggctcatcctgctctacctgctgggcggcgccgcagtcttctccgcgctggagctagcgcaggagttgcaggccaagcagcgctgggaagagcgcctggccaacttcagccggggccacaacctgagccgtgaagagctgcgaggtttcctccgccactacgaggaagccaccagggcgggcatccgcatggacagcgtgcgccctcgctgggacttcacgggcgccttctacttcgtgggtacagtggtttctaccataggtaagtgagccgcctggtcacaccatgcccctagttcctgggccctcacaggacctagcatctcacccttggggttctccgcttgggcgcccagcgatgcacctcgggattcctttgtggctaatcaacaggtgtgaatggatcccaaccacacccgaagattattagaattaccccagacctctgcctagaccagaaccagctgctctttgttagccagtcgccaggaatttgaatggttcttaaattagggaagcgcttttgtagacagtcagtctggctcagcagacagggctgagttcgtgaattctgtggagagagcttacaaggagacacaaagctagaaacgtttactgagtgttgaactatgcacaagccactgctcaaagaaaaggccgtgatttcaaacttacagagagactctcagaattccaaactggaaagaggcagaagagtgtaaaatggggctcaaagaatgggccgtgtttccttctgtgaaaaaccagtggaaaggtgacggtgggtctagccagtttgagttcctatgaattgggtttagggcccaaacataggggcatacacggggacagaagtggcttgcgtccagaattccctgaggtgctggctgagcttggactagaggaaggactgctaggacagccggcctggtggctaatgagctggagttagaatttagtaggaggcagctgagtccctaagaattttgagaatggtgtggcgggctgccatcggtgataatcccctgcagaaggaggtgggaactggaggatttgtgcagcagcaaccccccccccctccaaactgctcactattgatgtatagctgagtaatgccggggactggagaaagtactgtagtcgtcctggggaaagaggcctgtgatgggggaggggctccgaaaggaagaagggaagtagtgcagaagccaccgcaagagctcatggcgccagctggacacgtttgtgctaggctctcagcagccagggccccatggctctctagaagggtttccccgtggcatcggtgacaggtgacccaccttgagatgtcatgcagacattctgccaggagaacagtatagtcgaacaggagcctcaggctatagaccagattaaccaaggaagacttcccaagattagccaggaacccatgactcactcagctggccagcaagtgagaaggcagaagggaccagaatgactggggacataacaactgtactcaagtgcttcctgctagatggtctagctcacaaccccacgatcactctgtctttttatttttcccctcggaggtccgctgtttgtcacctagaaagaggaatgcttttcatttctgcagctcccggcatctggctttcctgactgctttcttccctcatgcctgtgtttggagcatcttttccacccagcctctgtaaggatgagaggcgtagttcaacagctctccatttccaggcacagctcggagtttctgctgggctttaagatgattttctgtgggaacaatggcaggtgcacctaagatttccagctgaggagcaatcagtgctcgggtgtggagagcaggagtgagagcagccggtgagagtttgtgcccactcaagggaggctaagagactcattcctctgagacccacctcctaagatttcactgggaagagcagactggccattctgagaagctggaatctagttgattactcttgtcctacctggaaactttcaggactgtagtatctgatacctgaccagagcataactctcgctctcaccacccagcattcctgtcctttcaggaaccggcgttcacctgagccggttgcatccgaactcctttatagtaatagaaatccaatgattttttttttctgtttgaattctcaattctagtcagttatctcttccctcccatgcctttctctgtgaagaagaggtgggttggatgtggttgtaactcaaatcattcttgaggtcctgtgcaaagtggctgccttttcaaagaagactggtttaatagctaaagtatcgaaaaactaaattcaatgttcccttgcctctttaaggaaacttaaaattgtcctgttataacacaaaagaaacgttcctcttttccgtggctctgggaattctcatctctaggatcctcccctaatgtcctcccctaaggtcctctcaggctcgagccttctgtcattcgttctttgaggtcccctcttcctatctctttttgctctgttctcaaaattgacatagcctctcttctttcttttagcttactctcatttaacctattacctggagtctcaaaaatacaggacagtcccaggaggtgaccagcatcaaccctgtcaccttcaaagcacagaaacgaaagagcttgtgatcagtgtgtgacttcttgagcctgtgggttcagacccagaagcaacccagtccagctaatgacaagaagcacccgctccccccacccctcagggctgtggtctcccctccccacaaccactgtttttctctttcccatcactccctctagccctgtctttcattatggaccaccaggcattttcccagtgatgcctcttcagcccacaggttgcaccttccctttatcttgagggccatctttagaactaattaagttcttgggatgcttggtctgatcacacctgcatctcatttattgatcacctctccttgtgggatggatggaggacactggttgtcagtgaaccagagatcagaccatgagtggaaatcagtataacacaaggtgcagggcattgggtggggggcagccgggccctggtgagagcagtgtcaccacaggagttccctaagttgaagaccatgctagctagacaaatgtgtggacctgaagtccccagatgaacttaggtcacaggggagagaagtctggccttgcttcccttgggaagggatgagaggaagttcttccttctcttgcagtccttgggtgttgcaggttactctagactagtgcacacaggattcttggtcaccctggagggtgacgtgtgtcacctgaggtagggagatgcattttctctgctcttctgattatcacaatgcttcatccgggcacacacatcatccagcgttctctttcttgaatcagctgtccacgacacttacatgtgtttccaggaatgtggaaccgcataactgtcctctggatgctaaacacagcatgtatctctgtacacaccgaactcttacaaacaccccttaatgctggccacgctctcctgtgagtagcagcgggttctaaggctcagagagcttctacgatgggttggaagtagctcagctggaggtgacggagctctcccttccaagctgacactaagaaccatcttcatgccttttcttcctttgtaggccctttttgtagggagagtggtccccagttagataccatgacccctttcttcagttgtgaaggtttttaggtaccctaaaataatgacatgctccaaggaagtttgtgatttccagtgtcggctagtacaaggcaagatttgagcaaagccggccatgtagacaaagactgacctctggcatcgtgtttcacactcctcaccaactaaacatctctcccacataccatgatggttgacaatgtctgtcccacttccagcgcaccccctcccccaccctccagcagatcccaaagttacttcctggccttttctgttggctcttggcacattggtacccagattgtctgtgtcttgggaattcccttggagtaaacagctgatgaatgtcacggtgagactgggccacccactgaccattgacgtgggtttcaaacagctctgaggagttcatggggctctctatgctatgtcgaggacattcttcaaggctaagggcccccatcccttatgatggcctgacaggaagcttccctcccctgccttgtgtgtgtgtgtgttgtgtgtgtgtgtgtgagagagagagagagacagagacagagacagagacagagacagagagaaacatagggggggaagaagaaaatgaatcggatgaacattcatcttttcaattaccttcttgccgacttgaatttttggtgtaggaaaaaaaatacttatttgattgacagaatattttttcctagtttttcataattcacatcctttccatggctaagataaatattcttgctcattctgtgtagctgtttaactcgtctccagtgttattcagaaagattgctttttaaaggttctgtgaggttggctctataattatgctttgatttattgctaaaattatcgcataatgatctgagagtgtgcatgttgtacaattctctgttttcttctttgaacgtttctttgtgtcctggagtccgtatatattcaagccagtttttcctcgggtcacagatttctggaggtaaagggaacatcgacacccccaccctgccaccagcctctaaatctcatgaatgcaccaaacacatcattccactgcatttcagaacatgtaagttcatcaatttttcagccactaattccataacctgcataacgttgctcatcttccttggggctaacttggttgccctctctgcgacagtggccatcttaaacatctgaatctggagttagttctgtgtcacatgagtcaatggatgctgacctttaaacaattgcttgaggggtgatcatcagtaatttttggtttaagcaaccacttagcatgttttcatccttttatttttaactagctctatatttttctatgtgtgtgaaaatttggcatgttcgatacctggtttttcttcctcctcctcttcctcctcctcctccttcattctttccatccctgattttttttcagtgctgatttccttctctggtaggtgagtgccttagtcagggtttctattcctgcacaaaacatcatgaccaagaagaaagtcggggaggaaagggtttattcaacttacacttccacattgctgttcatcaccaaaggaagtcaggacaggacctcacacagagcaagaacctggaggcaggaactgatgcagaggccatggagggatgctgcttactggcttgtgattgctcagcttgttttccttagagaacacagagctaccagcccaggcatggcatcacccacaatgggtcctcccacccttgatcactaattgagaaaatgccttacagctggatctcatggaggcatttcctcaaggaagtctccttcctctgtgataattccagcttgtgtcaagttgacacacaaaaccagccagtacagtgagtgtttctttcttttggtcattctaagtatgatcgagacagaattcaactacccgaggctaaaagccatctctaccgccaccttcagtttggagataaaactgggatgccttctctggacaatgcagagccttttgatcttgagtctaacaccaccacccccagcttctagcttcccacccaagtcctggtctcatattcttcaggaaaagcattcccagaccttcccggtatcctcatatctatagccgagagtccatcctttcctgaccttctccatcccgcttctgaaggccaccaccaccatcccttcccagccctctctcctccttcctcctcnnnnnnnnnnnnnnnnnnnnttcctccttccactgagcttattcttaatcctttattttgtgacagagtcttactaagttgctaaggctgaactaactggagcctatgttggttttcatcttggggttttcctaccttagcctccggagtacatgacattatagtcttgtaccaccagacccaactaggaccttccttccttccttccttcctccatctctccttccctctctccctttctcccttctttccttcctttctcagtttttttttttttttttttttggtttggtttttcgagacagggtttctctgtgtagccttggctgtcctggaactcactctgtagaccaggctggcctcgaactcagaaatccacctgcctctgcctcccaagtgctgggattaaaggcgtgcaccaccatgcccggctcctttctcagtttttgagacaggatcttactctgtagtccaggctcttggaacttactaccctatgtggtccaggctaccctcaaactcacagcagcttccctgccttagtctcccaagtgctaggactgcaggcacataccaccaggcccaacaagaacggttctttctccgcagccccagctctcctccagttcctttcttctctgcctccgtacctgggactgcactggtcttacatagcagcaccggatttgtctcgagctttgcttgcttccgctttcggatggaaagttaaaggcagtaagatgaaccttcacaaaagttacttttcatgcgcagtctgggaatagcgccccatttagcatggaggaaagcgggagaacaaaagaccctaactgcacatgcgcctgttgcttctgtgcgggaacctggcctctcctgtgctcacccctcgctggcacctcagccttcaggcggcagcagaacgcccttccattgcctgcagcgctgtttcttgtgtctgcaatcacaggggagagaaaatggcaaggagagcagtttcaggcagcactgggttgtctgcgaatgtttatgtataagttggtcaccacctgtttgcattgcctgcagaatccagaagggggagctggccacccttggaactgaaataactagtgagcgctgggaattgagcctgagccctctggagaacagtcagtgctcttattggcagagccagctctgcagcccctccccctttttctttacacatatgctaacagcagtgacagagacacgctgaaatatgatattgaacacaagaagtgccaaggcccatgcccatagctggacaacagtcccaggaagccaccagtttggcagcacctcctgcctttcttctcgacatcatgtctgtcttcttcactatcacatagaggattggaatgagaccttgctgcagatttgattggcgttctgtaatagcaagtaatgttgaataactatttatgtctttaatgaccttctatatactttttatgtgtatgtatatgtgtatatatatattgagacagagcttcactgggtaatccgggctagctatggactcataattcttctacctcgtctcccaagtcctggggacatggctgtgtatcaccacagttagccctatatatactttcttgaaagaaacatctattcacatcccttgggttacctgtcctttgactaggaactgtaaatgtattgtatgtaaaagaccctcatcacataggatatgtaggttggttgtccctggaaacacaaaaggcttaaattgtgataaagcccaatttatctagtttttgtttatttctttatcatttttatttcatgcatgtaggcagttcatgttggtcaccacctgcttgcagtgcctgtagagtccagaagggggagctggccaccttcagaactgaaataactagtaggtgctgggaattgaacctgagccctctagacgagcagtcagtgctcttaatggcagagccagctctgcagcccctccccccttttttctttttctttctttttaaaaagatttatttatttatttatttatttatttatttatttatttcatgtttgtgggtatactgtcattatcttcagacacaccagaagagggcatcagatcccattacagatggttgtgagctaccatgtggttgctgggaattgaactcaggacctctggaagagcagtcagtgctcttaaccgctgagtcatctctccagccctccctgctttttcttttgttgtgtatgccttttagtgttcgataagaagccattgtagaaatcgggtcctgaagaattttacctgttttcttctagtttgtagttttgcccttgccttcaggtggctgatccactttgaattaatacttggcatatggcatgagatgtaggtctatcctcgtgcacaaatggaagttcaggtgtactggtaacatttatcagaaagtctgtcaccatctgtcccctgtctctcccactcacctccccattcacacacagggaattggttttggcacctctgtgacaaatcaattggccactgctatgaggattgcttcctggactgcgtttgattctgtcaacctgtgggctctttttacaccattgccttagatatggaggctttgtagtcagacgaaattaggaagggtgagtcctccaacattgttcttctttttcgggactatttttagcttttctgggttccttaaacatccatgagatttctgtagagaaaacttacgttaagtgtgtaggctaacttgggaatattcattccaaccagcaatatgaagttctctggtctgcaaccatgagctgcctccctctgcatgtagatctttttattaattaattgatgttaattaatttagcagtgttttgtagttttcagagtgtgagttttgcactttccttggttaattttcaagtattctatcatcagtaacgttccactcttaattttagcttttggatttccttcagtgttgatgtacaggagcagactggcttttgcatccgtttgatcttgaatgctgtgatctccctgtcctaggctgtttgttcttatcaccagagttaatggtttcttcagggtttccgatataggagatggtagaatagcgatactgttaattatctctttctcgtctggaaattttatatctttagtcttgtgcctgactggagtcttgagcacactgctggcgagaatggataccttccttcatcttgctctcagaatgagaacttccgtttcccactactgacctcttagttatagagctggccttcctgaggacgccaggcttccttttctctcgagatcttctttctttaaaccataaggggagttggtgttttgctgaactgtttcgtgcctctgttgagaagaccccgtgactctcccctttatgccatggatagagcgtattattacagtagccacttctaagccatcatagcaagtttgggttcccacaataaataccacttgtccaggctgcatatgcctttttctatgactaggcatttggtctggtaatacttaataaagggttttttgcatctctagccaaagagatgcacatctgtttcttttcctgtgatgtatatgtcttgtcttggtatctggataatactgtggagtggtaaagtattttttcctatagctctgtcttcctgaggtcaacgtgaggtccacagccacagtgtcaacgtccagtcacttctaattacttgccactaccacagctctctaagtcacattttaattgtgtgtgtgtgtgctactcattttataatgtttagataagaccatctctttaaatttttaactttaatttttaataatttaaacacaatacactttattatattcttttccctctctcaattcctcccagatcctccccacctccgttaatgttaattctccgtctttctctttctgcaagaaaaaaaaaaaaaacacaaatcaaaataggttttaaaaacttaaagaaagaatgaaaagaaaagaaagtcgagaggaagagagagagagagagagagagagagagagagagagagagagagagagagagagagagaacacattgattaaaaagaaaaaaaaccagctggggcctagcaaacacagaagtggatgatctcagtcagctattggatggatcacagggcccccaatggaggagctagagaaagcacccaaggagctaaagggatctgcaaccctataggtggaacaacattatgaactaaccagtaccccggagctcttgtctctagctgcatatgtatcaaaagatggcctggttggccatcactggaaagagaggcccattggacttgcaaactttatatgccccagtacaggggaatgccagggccaaaaagggggagtgggtgggtaggggagtggggaggtgggtatggggacttttgggatagcattggaaatataaatgaggaaaatacctaataaaaagtttaaaaaaaaaaaaagaaagaaaagaaaaaaaacagccaggcagtggtggcacatgcctttaatcctagcacttgggaggcagaggcaggcagatttctgagttcgaggccaacctggtctacagagtgagttccaggacagccagggctatacagagaaaccctgtctcaaaacaaaagaaaacaaaacaaaaaaacaacaacccatggagtgtgttttgtgttgacctgcctgggcatggctcctgccgtagagtgtgattgatatacccagagactctgggagcaaggtcaaaaggttttagaggagaagaattcggcctagagactgttttatgatcttgtctgaagatctgcctgggacagagcaagttctaggtgaagaaaagtttaagcctagtcatggcggtacaggcccttaatcccagcattcaggagacacggccatgcagatctctgagttcaaggtcagtctacagagcaagttccaggacagctaagcttgggcagaaaagaagctgagaagactggcttccaggcagctaggaggagggtctcaaagcccacccctaatgtgacacgcttcctccaacaaggccatacctcctaatagtgccactccctgggccaaccacactccattggagaaaacaggttttcctcctttgtctgcaggtatcaatcacaaacagattcttagttataggtgggactttgtgtccatttatcctgcccagttctgggattctgtctgatttaaacctgtgcgtgtcttgtgcatgttgtgacagtctctgtgagttcttatgtgtatccgtcatgttgtgtctgaaagacgctgtttccttagagtcatccaccactctggttcttagactccttctactttctcttcagcatagatcctggaatcttggaagggtttgccaaagacattccctttagaactgagtgcttcaacgtctctcagtccctgtacattgtccaattgtgtgtctctgacttcattcccatcttctgcaagaagcatctctgatgaggaatgagtgaggcactgatctgtggatacagcaacgtgtctttaggaggtactgtatagctttgtttctttagcagaataatagtagtagattttcccccctaggaccatggttctagtcttaggttcctggtcactttggcatgtgtgtgttccatctcaaggagtgtgccttagatttaaaacaaaacaaaacaaacaattaccatcagcctggttggttacttccatagcatttgtaccattattacacaagtatatcctgtagacacgtctctgttgagagtttatagctgggggacactgagagttactttcctccttatgtagtgtgaaaagcaccttttagtacatgaacattagtcaataggggtgaaacttctagttgggcaccagctagatttaatggctccatgttaatggcttaaataatcggtatgacctcaccgttaggtgattgagagtagccagtagctgtgacaatagtaacctatgagtttgggagggtctaggagacccctttagccacagctcaataagatgcaacccattccctggaagtttttacttggtggtataggatgtctcccttattatatggtgactgcatttaaatccctttcatatatatatacatatatacatatatatatacatatatatatatacacctttcatttatatatatacatatatatacatatcctatatatatatccatttcatatatatatatccctttcatttctatatattccatatatatgtatatatattccatatatatatgtaaaagcttatacagagtatgttaccctatggctttccaaaaggcctccaatattagttgtccctccttatctcacccccgatgccccactctcccacctccttcccccttgctcctccttactctagcttatctttatctttatcttatactctcattcccttcctttctccatcctcctccccggtcccttccaaactccctaacctctgcaattattcagactgaaatacatgcatctaaagcttaaaagctgccacagaccctctgggcccctttgtctgcatggaacgggtctctagtcgcaggtgggcaaagcgttagatgaaatgacagacagatgtacacaggagaggttgtgtagaatctgaatgtaatttgtcaaattgagcatcaaactttttatacagaagaaaatagggaagttaggtgacacattggcaaggtacagatgaggttacctgatgcttaatgactcttacacaaaacagaggaatgtaaacacaaagactggcaggaactgggcaataaaataactgagacaaagtcagccctatctaaggtcagctatagtcttaggagccaggtgtgaggtctttacactcctagggcaagggctttcactcccaagtcatggttctaattagggagttccgctctagctaaccatctcatgaataatgcattactctaaaaccacagccccatctacttcctaaaccattgtaaattcctgtatatgggagcgacttggcttttattctaagtgatagtgtaatagcagaggcaattctgaatgtcactgaacaggcaacattcttcctgaattctaagcccatggtcagctcaaggactttctaggacattggaacactggtgaaggcttagctatgtcagaattcaatcttaaaaggcacttataataagataatactaaaagagagcactggatccatacactagactaacgtggtattagggtatgagtatatgggttaatgagaacgccagaactccagaaggtgagcttccatgaaactctctgcctcgtgagtggcttttaggcttcacagcctatcaagctgactcgaccagagtgagtggcaaaaagctaaaatccacctcaaagagaaagcatgcaatacttgtctttgggactgggttatctcatccaggatgattgttctgagctccatccatttacctgccaactttatcgtttcatttttctccatagctgagcgatattccaatgtataaatgtatcacatttttgttctaggttgtttcccgtttctggccatgatgaatagggcagcaatgagtgtggataagcaagtatctctgtaataagaggtagagtcctttgggtatatatccaagagtcatatagctggacctctctcgtggtagatctattttcagcttgttgaggaagtgctactctggtttccgtagtagatgtgcaagtttttgtgatccctaacagtgactatgtgatgacttcattctttccagcacttgctgtcacttgttatactgatctgaactattctgatgaggtgagatggaatctcaaagtagttttaatttgcatttccttgatgactaaggatgtcgaacattttaaaagtacttctcagccatttgatgtctcatcttttaagaattctatttagttctatatcacatcttttaattgggttgatgtcttagccagggtttctattcctgcacaaacatcatgaccaaggagcaagttggggagcaagggtttattcatcttacacttccatgttgctgttcatcaaaaggaagtcagggctggaactcaagcaggtcaggaagcaggagctagtgcagagaccatgaaggtatggttgcttacttactggcttgctttctctgccttgctcagcttgctttcttacagaacccaagactaaccagcccagggatggcaccacccataataggccctccccccttgatcaccaactgagaaaatgctccacagctggatctcatggaggcatttccccaatggaagttcctttctctgtgataaccccagcctgtgtcaagttggcacacaaaaccagccagtatagttgttttcttgatgttctggagttgttgtttttttcccccagttctttatatattctagttaatagccctctctcagttgtacaactagtaaaacatttttccactgggttggttgctgcgttattcaaatggtgatgtcctttgtggtgcagaggatttatagcatcgtggggtcctgtttattaattgttggttttaatgtctgtgctctcaatgtcctttccagaaaattctttcctgtggcaatgagctcaggcctattccccgtgttctcatctatcagatacagggtatctggtcttacattgaggtcctttacttatctgaacttgagtttggtgatgtataatagatatggatctatttttgtccttctacatacacctatccactttgaccagtaccatttgttgaagatactgtcttttttttccccccagtgtttatctttggcttctttgttagaaatcaagtgtccataagtgtgtagaattatgtctggctccttgctcctgttccattgatcagtggtgtctgttttatgccaatatcatgctgtttttattataatagctctttaatgcaccttgaaatctgggatggggatacctttagcaacttgtattattcaggaattattcacagttgttttgactatcttgagtttttgttttctataaagttgaagtttttaaaaaagttttattaatcattgtgttggaatttctatggtgagtgtgttgaatctgtagatttctttgggtaggatggccattttcactctagtaaataccaattcacaggcaagagcaatcttttcatcttctggtgtcttctttaatttctttcttcaatgtcttaagttttttttgtgtgtgggggttgttgtttgttttgttttgttttaactatacaagtctttcactcgcttggttagagttatctcaagatattttttattcagtctattgtaaaagccactgttttcctggtttatttctcagcaggtgagttagttgtatgaagcaaggctaccaatttttgttttaattctgctacttggctaaagtgtttatcagctgtagaagtttcctggtggagtctttaggatgtttttatgtataaaatcatatcatctacaaataaggatactttgacttcttccttttctgtgtgaatctccttgatatccctcagttgtcctactgtgttagctaaggtttcaagtactatattgataggtatggggagaatggatattcttgtcttgttcctggctttagaagaaatgcgttgaatctctctgtatttaaaatgttggcagtgagcttgcagagcattgccttcattgtgttggggtgtgtctcttgtatccctgttctcttcagaaccgttacaatgaaaggatgctagattttgtcaaaggcctattctgtgtctaatgagatgactattgtttttttcctgcagtttgtttatgtggtagacagacaacatttactgagttcttgtaagctgaaccacagtgcatgctcttttttgatgttgtcttgaattcagtttacaagtattttcttgtgagtttctgatctgtagttttcttttttttcttggggctgtgtgtgttttgggtaccagaataatagtggctttgtaaaatgagttagaaatttttccttcagtttctattttgtagaataattgaataattggaagagtattgccattagttctttgaaaatctggtagaattctgcactgaatccatctgtccctgaactattttgttttgttaagatttttttttaattactgactctactagaggatatgggtatgtttaaatttttttatttcattttgatttaactgtggtacattatacataacaagatgtacatttcttttgggtcttcaagtttggtgacatacagatttttaaaatattttttctaatgattctctcaaattcctcagtgtctgtagtaatgtctccattttcatctctacttttatcaatttgaatattctctctgtgtcttttggatacttttctcaaagaatcaactctccatttcattgatcctttatattgttgtttgtttctgtattactgacttcagctctgagtttatttttttcccatctactcttttttaagtgctatttcttcttgcttttctagagctctccagtgtggagttatttgtatgagatttctccagggttgtgtttgtttgtttgtctgctttaatttaagcaacttagttctatggacctgcctcttagaaagtccttcactctgttccataatgttgtattttcattcaattctccaaaatatttcaatttccttcttgatttctgtttatacccagttttcattcaaagccgggtgataatcccagcactcagaagacagagacaggcagatctctgtgaatttgaggccagcctggtctacagagtgagtgtcagggctacacagagaaaccctgtctcaaaaaccaaaccaaaccaaccaaccaaacaaacaaaaaaactattttccttcagtagtgagttgctcagttttcatgagtttgtgtactttctgtaatttctactgttgttgatacccagcttttaaaaatcaagggtgctctgacaggaggcagggcattatttcaattttttaaaaaaagttctgtttccatgtgctttcttttctcttatgtggtcagtcttgaggaaagttccacgggctgctgagaaaacagtgtattctttagtgtttgggtggaatgttctggagaagtgtgctaggtctgtctggtttatgtcattatttaactccagaagttttctacttagtttttgtcagaatgacctgcccactgccaagaatataatattgatgtcaaccactctcactgtgctaggggttaatatgtaatttagctgtagtagtgtttcttttatgaacttaggtgcccttgtatttggtgcttagaactgtaaaatcttcttggtggatttctcctttcctatctttcctgattagttttagtttgaagtctatctttttggatattaaaaaagctacacctgtgtgatggcccagggagtggcactatttggaggtgtggctttgttggagtaggtatgtcacttgggtgtgggctttaagaccctactcctagctgcctgaaagtctgtctttcactagcagccttcagatgaagatgtagaactctcagctcctcctacaccatgcctgcctggatgctgccatgttcctgtcttgatgatactggactgaacctctgaacctgtaagccagcccccattaaatgttgtcttttataaaacttgccttggtcatggtgtctgttcacatcaataaaaccctaactgagacaacctgcttgtttcttatttccattttgttggaatagcttcttcaattcttttaccctacctaaggtgatcattatccttggtggtgagtgtgtttctttgatgcagcaaagatagatcttgttttctaattcaatttgtgagtctgtgtcttcaggttggggaattgagatcattagtattgagatcattaatgggcaatgattattagtttctgaagcttttgtcattgggtatgtgttttcccctcctttgactaaccgttgtgggattatttattcctcttgagtgccactaaacttctcctcagactgttttccattttctgttgtgattggttgtctttctgggtatagtagtctggactggcatctgtggtctcttagagcttgtagaacattcatccaggcccttctgactttcaagggctccactgaaaagtcaagtggacctgtctttttatgtcacttcatatttttcccttgcatctttttaatatcctttctttattttgtaaaattagtattttggttattatatgtcatgaagtaagtttcttttctggttctgtctctttggggttctgtatgcctttcgtaccttgatatgcatccctctctctctttagattagggatattttcttctattatcctgttaaaaatattttctgcgcctctagcctgagtgtcttcttcttcctgtatctctattgttcataggttttgtcttttcatgtcacggatttctaggatgttttgtacattgaattttttagactttatgctttctttgactgagctatccatttcttctaccttgttttcaagatctgaaattcttcctgtctttcatctcttttaagctgttggtgaggcttacctctgaggtttttgttagatatcctggttttttttttttttttaatttccagtttgggttttctttagtgatatgacttccttgctaaattctaccttcagatcttgaattgtttttcattatttcactcaattgtttgtgtcctcacagtcttcattaagacatctatccatatcccttttaagattcttaaacattcatattgctattttgaaattcttatcttgcattccagctaaatctcctttctcatggactaacacaatagggttgctgacttctggaggaggcacgttatcttaatttttcaggtttgtgtttttgtgctgggatctaggcatcttaaatgataactgggatctaagcaccttaaatgattgaagtattacttggtatggacatctggtctcatctttgttgggtgggtgtctcattctttggtgttgttacccactttggttcctaaccaggtatgatatctgaggatccctggtagagagaagttttagtcccagctaagtggtgggtgtagggtctctggtagagagttgttttgtaggtcatcagagagtcacaaaagaatggagataggttaggaaaaaaagtctgagaatgactgtgcggaataactggggaccctccatcaccaagaggtctagtccccagggaatagaggcagactgggaggaggttgtcacacaggcaagctgtaaaagggctaagggaaactctggagagtctgggatggaagacaggaaggaagatgaaggtcccctacttgaatccaagcctagtatggtagctgtggacccctgagagagacattctgcaggtcagcacagtcacaaaggagatgagctagaagaaaaggctgaaaaggggtaacaggggagtccctgggtctgcaacaagagcctgagtctctagggtatggaggtaggctagaacagggcactcttgtgggcaggttgcagcaggactaagggaagtctgaggtgactgttctcttaatgaatttgcaaggatcttctccttacaaccaatgtgtactgtattcttgctcttactttgggctttaccaagcaatctgtatgcacagtcctccatcctcggtgaggttgtagcccagttgactgaatgtttgcctactatgcataaagccccgggctcagttcctaccaccacattaaacttggtatgatagcatattcttgtagtcccaggatacctgttaggatccagcaggaagatcagaatctcaaggtcatcctccactccataatgtttaagactacgttacatgacgtcctgtctttaaaagttcaaagccattccttcatcctatgactgaagactggtatggcctccattgtgtgggaaaactgaagtacagtggttagattagttattctaagtcccatggctagtaaatggtggtgttgtgattcaaaccttattcagccctgatttaaatagagcatggctgtcaggccttgagactctccaaggtctaatggaaatggaaatagaacccatggcctggttctgtgtgtttgcaatcactagatttgcatatgacattatagaagaaatatttcttgagatagagtcttgctgtgcagcccaggctagccacaaacccgagacagtctcctgccttagcatcccaagtaatggaattacaggcatgtgccaccacacctgactaggataatagtgtctggatatcccacgtgtgtgtgtgtgggggggtgcgtttctcccttcttgttatctcgtgtcaaatataaatttgcattggctcagctggaatctattgaatcaccactatgtgatcaacttaactctagggcttttcctttaaagatagagttcaaggcacgtgtgaatttggatgggaatatcgctcccctctctctatggttgctagccttcagtaatgagtgtagagacaacctggctggtaggatgggtgatagctgttattttgtcacctgcagaaatgacagacctgtttcactcactttacagctatgtcaggaactccattggcaccacttcaaactcatggatgttattagaccaacctgtctccctgtgttttaatgagaggcacatacagcatgttacctatttgtcccatagttttagaactgagccttcagatggtggctctattcattctgtgcatttccttccatcagcttaaaaacaaaaaccatctgacagacaggtctgcactggttgccagagagaggctccttgttacagaaacaggaatcgaaacctggactaaggtggactcggtatgaagaggaagagagaaactgtcacgccacaatgtctgccgtgtgtggttattggagagtggctattgccttgtaaccattggaaaggcatttgggattgcgtgtgattttcaactgagtcaacataccctccttttctgatggctcagagattgctccagactcttgcaaagtcttgagtcaccatttgaggtattaatggccacagacttcagaggagtaaagaaacagtgccactcacacatgctatgactacagagcactctctgtagtgcaggagaccaatagaccccctccacccctgcccactgagtttcagctttcgtcctcagcaagtgatagggtccttctgaccaccacctatcctatggctttatcgtcacaggggctcctagttgctaaatctcgatttgagactatacaattctcctctgtgggtatttaacactactttttgatttatgttgcagagagtaactataaccaactgccatttatgttatctggctcactgatgataacaaattagcaaatgcttaacaactatctcaaaggaaaactgagtatggctgatccaagcaccggcctggtcttaatggtgtaaatactccaagtgaagccactcttggtagaaggcagatccagtagaatgaactccattgacaaccaggagccttagtatttgggaaaagttgcctatgtgctaaactttaaaaaaataataataatttcagataaaagtaacaaacaaaccaggcttccaatttagcttggaaaaatgggagatctggtcaacccggcctacatctgcacacactgaccattccttgaagacagactgcggatgctcccttggacgctcctttggagcaagctcactgcatcccatgcttctgcccatggctgggtgtcacctgcaattcatctctgcgtttggcttctctcttgtctcttggtttaagcactaagtttgaaggagaaacaaacaagcaatctcattgcctgactttgaatcaaaaactcaagaaagggtcgcccagcaagcctcccatgagatgttgtttctaattgctccctgttgaatcacggggccagcgggggttctcctgataagatacatggagattttattccattttggttgttttccttccggtcatccaaaccagtaggcacaagtgccatttctacttagggtatttaattaatgagactcatccagaaacttgtgaactgtgtggcaggctaaagatttccctctagggatattaaggcccactgactggaaatggtgcaaagtgacaggtttagaggaaactcagcacagtaattaagaacacatcaagtcctgtacagtgagcagatgacagatcatagcaggattaaaaaatagcatctctgagccctccttggacaacagccatgttgactttggaaaaagctcaagtgtcggggaaaggggaaagactgatctctagcctgaaatgtagaatgcccagagtcaccaacatcacgcaggggttggaccatgaacatcaatatcattctttatgattattgagggattctaaggtgctagacatttaaatgtcctgttcttagtggggtagaatatttccacagaagatcaaagaataaggagttggaacagggtttgctgatgtgtgtggagactctttgggctaccggcacacctggacatctgcctaacaccagtggcagacggtatgatttccctaagagtccctttcctctgacagccactgtaatgggagcacagtggtcactcagttgaactacaggtgaagacagtgtgaggtttcttttcttcataaaaaaaaagatggttctctttcttgccatcagtcagagaggcaccagagtagagaggacttgattaccttgcttccttttcctgcttattaacctgacagagtctcatctcatgtcaattgatggcacttacccgtccccccacctcccatcaggtatgcaccatggcattatgcgatgttatactccaatatctgagtataaaatccttcatcactgagaacttctgaggggattatagttttgcctacagttgtgtggtttgttgttgtttggtttttgtttggtcagtttttggttttttcaaaacagggtttctctgtgtagttctggccttgcaaaagataaggcttcctgtgcaaagacatgaacagttgtattgtcagaaaatggctgtgttctctgtattgcctctgtcagggcccctctgcttgcaagtttcaggagctcacttgaactggctcaaaacaaatcatgaaattctctttaagagcacaaagaactgtggggcagggagcacaggtgagccttgtgggaatcctaaaccaggtagaaaccagccagagatcagcagccctttccccccagcctctttcttttgctctgctcatgcctgtgctgttttttaactcttccttttggcttctgctttctgatcctcctcactccaggctgctaacggtcactcctcagacactgaggttctatctcctcagttgacacaactagcaattgccttctgtttctttgtaccaaatctacattcttgggggacggggggaggaatctgatgagcaaatgtatgtcagctgtctatcccttgtcaaatcaagtgatacctgtgggtggaaacagggccataccctcaaatcttatcttctatgttatacctcttagtataagtcttacttcctgtatacccagaggctcctttcccagtataagcaaacatttatcaatagtcacaagccctacccccatcctcgatggagaatattccaagtgctattgcattgccgcaagaaggttctcggattctgaatgtgtatgtccattacctacaaacataccagtatattacaccggaagtaaaaacaatcacactaacatttccccttcagactctgtattgtaccacagaaacacctgcacatctgtgtttactcgtacacattcacagtagctaagaactatttatagctaaataaaattccatcaacaagtaactagataatgaaaatatgttatgtacatataatgaaattttctttagctataaaagaaaagtgaaatttgtagaaaagtcatatatgtataaagtgttattttaggtgtggaaaagtacatacatctgtaaaatactattttaggcaaggtgccctatacactcagaatgacagtatcacaggttctctgtcatatgtggaccctagctttcagtgtgtgtgtgtgtgtggtgtgtatagaggctatgaaaggaggtaaaggaccacaagaggaggaaaagaggtgtgtgggggggagcaagtgatctaacacacatgacatgaagaaatatgaagaaaggagatactggctgtggagagatacacggacagagagaggtatatgggttatttttttatctatgatttaaacaaaaaaccctaaagcaacatatagaagagtttatctgagataacagttccagggggataagagtccatcatgtccaggaggcacagcaacaagctgagggctcacatatttcaacacaagttgggagcagagagagaaaactagatgtggcttcaaagtagccacccccaagtgacagacatacttcctccaacaaggtcatacctcctcaacctcccaaatggtgccaccatcagaggaacaaatgttctaatatctgagcctatgatggacaggctcattcaaaccatacatggggagaatcaacaaaagaattaaatatatttcttacttaaaacaattttatgccataatgaaacctagtactttgtatgctaatttttaaaaagtattagtttttaaaaggccctttagggaaaggactagagtataggaacccaccatgcatctcacatccatttgttatccattggctttgagcataaacagtatccaaaggtcaaaggtaacatgcagctctgaaatacagacttagatttaggagggagtcatcattaaactccagctttctcaagatgacctgccccccaaggcacatgagtggactgcaccagcacagacgaccctctaggtctctctgtacctccttatggtcttcagtctctctactgctccctgtaggaacaactaagctaagggttccaaaagcttttaaaatacaaactcaggaggtggggagatggttcggtggttaagagcacttgctattcttgcagaggatctgggttcagttcccagcacccatatggcatctctcaatcatctgaaaaatccagtttcaagagatctgatgcccccttctggcctccacgggtacctgcacccacatggtgcacatacagacaggtaggcacacatacatgcacatatatatttttttaatttaaaaatgaaatatgaactcagaggatctgggtattcttattgcagggttctctaaatatcacaccaaggctattcatcatagacatagaaagcagcacacttatttaaatggttaattctttgtcctttgtttccattgttaatttaagtgatacacaaaagttttctgtggtttcttttgctaacgttttaccttcgttattttgattatcctgtgcatgtgtgtgcatgaagggggcacgagcgtgcagtggctcatgtgtgagggtcagaggacaacttggtggagtcagatttctctttctacttttacgtgggtttcagagatctaacatgggtcagaaagttttgcaagaagcagttttacccagtgagccatctcaggagtccatgtcctatggcttattggctcccattgcttaggataaggttaaattagaatgttaaagtactacagtttatataacacattaaggatgtgatatctgaggctgaaggtccacatggccacatcacagagactttctgaaggacagaaaagcagctttggggtttctcatccattgaggggtccactccaaatgtttagaaaacaattttgtatttacctttgaacttaaataaaactcttaagtgacttcttaaatgtccctgtttctttaaaaagcactatctgcgggggggcttcagtgtaactgcagggggatgtctctaaactatgttagcaatactaccttgtgtttcccctcagcaagaagggatttccagcacagttgaccttgtatgcaaggaatgtcccccagtgctgcattgccacttactgtgaacaacagcaggtgtggagggtgacagacatgaatctgtctccatccctatcccagtcaccctctcagtggctttgttagtgccctaaataagtctctgaggcattaggtttcttgttaatgggttgcttttcataaatgatgaatatggacatttcaaaaataaaaatattaattagtcgagtgtcaagaaactagatgttgatgtgtctacacggtaagttattattagaaagaagcttcgggttcagtggtcggctttggatgttagaggcaactgtttgtgaagctaagttctatgggctctagacaaggctatctatggctattgcagagcaatgttaaccctgcgtaacggaagcagcatgactacggggtgaaaaaaaacctcacctcacggtgggtacatagactagaagtgggcggcacgcttgcataattattcagaaaggttctgagctcgtgcctgaaggagaaagtcacagaactgcacattttctcttagcaaacaagtgggatttcccctccagggatggctaatcatatcaacagccccaagccaagtattgctttttggcatacatacatacatgcatacatacatgcatatatacatgcatacatacatgcatacatacatacatacatacatacatacaagatttactccttgtaggacggatacctggctaacggtgctgctgtgaatccctctccagctgctgttccaaactttagcaactcttctcttcccttccctgcccgatattaaagtccccttgcacggtctatgttagtacctaagggtcaccaacaggtttctctttgcagttcatttcactttggagctcagcacatagatcattttacatggggagccaaggactggatccattcagaaagactgaataactgcatgcaggaaggctgggccaaagaaatgagtccattttcccacccgagaaactccacgatccatgccagggatctctattacattttttgggtcacttggccagttctctcatcgcatcagtgttggccctgataaaacctaaattggaagttgacttcacaaaatgaaatctgccttggaacaagccactctctgactggtcatgctgccctttcttctggagaaaggattgcttatctgaacaaatagacccctcccccaacctattcagccccaaggatattaggcatgtggcctcgggatgcagaacagtgggtcacacaaaggaaaacagtaattctgtcagttcagttgtgatttttttgttgttgttgttgttttttagctccgatgatctgcatgaaatagtaaaaggatacttcccttttaaaattccacttgcttctgagattttggtatttgccactccccctctcccccatagaagatgcctctttgttcttttagctaagtggcccccagcatgtagagggaagtacccatgcaaggctctctgctccctcgtgccttgtttctccatctgtaacatggcgttggtaacagtaacatcagagtagctataaagaggaaataaaacaacgcagatgcagcattaagagccctgactgagtgcatgtgatacctgcttgccctttagtcccaggacaaatggctgtgagactctatgtctaaagtcttggtcggatgttccagcatgcctctatcggttacttattccaaatcccctaacaagaaacatcccaaaggacaggctcagccaattaaggttcttgctgctgccagcctgatgacctgagttcaatctccaagaacccttgtgatggaaggagagaactctcataaagtaaagctttgttctggcataccgttggaagggatacaatctatcgtggcagaaaaggcctggcggcagagaccggaagctgccgatcacatgacatctagtcagaaagaagttaatatacttcacttcatgagggttggctgtaaaacccgagggctgggttataaaagtccagggatgcactacttccagcaaggctccacctcctcacggttccaccaccatcccaatagcatcaccggctgggaaccaagtgtccactcacgtgagcttatggagaagactcacatttaaaccacaatctatctgtcctctctccctccttctcccctctcagaaacattctcttaaacaaacagtgccagtgaggtcgtcttgtcctcacgtggcaaagccagctctttgacttgggaatacccctgtttcaggaacaccatcttttaaatggacactttgagtagataggtgctgtggtgattctggctattgtgcagtcagcagtgatgcagaagcagcattaaacacagccaggatgcagagtcccttataggtcaggtccaggatatagctttttcattgaatagaggactttcagttatgaatatgaaagttagagcttagaaacagggaagaagaatcctgcacacgcaggacttcccagcggaaaggacaggaggcaagcctggatggacagactccatcaactccgttccactcagctcagccacattcagagcactgtcatctctcctgttgccatcctggttattgaactcaatcccatggatgcctggatgcatattctctcctgtgtctgcctgtgaaagtcttccatttatatagacatggcctctgggaactgaagcatccatggatcttccatgtttgctttcatatgaacagggtttaatctctgtatcttctgttttcccattgaattgggaagtgttagtcttagatctaaggcatcagatttaatgttctagttaggtttcccattgctgtgaagagacaccatgaccaaggcaacttttataaaggacaacatttaattgggggtggtttacaggttcagaggttctgtccattatcatcatggcaggaagcatggcagtatctaggaaaacatggtgttggagaaggagctgaaagttctacatcttgatctgaaggcagccaggaagcagacttttctcctctctgcactgggcagagcttgaacataggacctcaaggcccaccacagtgacacatttcctccaacaaggccacacctattctaacaaggacacacctcctaatagtgtcactctctgtgggtgaagcattcaaacacacgagtctatgggggatgcatttctattcaagccactacatttaaggaactgagtttctgctaatgttcagatttcgagagtcacctgggttattttattcaggacatttgcatcgaggatatggaggggatgtctggcagatgagaaatccatggaaactagaaccaccctgtaaagaaaagggctcatcttccctctctcaggtcaggccagtcaacaagcgacatctcctgcaaggcagactccagaatgcctgctggtctcccagcctgatgaaagcacagaggtctccaaatgtttcagcttggcccctggacttctaaagacccatctgcacctggccatggttttgtcagcagggtcagcctctccgtgtgtccatcagccttacctccttctctctcctgatcctcgccctctctgtcagcttgaaaacctcattcgtcggcccaattttctttccacatcagtttccctcttcttggctcagcctcctaatcttgtctctcctcaaggtcatctccataaaagcctggctgccttctttgtatgtctcttgactatatattacctatgtttcttttggcatcagggagtgaattattcctagtttctctttgggctttttttttttcctagactgcggtggcattcaatattttttatattgtaccaaacgatttgttttataggctgttctctgagtttctagaagccttactgaaagcacaaattctctgaagatggcctcctctcttggcacagcaagcaaccagatggcagtgaggcacagcctgtgtgttacaacacaggcgcctatgtttgggaagtcctgtgtgttacaacacaagctcccatgtttgggaagtcttgtgtgttacaacacaggctcccatgtttgggaactccggcgatttgcttgataatatgatcttagttcatttttggaagccttcatgtgatcacctgaattctagaaatgccatacaaagttgacacctctgtgatgttctgccagcccacatgtcctcaagggatggctaggttaggctcaaggaaagttccaccccacccaatacctaggtgtggaagggaggtgggggagcccccaggaagtccctccttggtgagatgccattgtcttgaatttggggatgactgcttctgctctgggatgctgtctacaagtctgggggcagcactgggccttcccacatacccagaatgcccggcactaccatttccccactcgcagtattgtctcctaatcccaccagttgcttctcccttctgcctctttgaacttcttctctgagctctttcggaaatggcaccacccttcacatgaagacgtgagaaatcctctttcctctacacgtagcagcccagccttgtctgactgtccttcttggtagggagggtcaccctttcatgtgcaggataagacaagtgacagagcagccaacatgtaaacagccaaagtgcataactatagttgatggagacactgtgtttgtgtcatcagtgcccacccaccctgtaccagagtcgtcattattgaggatatcagtgttattgacaggttagagacccaggccctggcttgttacggacaaaatccacacattctagagtcaaggaaattattagttttcttgccatttcctttaaggcccttgaatccaactctgaacagacaaggacaagcagtaatttgtgtctacagagagctgggaacaaaggctctgtttattttgtaatttctgtatctgcaagaaaaagatcctgcgttaactataatgagtgagtcaagcaaaggtttggtgctttctcgttaggctgtgtgagtttacaaatcactgtctaactgtccaggccttggcaagggcagaacaaagaaggaaagaactctccagagtaagccaggctgggttggcagtgcgggggctgggaggccacccagcagcttgcaggtggctccatggagatctggtctgctctgtgtgggtcttcactgctcctgcagctttcagcacccacctcccggggctctcattgatcagagtatttcttctcaatccctgtcatagctaaaaagctcatttataggtagaaatttttcttatgaagtgtcttatttattgtattgctactgtgacacaatacttgacaaagcgactttaaggaagaaagggtttgtgtgacgaagagagagatggattcggaggctcagttggctttcttcttcttatgtaacccagaacacaagcccaggaagagtgatgtgcacatttagggtgggtcttccatacctcaattaattaagataatacctcgtagtcctgcccagaggttaacctaataggtaagtcttcacaaatatgtccagaggcttgtgtcctgggtgatgatagttcctatcttgttgacaatctatattaacagtcacatacaggatgaatatttatgaataaaatattatcctgaatgacaactttagattaaataaaccatctgaatgacataaataaaccatgtgagtatataattccaaaaggatagcatattgccttgtttgcatcgatgagacaacataaaacatttcgcaataagacgctacggatttaacgtatcactgctaacatctggccttagtgaagctaagttctgcattgtgaatgactgtcaggagctggcttatccatgaatatggctacgctcaccactgcaccattgaaactgcctggctctgcacacacctttttttataagagattttatttttgattatgtgatcccttgtgtaggggcatgtacatatgcatatggtacatagctcttgccatacttcaaacacagttatccttcagggtctacaggatatcggttccaactgatactaaaagctaaggatgcccaagtgttggcatcaggatctcccagacctgttgtcaagacaatggccaccatattcccagaatccatttgggctcccctccaacctttaccatataaataaggagagcgcccctccctctctctctttcctccttctctttctgctgccaccttgtctttccctcccaataaaacctcttccatgtggaactgtcatgacctattgtgctattgagactcgaccagccattctaacacgtcaccaagtcccccatgtgagatgctgccataatcacagtcaacctacatacattcttgtgcttcacgtcttctccagtggccaatggccatggcaggtgcaaagctatcaacttgtgttgtttagataacaacgatgagaagaaagttctgtgtatgttcaatacagacgttttcctcaaatatttttagaggttggatgactcttcagctatggaagccctggaaacagaacgccacctggaaaggctgactgtccctgccagctgccttcctggaaatgccaatatatactaaagttgtgtgttaaagaagtgtttatttgtaaaacaagaactagttaggctcagatcaatgtagacagactttctatatgctggaaaactcagccaggcttctggaagtcattcacaatgcaaattaattctttaatgtcctgaaaacctcaaatccctggcttctgcccaccaaaagctaaattgttatgacaatccgaccacctgacagatacatttccttagtgttgtgcgggggcagcgtggtccctgctgaaggcagttcagttccttcagcaaactgagaggtatgtgtgcaaacaagctaggaaatcatataaagcgcatcaggttggggacctgggggtaggcagcaatgacaccacattctaagtgatgtctgctgttaatctaggaccattgcttgagttacagaaagtcccacaaatgtctcctgggccaaattctaaggattcatctctgtctctgtctcctctctcccctctccctctctctgctctcctcccctctctcctctccctcccctttttcccttctccctccctccctcccccctcccttctcccctctctctctctctctctctttctctctctctctttctctctctctctctctctctctctgtccctttgagaatcatctgctatgagtgacctgggtgtttgtcaaaaatacacactgctgggtcttgggcgctaaatcaggagccttatgtatctgtgtctcagtgctcatcatcctgagcattgccccagacgatttcacaaaagtcaagaacccccataatctttgaggaactaagctctgttgttctgtcttagtgttcttttgccgggaagagacaccgtgaccacagcaactcttataaaagcaaaacatttaattggtgcttgcttgcagtttcagagctttagctcattatcagtgtggaaggaaacgtggtgtcacacaggcagacagggtgctggagcggctgagggttctacatccggatccacaagcagcaagaaggagagagccactagacctggccctggcccttgaaaactcaaagcctacctccactgacatacttcctccaacaaggccacacctagtagtgccactccctggtgaccaagctttcaatctttgaatctatgagtggggcagggtcattcttattcaaactaccacatgcttcattcaaaacgcaggtgacaacctgggatgtccgaccaagctagggagtcaggcactccactgaagttctggggcttttgtgtgccttctttggatggtgggtacttagatgtccaagctatttgtttattctcttttctctgagcatatgttacatttcacatccacatggctaaaaggccttcctctctgtggctttaatagatgtagtcaattagcccagggaaggataaaaagtcttactcccggctacttgagcccaattactttttctctcccagctgtggcctttttctattgatttcatataatccaacagtgggagaggacagttgagggacacagagaactggccctttttgttgttttgggaccaagcaaagagagtttgacctgtatattttcacgaaaggtcatttgggggtgttgagtctctctgcctctgggtgcaaatgtcctccctccagcctcagacgactgagtcacaatagtaaagccactttccttggtttgtggcagtgggtttccatgtccctgcaaagctcatactgcattgtcctcagatgaatggcctttgctaattgttgttcgcctgccaagacacaagcgagagtctctggaccacattcagagtctcgatgtcagatccatgcctcctgtgcctcccaggtcgctcaaaggaatatgggcagtagaactgttgtcaaagaaaaagcaaattgtccagaccagctgttctcaacctgtgggagagggccatcggtccaatggtcttgtaaatgtttacctgaaccgaatggaaactttaaaaaaattcaagcagcttgtgcaggtattcactaaagagaatattgctttcaataaactttcttcagtgttggtcaaatttagatgaacatatattgttataaggacagaaaaaaaattagatttgaacattcaaaaatggtgggtaacattttgactaaactcaatggaccatcttaggctggtcctgagcagaaaagtgatgctgatgttcatgagggtgaaatctaaggtttcgtttttgggtttcggttttatcaaatgtatcatgggagtatgagattttaacattatatctggtgaaaaatgcttgggaatgttctttaccagctgaacaacttttctgtagatggaaaagcattttctaaaatatagcaggtccaaaatgtcctatatcaaaaccaaaagcaatacatccattgtgcttaatacccacctctgtgctccatggagtccattggttgggccggttaatttccaaaggcttcctagaggatcagacctcttgatatgcctgcccagtcagcttttcattgctcatcacttcaaaccagccttccttgacttccaagggtgtagtcgagagcccacagaccctgctgtgtgttggcatcaccagaggaatgtcaacaagtcttgatggctcctgtggatcttggaaattctgtcttgcatagcctgggcctggttcctgggaatctgaaaaccctcccagtggtcatagagagcagccaaggtttggaaaccagtatgaatgtagctctcattcctcgtagtcattgaagaacatgaatgagccctgccttggtgacagcagccagtctccattcttgggaccagtcagccatcctcctagtacacctgcagataggtatggtgcaccctgtccgtaggcaatggtttgggtccatgttctctgtctctccaccagaacatgcaggctcctttttctctggatttccttgtgtcttacccttgaaagtgaggatcaaattgctgggttggtttttttgttttcttgggttttttttttgttttttgttttttttttttttttctttctggaaataagatgtcaatgcccatctgagaggccctctgctagctaggtatctctggctctaactcagaacaacctttcaggctggcgttctcttttgctaagtgaccctcgtggctctgcaggcccctgcagattcacttcagaacccttgcagaacaaagttgtttatgaggcagtcccatgtgtcctggggcagagccaactcttgtgcttgtgcttgcagctgacgtccatcaaagtcacttggcttctaccaccccagtgtgaactctggtgtccagttggagttgtctcttcaaaatactgaggtttgggagctgggagatagctcagccagtaaagtgtttatcctacaagctctaggatctgatcaccagactcatgaacaaagctgtgtgtagtgccatgtattgggctgtaatctgagtattgggcataatcccaatattggggattcagggacaagagggtttctggggctctttgaccaaccagcattacagacctggtgaaccccatgtatgagaggtcctgtcacaaaaagtgacaggggtgtctcatgaagaacaacacccaaagctgacctcgggcctctacctgaacacgcatgtgtgatttttaattgaggaactgtgatgggtattcttggttgtcaacttgatcatgtcccagaataaactacaatgatccagaaatgagggcacccctgtgagagactttcctgcttggatggagtaggtgaatctacttctagtctggacctttgaggcaggaggacaccaggcttttaatccacatcctgaggggggaagacacacctttaatctgggcctcaccttctgctatagcacatccattcttacactggcattggagcctatctctttgggattatgtgtagatatgtatacatacacacatagatagatagatagatagatagatagatagatagatagatagatagatagatattcaatccataaatctgtgactagagaactctaacacagggtgtaaatgacttcatttcagctcctagatgtccctactcatctgtttgttcttgaaggctgcttggtttagggcatcaatgactaaagacccacaggctccaagctcctgaaaggagggtggtcgctaggaatatgagtctagacatccctcagattttctgggacagctggccctctaccaatggtgtctggtactttgtgtatttcacccctgcagtgtatcaagagcagtgcttcagaaaagaagccttcatgaagagctgctcggggacttgcaaagaactcatgctgtagctttaatcctggcaagctggagccagagggtccaggtggtgccggacagtcatttgtgtgttttacatactccctgggtggggggggtggctttttctgtgaagaaccaactggtaaacactctaggcttgcagaccatatggttcctgcttcagctgctccgctctgccatcatggctgagagcagctgggggtttacttagaggaatgtgcatggctgtgttcccaaaacgcttgatttacaaaaacaggtaacagctgacttacttagctcatgggccatcgtttgtctaccccaataaaagtcacccggagagctctaaaatgttttccctgtgctccggccaattaaattaggatctctgtgggtggtgtcaggccctggcatttgttaaaagctcttcaggtgattttcaatgggccaggattaaaaactactgttgttgatccctgtcattgtgtagatctgctgaagagcggggtcctgctctaatgtaatgtttagcttgctccagaaggcttgctgctcactcgcgcgctctctctctctctctctttcttcttcctcttcttcttcttcttcttcttcttcttcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcccctccctctccctctctctgtttcattaactgcaagaagtccaagcacattcttctatgcctgccttccaatcatatctttagagagataagacataaaatacagccaaacttatgaatctgaagccccctgctgggaccttgtgctgcagctggtgcataaactactcactgaatccttgtaactgcttcttgggtcaaaactaaaaacactcagaggactcctctggtctttccataccgtagccgcctaaagtttcctgaaagccaggcaggacttacagttccagagagtaagggtccatgatgatcaagcagagaggcatgtcagaggcaaactagcaatggctccaatctttaaacactccaagcacaccccatgaaacatacttcttcctgcaaagccacacgtcccaccctgcacaaacagcaccagcagctggagaactggtatttaaatgccagagactatcgggagcaattatcattcaaaccaccacaacacacacgtttttacgtgttcttgtatcaatatttgtggggatctgccagaatttgaggagttgccctaaattctgtgacaaattttacatgttttagagtcatgtctgttgctgtgataaaatgccctgacagatcaatttgaagaaagagcgagtttattccgtgtacaactccaggttatggtcccccgttgcagagacatcaaggaagagctttgaagccgctggccattcctgcagtcaagcagaaactgaatgcatgcctgcttgctactccgatagctgtctctctattcttatacaacccagggccccaaaccagggaatggtgccatccatccacttccagcctgtgtccttcccataccagttaaccagtcaaggcaatccctcacagacatgcccaccggcctggtgatttctaggccgtgtcaagttgacaaaccaaccattgcaacatctatcagcaaccctcgaggcttccaagttctccacattctgagcagctctggttcttcatttcttacattaatactttttttaaattaatagccatcctagtgggttttttttgtttgtttgttttttttgttttgttttgttttgttttgtttttactgtgcttgtaacttatattttccaggtcattgatggtattgagcatcttctcaaatgttggtaggccgcctgtatgtcttctttgggggacatctacatcatatcctttgtctatgtttaaattgggttgtctgctgctgttgatgtggatgtgtgttgatttggatgtgtgtcatcccagtgaagatagccaagtgatccttgccaagaactcaccgagttttagccacctctatttactcagaataatcattgaatctaccttacgctcatgaaaatacttccataaaaaagcttggagatgagccggtttcctggtttcctgatttcctggtttcttggaaaccagagttgacaagcttgctcggtagtcctgtgcacttggttcatgacttagcgttagaagtcattaaagatcctcgtctcagcaccggtgactcttgtgagggtcatgggcatggttaactgcccaaagcctgggcagaatagggaaggaaatgagtaagaagtgaaattagggtgtctgggcaacccctcttcttgttttcagtgtagctgatgtggctattttgaggtgccctctgaccaaaggacaaagagaattcttcatcactagtgtttgagccaactacctttctcaggagctaaagcaatgcagctctttgacccatcatcccccatctgcagtaactctcaggcctttcttgtacctctctttaatggattttagaaaacttgccccctctccttttttaagttaccaacctggttttatcataaatgtaaataattggtggaatggatttttaggcacaaactattacacgttaaaaataaacccaattaagtcttgatggcaaagcagtgtggttatcgataaaccacatgtaaaatacttgagccagtaactttaacataaattttatattgtcttattttctttttgaaaccgaatgtccttccgtctctccagaaattcatgatgacacagcgtgttttatacttaagtttgtgactgattacgattactttatatcaaaagcagaagttgaaatttattttttacaacttctcctgtgattataaagcttgcatttttttcccgtaagatttctttctaattgagcaactcctcgcttgataataatgatcaaaagcacaggagtatttgggtacttactcaaaattaaaagttcattgaaaatacatccctgtaagagatttgcaacttttctaattgatgcattgttaactgactacgttttaaaagttagtttgggttcaattttattcattattttctacctaccaaggcttgtttaaataggcaaatggggatggaattttatttgacaatgccactcaactcattgaatgccttctgccacacatcctgaagaatgaccccctctgtgtccacatcctagcccctaaaacagatgaattggaaaaaaaaaaaggtactgtgcagaaatgatcaaactaaggaaccaggaatggagagaagatcctgtgttatcctgtgggcctgcggcagtcacaagggcataagacacaggagttcgagtcagaagagatgtgccagaacagaagatgagaagaaatctgaagattggacatgagcttgaatgtggaggcaggagccatgagccaagggatgtgaaggagacaactgtattggttactttaagagtgtggggataaaatgcctggccaaggcaacttacagaaggaaagatccatttgtgcttatgattccagagggatgggagtttgttggacattttggcaacagggggaaggcccagcctcaggagtagctgagagctcacatctcaaaccacaagcaggaaaccaaaagtggactggaatggcatgtgacttttgaaacctccctagacccaagtatttgggtttttaaggtctgagcacacttgggtaattaatcatctataggtttcaggaaatggacatttggtgaggagtccattactggcttgtcacgttggtatagagtgccttgtgtcttaggcattcgacagtgactaagtgctctaataaaagcatgaaaaagtccagcaagctgggtgcacatgaacagagcactcagtgcccccggctgctgggtgtcttgctgattggaaggttttctatgtacttaagagcacattatgtcctcctgggcagacagcatggcggtttagaacaagagcaactgagatctccacatagaatttcaattatatgagattctcgggttggttgaacattagaattgccaaggagcttagaagagagtctatgccagggccttccacagaccatttttacaccaggacctctggaggctgctggtttagctatttgctaaagcccccctaggtgacattgaaaaaagagtagagccattggcttggaattaaccacatctcttatgtaggtcttagcctgtcctgattccttttgttagggttcaaatggtccccctacctgtctgcaggttgaaatctcaacatgtggctgtagttggatatagagggtttgataaagtcattaagttgagttagaaagtggacaggagaagccacagattgcatcctcagctggattcagccctggtgatagcttgatctcggattcactctctgggctcacagtctccagacggtaatgtcatttcagcagcccaggctagggaactttgctgtggctgtcctagcaaaccaaaccagctgttgctcagtgggcgtggctgtgcttccttcagtagaacaaattcttaggtgagggtttgtgtctcaccggttccttgacagagcagcactgcactctaagacatgcaaccaaagcaacacaaagggagcctaggccgtcttgcttcagtcctgacagttcattgtgtgcctctgagagaagcctcatgagaccactgggagatgtgaggtgagaagcctgtggctgggaaatctacctagatctttccagcactccagttcctggactggatgagaaggcttcccaagagtgtatggaagggaaaatagtaccacagaccaatgcctgcatttcccctctatccgttctgctgtgacactctgtgtgtgtgtgtgtgtgtgtgtgtgtgtgtgtgtctatctgtctgtctgtctgttcatgtgtgtgtgtttgtagaagccagagaacaaactggcctagaattctcaaaggaggctaggctgtctgaccagaaaaccctaggaagccgtctgcctcaccttcctgaagctgggattacaaagaattaacacaggatttgatttaaaaacaaaaaacaaacaaacaaacaaacaaaaaaaccatgggtttgtgggatcaaactcagggatttttatctttccaggtttcgataatgatttgtgtgtgtgtgtgtgtgtgtgtgtgcctgagtgtgtgcatatacaccatgtatgtacaggaacctgcagaggtcagaaggggcactggatgccctggaactggtattttagatagttgtgagctgtcctgtgggtactgagaactgaacctgtgtcccgtgtaagaacaagtgttcttaactgctgagccatctctccagcttccatgggtactgggaactgaacctgtgtcccgtgtaagaacaagtgttcttaactgctgagccatctctccagcttcccctgccccatctgtgagttttaagattagctctaaggagttgctggtttgtgctcttttggttttattgtggctttaggcagctggcgaatatccagtttcaaacaaagcccagcatttcacacatgatccctaagatcaacccagctggaaagcaacagcaggttaccagtgaaaagttttaaaacatattcatacctaagccagcacaatggtgtatacctgtgatcccagcactcagggaggtaggcaggaggatggttgaagtttgaggatagcttgggtaccaggccatccaggatggtatagtaagatcctgtctcatgtatatgtataaattcacataaattttctctaccatcagctcagctctggtgtgtgtgtgtgtgtgtgtgtatgtataccctaatattcagagatttcacttctgcaactcaattctaaagagaaaatgcttaatctagaagtagccttatttggaaatacattagcggcagtgggaaatcagctccagtttaaatgtcccatacggggagggacaaataaaatacagtacgtgcctgtcatagactatgaagaagctaaagatgtaaaaaatatctcaatataatacttacataataaaaagacacacatacataggttagaggtgtgtgtgttgtatatgtgtggtgtggtgtgtgtgtagtgtgtgtggtgattgtggtggtgtggtgtatgtgtggtgtggtgtgtgtgtgtgtgtgtgtgtatgtgtgtgtggtggtggtggtagtggtgtgtgtgtggtgtggtatatgtgtggtgtggtgtgtgtgtgtatggtgtgtgtgtgtgtgtgtggtagtatggaatgtgtgtggtgtggtgtgtgtgtgtgtgtgtggtcctgtgtgtgttttggggtggtcacataaaaggctcacaccacatgatcatgaagcaaagccttggaaagtgggtctatgggctgtctctatcttacttctctgagttcctggctttgtttctatcgtgagcatacccatttactatctaggaaaataaaatacaattagtgtaaaataacccatgaccagcagcagacacagggctgagggcccactttgctgagaggtcctgctttcccaccacaatgatcaagtgatcagatgtcattttacatgctgtggcatattgacatccagccctaggcttcccatgtgtggtgtgtgtgtgtgtgtgtgtgtgtgtgtgtgtgtgtgtgtgtgtgtgtgtaacacatccttaggaaacctcagtgtttaaggggagcaaagggcaatagctgccatatgtggtgttagcaacttgtctcttcccctttaagaaaacattcattgatttaacagaaacctgtccatgaaagtcaatattcacccaagcctgcagctctggtaatgagtgtgtattatccttatgctttcctgcatgctgcagaagctcttccctctgtagtaagccgggaatcgaggcatgggctggttccttctgctctcatcgtctgttagtgcatcgagtcctcttgagaaagggttgcaaaattcccatatcagaccagtaatctatagctagtgccatcaccgtcttcctccaactattatagagctggcacattggtcagtctccatcactaccacaaaacaccccagataatcagcttataaagtcaaaaggtttatttcggaggttctaatctatgatccgttggccccgttgctttgggtgtgaggtgagacaaaacaacctgctggaagcaggtggaggagaaaatccactggcctactggtgtccagaaatcagaagaaatggagactagagtcccagaatccccttagaggtcatcatgcctctgatgaccaaggaccatccaacacattcccggggatgaaggcttgaaccccaggcgtttggggagattcaagatgcaatcagtaacactgcctttccttcagaacgcatcctcctctcctcattggagggcctcctgaaggaactgggcacttggtaacttagaacaaaacctgtgtttccctgatctcttgagatgagggagaacatgtggattgtgtgtggccatctctgggtcacctatgctctctccctctcgtggtggtgtggcattcaattctttaattaatatatcaatttttaaaaccaatagttttcttttaaattttaaatgagctttgagttagaacacacaatgatgagtgtattttgacattttcatgtatatgcatgtgtgtgtacatacacacacatgtatgtatgtgtgtatgtatgctgcatccctccctcctatctcttctccctcctcactagttcccttatccatgaaagcagtcttccttctgctttcatatcacatacacacacacacacgtatgtgtgtgtgtatgtatgtatgtatgtgtttgtgtatgtatgtgtatgtaattattatagtctagatggtttatgaggaaagtaaacagtattttatctttcttttctcttattaccctctcctgttccctatcccccccaaacctttaagctacctcctcccctccacagtctcccttgtatatttatcttaaattaatattatttgaaaatgacaaatcacaattgcatggcatctatgaaatgcagtatgatacatatagccagtgtggatgggttgaaccaagctcacatatctatctatcacctcacttaacatctttgttacagatctgtactggctggttttgtgtccgtttgacacaagctaacatcatcagagaggaaagagcctcagttgaggaaatgcctccatgaggtccagctataagacattttctcaattagtgatcaatctgggagaccccagacccttgtgggtggtatcatccctggactagcggtcctgggttctatgagcaagccatgatgaacaagccagtaagcatcatccctccatagccttagctcctgcctttaggttcctgtctcatttgagttcctgtcctgacttccttcagcgatgaacagcaatgtggaggtataaactgaataaaccgttttcttcccaacttgctttttggtcacagtgttttgttgtagcaatagaaacctctaactaaggcagggtctatctgaaatcttactgtcagttattctgaattatacgccatcactagccacgatctccatgcttgcactgatctcaagaggttcttctctggctgatgctttgtctgagaccagggactccccatatagcttctcatctttgctcacaagcaggatacacttgagcatcagtggacaggccgttgtataagacaacatccatggctgctctatcataagctacaatcgcttaagacaacacatttgttctcgccatggtctagaggttaggagccccaaaccagttttcctgagctaaagttaaggggtcggcaggactgattgtttctgaagggtcctctgtcttttttgtgactactgttgttagtggtttgaatgagtgtgtcccataggctcagatgtttcagtaagtggttaacagtactgcctgggtaagcttaggctgtgtggctttgctggaagaagtatgccactgggggcagcagctctttggttatcctccaaccctcaaatcttcttagttttagaatggaacaaataaaaacaaaacaaccatctacactgagtaattgcttaaagcagtgtggtcctcagcctgtggattgtgaaccctctggggttatcaaatgacactttcacaggggttgcctaaaactaccagaaaacacaggtgtttacatcgtgattcatagcagcagcaaaattacagttctaaagtagcaacaaaaatagtcttatggttgcgtggggggtggtgtcaccataacatgaaaaactgtattaaaggattgcagcattaggaaggttgagaaccactggcttagaaaagaaaagcgcaatgctatagtatgtcagagtgacatgggaccaagagaaagacctcctagtagccaaggctggcataattcaagcaacaaaataaaattatgttggatcatagcccaaatataaagtaaatattgtgaatccatactgttattaatgattcaataaataaataaaggagcagaaataaatctgacagattccaaatacctaagtccagttcagtggctatagcaaaatcccttagactggttaatctataagcaacagaaatgtatcgcccattgttctaaagcctgtgaagtccacaccagcagagtcgtagtccaaggagaatctgtttctcatggattgtaccttctgagtggccttgcacattaggaagaaggcacgcagacttcctcaggcatcttttgcaaaagacactgacttcctctttcatggttctgtcccatgacctagtcacctcctaaaggccattatgccaacactttgagaattaggctttaagatgggaattttgggggatacagacactcagatcatagccttgccctttgcatggagggggtggatcataagccacctactccagctgtgggctcagtgtgatgactccttactaagggtagagcatggccatggtgaggggttgggtgcagcttcacagaggagaagccatccaagagtcaccttggcttcactctggtccaggcttcatgatcctcagtgatatcatgttgatagagctcacccgagatataaaatgacgagaacatgtctatctctgagcctcctcctgaaacctgtagctccagtattaatcatgagcagccatgaatcaaatctcaatggacagaaagtctggagaaactgtcacacaccagtagagtctaagacaacagactacaaaatgacatcctggactgaggagatggctctcagtaaagtcttgccttgtaagtatgaggacctgagttcaaatcccagactctatggggtgaggaaaaacagctgggtgtgatagcatgagtttataaacctagagtaggagaggctggcacaggggaatccctgaagctcacccgactgccaggcctgcctaatggggcaagatccaaggcaacaagagactcacaatccttcctcaaaattacatggccataaatattagtagtgacactcaaggtgaccggcctctggtctccacatatacactgcattcacacatacacacacaccacacacacacacacacacacacacacacacacaccgcacacacacgggttaaaaataaaatacaatgggctggagagatggctcagcaattaagaacactaactgcttttccagaggtcctgaggtcaattcccagcaaccacatggtggctcacaaccatctgtaatgggatctgatgccctcttctggtgtgtctgaagacagctactgtgtactcatatatattaaataaataaataaataaataagtaatgcgacacagcatccagaatggaatcctgatacagaggaatgacactgggtaaaagcaaagaaaatctgaatacagtatggaattcagtagtacttgacagtgttggatcattaatggtaaggaatatactgtatttgtggacaatactgaagaaggtagaaagtatattgtaggagcccaccctgtgttctagtttgatattttttctgtgactttaaatatattctccaataagctctttttttttccagccagacacaatagtaaatgtctgtggccccagttttattttgttttttgggttttttttgtggggggagctctatggcagaaagaccataaaaaacaaaactaggaaagtcttacagatgtctctcccagagatgtctgtagaatgtggggagccttctgcctctcctggatagtataaggagttctgtgtatctggagctaggccagcaccagagcagccctctttgcgtgttcctctcagagctgaggaaataacatttgtcctacttgggcacaggtctctctgctccacatgccacacatggccatggtacattaaagctatctaacgtctgaggggacacttttcacaaagtgcacctgaagctgtgaatgttttctgaaaatacagaaaaacacatcatagaaacccaatggagttgaggtcagtgagggcctgggctaagggcttgcccatgggcctgtgggaatccaaccctggcccatgctttaaaataagacggccatttagaatacctttccacgtgagacacaatttcaaatcaatctatacacggaagttaaaacaggtgctgtcccccgccgtccctagaggaaaaacagtaaccaggcatctaatcttcaacaatagactcagcacaaatattgaagtccttcctaaggtgggtaagtaacctgtcttcaaagaaaattgattctttcattctgaggaagattttgcaattttccaaacagcaattttcttctcatcccagagagaagtcaattggtggtttacaaaaaaaaaaaaaaaaaaaaaaaaagttagacattaaatcacctgtgtattttgttctggctgtgctcttcattcaagctaggtctcctatgccagctgctgtccttggagtggctctcatctctatcaaagtctctcatcctgttccctgtcaccatgggctcgctgtgtgtggacttcaaatatgacatacaacacaggtttttgactgtttggtgaatgaataactcagacaaggcatggaacctgagcaggcagcactcggaatttaccactctggagctggggtacacaaggaggcaaggcgagggaggtctttgtgggtttcaatttccttcatcgttctacctgttcctttgaggccacatgcttatctgggctagcacgatgctctttagaatcttatatttcatctcttatagaattcctgacttggtcaaaacatctccattttctttatatgtgtgtgtatgtgtgtgttatattatatatagagagatagttatctatatatttatatagaaagttgatataactatagatagcacaaatatgttacaaatacttctaatgaaatgtatgtctataggtctaccaccaattcaaggatatgggtcttctcatcaccatgccattccttgtgtgcttcccccccctccccacaccccctcctggagagaagcccacgtggttattatcccccagttttccaaatacttttatcacacatgtctacaaccttaagtgatatattgcttcctttgaggttctaatgttcacaaaagcatcatagtgaacttagtcaaaggcaactttgtggcagccttactgctgtgtctctaagattcatttacactgtgttttacccacactgtattcctaggtctctgcttctatgtcgcctgttgtctgtcatgaggggtttctcagttcacctgacttttcttaactccgaacatagggtaccccatgaatctcactacagtgagcattctcacagaatgctctccttggtgtatacacgccaagtgttctctagtaaaagggctctcactatgagggcctgtcagaattctctgaagggagcctggtgctggccccactcctactcctccaatcccataggcctggggggaggcctaagatttcaaatttcgagtacagttccaagtgatgaagcgttaccggatcaggaccttttgggaattgtggtcctataataaatacctgtgagtggcatacctgggctgtaggaatgcacccattcatacagtaagataatgtccagggctgaggaggtggcacatctgtaagcacacagacctgaattcagtccctagctctatcatgaatgtcagacatggtggtacatagctgtaatccaagttttgaggagggagagacagacggatctccagaactcagtggccaggcaggctaccatatcagtaagacccaggttcagatgtggagaaaccctgctaattaaggctgcaatctaccatgtcctcctctgagcttggtgcaaaatggaggactctctttatcagctggggttccccttctctgaccttgcctgagggactggacccaccacaccctctacctggggaatgtccagtaatccttggcaaacctacaacttcaacttcctccccctacccccaaccccgcccccataagaatgtgcccagggagtacctagggtttctggaatgcctccctatacaaatgcggcattcacagcactttaaactccaaccaatgatctcattcaccctgaaaactccttcccactccttaaggttcatagatcacccttgtccaccctgaataaagtatacatgtacaagctcacctggaataaaggtatgtgcacaagctaaaatcatctgagagagctgtctcattgaagatcgtcagagaaggcctttacctaaaagagctgtaacactaagatcctcacagaaggcctcccacccactgacccccgacccctcactcactcccaacctgaccaggctcctgcagaaccccacctgttctggactccacttcatccttccatccccatgtgcatctggacaccctgagagggaagaagcagaggacatggaaccacagctgaaccccccaaatgcagaccacattcagggagggacccaaaaattaagatgtggagacatggaggaagacaggaagacatctgctgttgacctccggcttaaaacacacacacacacacacacacacacacacacacacacacgcatacacacgcacacacatacacacacacgcacacgcgcacacacatacacacacacatgctcgcacacatgcatgcacacacacacgtgcatgcacatgacacacacacacaaacacgcccattctaatagtagtgaagatgtccagttgtctcctgtgtaactgtgacattttctttcctcatgtcagaaatacgagatccacagagcagtgtgttatccagtccctgacatttctcatctgctttctccgtgctcacggtagctgaggtggcagaacatcagcttcttacccagagaccaggggtgtcttattaaagaacgtgagcaccttacacatgttaggtatgttcccttaacatgagaaagatttggctctcacagttctcctgtggaaaacaagcagtgaataaaccatgggaagattcacgtctggaaggttccttgccagcgtcagggaaagcagatggcttccttatgaggttcgtttcaagcaactgtagaaaaatgaaatagatcctgacagcagaagctacccgcagtcactcttgtcatctcatctctggcacctatcacacgcacagcactggtgccatgattctgcagagtatgtcactgctgctcacttggaaagcacctgattttgaaatgatgaagacttggggggatctgtggttgaaatttgggtctatggtgatgcaggtaagatgcacacggtctgatttgccacatgccaggaggacgtgaggactttccaataagaggcacaatcccaactccaatagcaaagccccagtataagacctgtgacaagtggcttggtctctcctgggcctcagtttctttttctgtcactttgcacaactctggtctacctctcgaggccattgaggttgaagaaagtgtaactgccttccccggccacccttaactgtcaggatctcctagggaggcatgggggccttttgaacccctctcccaccctgggatggtcatctgcccaaccctgtgatggtaaggacagctactgtgagttcatgagtgcagtcaagtccaaagtcagctttccacagctgtcctctccaccctttggcgcttgcattctttttgccccctcttccaccgtggaacctgagccctggagtgggtaattagatgtcctgtttagagcaaggcacttaacagtcacttgttctttgcattttgatcagttgagccttggcagtaaccaccctccgtggcaaatctctgcatctccacccaaggctgcactagtctattggcatcaatataaatatttagaaggacgtttgacacgtgcagcatgcgcatttagaaagccaacaggtttagtcaccccctagggcctatgaccttcccagccatgggttttgaccaggtttatagtggcaggtgtgaattctcacccatgggagggtcctcaaatcctaccagaaagtagtgttagcccagggcagtcgtgctgttattacatcagtgggcacatcttgcctggcaggtcagctaggtaacactactgctgccttttttctcccgctggcctacttagtctctgaaagccaatcattagggaggaagcttccagctcagttgtggttcgatttctctgtgtagttcgattgctgtgctgcggtccagccaccaaagcacaaggtgtgttttcggcaggaggatcttagcatctggttctagtgagcagcaaggacaacagactatgttgttgtttaaaggacctaagaggcctcgttgacaaaaaaatactccagggaggtatcccactcttggtactgggaaagtgtcctgaagtgcaacttacacaactctgcaaagcttgaaaaccacccatcggtggattttaaataagtgcctactagtgattcctaattaaacccaattactcaaaagcaaaatagcacagatgagtcaagaaacttgcctcaaatcacagaactagcaagcaattgaaccgggatatgaaccatgcatgttgaggttagactcaacacttcctggttaccgttttcctttcgcctgggacaaacttggctctttctgagaacccgctcaaatctgcctcatctgcatgcttctctgattttcacgcagccttcatgctccctcctctgggccatagctgtgcttaaacccactgaaatgctttctgcagggcactgattagttctgtatgttgctaaccctaggagattgggttccctccatcatgtgttcccagggcctccctgtctgctgtggatcccatgagtttagacccaacactgtgactgaaatgacaagtgtctcccagggccttccacatcttttgacatggctcttaaaaaaaaccctcaagagcccagttggtaaagtgttttccatgcaatcatgaggacccaagctcaatcctcagaatccacgtgtcaaaagctaggtgtgggtgaacgagtctgtaatcctcattctgaaaaggtagagatagattcctagggtccatcggccatccagtctagcctaattagcaagctagagaccctgtcttcaaaaacaaggtagatagaaccggaagaattgcatccaaggttgacttctggcctctatatgcctacgcacacacatggcgccacatagttatgagaattttttccccagggagagaaaccaatatctatcccctcttttctgggtcccagtaacaaaccaaaatgctagccaacaaagtcaaatgtgtgaaaccaataagttttttgggctcacatagagagcatgagtaaggggtcacctgcaggagcacgggtgaccccaaagcatccacaccacctggtactctggtgccagtgatgacacttcctcatagtggcacagatggagcgcccctccactttaccttccacagtctgattatgctgtcattttctagtgcaaggacccgtgcaatcagcccagaaacaaataaatgactgagaggtatgagagggagaggtgggaatcccaggcgggggttcagtgatgttcctcgtcttctctctataaagcaatgtcaacagtcaataagcctgatcttgggggctcttgcaagtggtcacatctgctccaacaatgaagatagctgttatgcttggatgagtgtggttctacaacacacacaaatatacacccacacctgtacatgcacacactctcaagtgcatgcacacacacacacacttgcactcacacacacacatacttgcacacttacacaatgcacgctcacacacatatgtacatgcacatgcatgcacacacacgtgcataagcacacacatgtagacacacatgacctccaagggaactaatccacacgggatagcggtgtgcagagctgggttgctaagcttagctaatgagctgtgcccattaatgaagccaaggtggctagtctaatctctgtgaggccacagcactgttcgttctttcctgtggttgctgactgacctcctcacctcagcttgctgtctggttaagcttgtacctttgatagaatgagagaccggggaagaatgggtgtgtttggagaaagctcattattgcctgtggaaaaccacctgcaatatcatgcccctgcagtgggcacaaacagcatttccttgtcttagagataatgatttttaactcttccaagctgtcttagtcagggtttctattcctgcacaaacatcatgaccaagaagcaagttggggaggaaagggtttattcggcttacatttccatactgctgttgatcaccaaaggatgcaggactggaactcaagcaggtcagaaagcaggagctgatgcagaggccatggagagatgttctttactggcttgcttcacctggcttgctcagcctgctctcttataaaacccaagactaccagcccagagatggtcccacccacaaggggcctttcccccttgatcactgagaaaatgccttacagttggatctcatggaggcatttcctcaactgaagctcctttctctgtgataactccagctgtgtcaagttgacacaaaactagccagtacacaagcttcagtcagtccttttttgtttgtttggttttttgctttttcttcctattatgggacacagccttagaagatttgtcagaacctggctgaaattggacatcagcaggaattttaataaagattaaacttcttcttaagaaataagatgtttgtggatacttgcacagactgaaagaaaatataccaaagcagctaaaacaagagcagctggccttacttagttcctaccccaagctgagggctttgcccatggtctcagctaatacccatgttcttctattgtgctctgtctcccgccttccaaatggggaaagcgaaccagagatgtgttgactctcttggcaggaaggcatcattagggctgttcgtttctcttgttctgcattttctatgacaagtgtgttcgtgtaaatgatgtattttaaatgctataaacaagtgctaagaaaaacaaggcaggagttgcatttggtggtcgatgactgtaacccaggaactctagaggcagaggcaggggattgtgaattcaaagccagcccaaactacatagccaaatcttgtctcaaacaaaaaacaaacaaaaccaaaacaaaacaaccaagggacaaggattatggtataatgattgtgcactgccctagcatgtaaaaagccctgattcaattcctagctctatagaagaccatcatagagagctgaggggtgactcactggtagagctcttgcctgccaagcacaaagccctaggttccagccccgctgctacaaaatgcagaaacttccaagaagaagcaaaacgagctgccttcctgaattggggcagggaagcagaagatgacctgtagaccatggccatgatgtcttgggagcctttaacatttgtgagtcttgctgaagcacctcgacttgtatttttgtttcatggtctagggatcaaatccaaggccttgtgcacgttctcccccaccaaggcacacctttgacctccaacttccctcacagagtcatttgtagacattttctgtggcatgttgttaactggcagaggaatccatccagtggttcatttggggacacacctccacactgccgacgggggtcttctaagaaaagcatgcagctctgtgctcagtcctccacagggactcactcaaaaagagaacagagataaggatgagtaggttttatgaacaaaaaaaacccctccctgtactgatgacttcttggcaaagaaaaagaggaaatgagcctcccaccgatggcaatggcaggctccctgggctgaggtcagcatttatctccctgtgagccaagagaaaggggtcccgaaggctccctcctgcttcctccaggcccagagccgaggaaagatgctctgtaagtggtttttcagattttctcagcaccaaagacttggagcatccatagctttctgttggatggttgcaatctagcgtccggtcttgagaacactcaaccttactcccatatggctggtgatttccatgcacccatagatgtatgatagagagagcatagctttctgtggcctgtctctgtggagggaggcgcttcagggtggagaaggtcaggggcattcagcactctgtttagctttgggccacgctgacacactttcctaagcaggggaaaccttggttctgtgctcaagttctgactcctggttttgtagagggaccttgccttctttgcatggcattaaggaaaacttcataggggctctcacaagatggctcagacagtgaagaacttgctgtgaaggcctgagggctggagtctgaatctgcagtatccctataaaaagccagatgtggaaggaggcgcctcaaaggcccaagtcctcgggaggcaggcagcttgcaggttggccaatctggaagagtctatgtgttctagcttcagtgagggaatctaactcaaaaattaaagtcaannnnnnnnnnnnnnnnnnnnnnnnnnnnnnnnnnnnnnnnnnnnnnnnnnnnnnnnnnnnnnnnnnnnnnnnaattcatcaggacacattcacccactacctctccatccccatgataactgcaatattcaaaagctgctcttttccccaggagagagaagaatatacaccaattttcaccacttactgcgcctaagagaacccactctatagagtccccagagcgtattcccggccaactctgtcctctcagcactccaagatacaactcctggccgaaagtgtcaagaccaggcatctgtgcagtagatgggtctcccagtggtacccacaaatggaggttggtctgaaggtcatgcagagcgaccagggtgtgcgtgagcagctgggagcaggagagggaggagcatgcaggaagtctgtgcaccttcgatgtacatcccatgcctctgaactgctgcagcctcctttgcggcagagtgacctcgacgggcagataagagattcctggggtgatttacagacccactgccccatcacagtcatttctgactggggctgggacactgtgtgcaagtggctgctgggtgacgtagagtgtctcgggacaggcaatcaggaagctctttccagatggacactgaggtcaagttggccagggaacctctgagaagacaaagcagaagcccacagagcgggagagacgaggccagcttcttacatttctgtccacattctttctcctttttttttctcttttattggcacattaactgtaaacatcatgggcctattgccatgctctcgtacatgtgcatgcatagaacggactttggcacatgtacccctcccatcactgctttcctcttgctgctttcctcttctctacacggaacatctttcttcctattcccaaatagttcccttctgcttccatagcttttttaattctctggattctgcatgccacagaagaaatgtgattttgtctctctcagttttatttcccacgatgatcttcagttccagctatttttctgcaaatgacaacattttgcttctctctaccactgtataaaactcccctgaacctatatgctatattctctttgcccatgcccctgtgggtgtatacctacgccagtgggtggaggctcttgtaaacagcttcacagtaaacagggacaggttgtgtgtaaacagctgatttacatctagcaggagcctgaactgtctgaggttttactgagaataaaatagtaaagactggtggaagctgaactcatacacacagcccacatgatgaacagatccttcatcggtgggttctccaactctggttcaagccttggacagtagaagacggtctctggctccacgtcccagcaggacagacatagcatagaactctaagatgactgaaggggaggttgggaagagattctcttgcatgctcgtaccttccaggggactctcagaccccactgagccttgtatgtatgtgttcgtgcatgtgtgtatgtgtatgcaggtgcacatgtatgaaggccagaggacaaccttgggtgtcttcccacagacattcagcaagtaggtctggtggtctaattagtataaaccccagagatctgagctgagattataaacaaatgataccatgtgttctgggaactgaccttgactcctggtgatgtcgcagtagaatctgactaactgagctatctctcaaccactccactggtcttgcatttgggacttcaacagaccatcatcagttaggtctcaacgggtgacttatgggagcatctctgtatgtctatttctggcaaagatgaataatttaagaggaaagaaagggtcacccgccacaccacaggcagggaggacagtgtctagaaagagcatcctgcagatcccgagtggattgggagccttctgattcatatttcttctttgtatatttgtgttctgggcacacactcctccccctggctaggtggtccctgattctttctcctatgtttggtgcccctggcttccttaatcatatggtagcaaggtctgctctgagtgtggtagctctctttctttctttctttctttctttctttctttctttctttctttctctctctctttctttctttctttctttctttctttctttctttctagcagctttctgcctcgtggccaatattcctgttcttgttttgaaatgacacgttgggaaccaatgagcaaaaccaactagttttgaagttgttccaaaagatgtagggaataaatgagttgtaaaaatgtgaacggggataattgactcccagctgtgtgtttatcacaatcgcaagtgtcagaagccatttccccacactgtggtttggtacagtggtaatgagccgcttacacacacggcggtgcatttcaaaagcttgtagcttcgaataattagaggtagatttcgctgttagcctggcatgtagcttagctcccagggcaaatagccggctctgcttctgagctgcctcagtgacagcgtgggtaacacttggggctgattattaatagttgacagagtctccttctttgacctgagccaccacagcgggccaccaaattcagactgaagaacttgccatttgaaacaattcacctgacctttcatctgcggctttttagtccatgctgccttttccagaatagagataacatactgttgttgttgttgttgttgttgttgttacatgtttacaaaagagacaagaggtgctccctgtaaaaataactatacaaggctggcaagatgactcagtgggcaaagcatttgcacccaaccctgatgacttgagtttcctctctcccacagtagaaggtgaaaaccaattcctggacgtcaccttctgacctccacacaaccctcagtggaatgcttcttctccacacacatacctcaatagataagtaaataaaggcaatcttaaatattttttaagtagctaaaccaacttagacacatatcaagagttaggtcccactgcaaacccttcttcccatgaagaactactatttagaaattctatccacctgtttttcctgtgtatagataaaggctaagtaacaagtttgaatttctaatgggatcataaccttttgaattctgtgggtttggtttgtttttgtttgtttgttttttccaataatgatggtatcatgtgaccaatacagtaatgcacttacagtgtttagtcctgtgtcagcaaaatgtgtttgattgacttcaaatccccattccctatttatcacgggtaaccagagtatgtgtaaaaatgtcataatgcagatgttcacaggaaggaagctaaaaaaaaaaaaaaatccttcctctaggcctgatgtggaaactctgaaatgactacccagggaagccatagacagttgttacagtgtgtgtgttgtgcacaggggccaggctgaggggtgagaactgaaatacagcctgcatgtgtgccacaccccatgctcagagggctcttcctactgagggctgtacaggcaagactcggagcatgcaggcctggaagatagtcggggctggaactacccaatcctgctttacatagtggagtgctgccattgaaggactttaagcaatgccaggacaagatctgattcgttttttgatgctcatttttatagcgcagaagcgatagtttactgtggactctggcgggaagcagcctgcagaggccgaggggagatgcggaaggtcccttgggatctgtgtcagtccgagcctgcagtggggacttcatctgtgggtggtcatgcaagtgaaagcttcaagattcgaaatgttgaggacataaaaaatgtcctcagggtgaacaaggatgttaccccataagaggaaaggagggtgggcccgagcccctgactttgggggatttataaagaaaagcaggaaagtgtagctcacagcgcttgggttctcaaggtgccagtaagaaacaacgaacttgaatgtgctcacacaatccgctacaaagcagttccttgggtccctggaacatggctgtgagttgttgccacagatggagggcaggagtccactccattcagtggcagaccccttgctgtagagcggcacatcttgtcctggtgaaagtaagctgaaaccaactttactttagagctgcctcacccccttggaaatgtcccagggctccccaggagagcctgctgcagctctggacaaactgaagctaatgaattacacccagctttcttgtggtgtccttgacctctctggtcccttcaatccttcctcctcctcttcaaaagaattctccaagctctgcctaatgtttgtctttgggtctctgcatcttgttccatcagttgctgggtgatggtgatagttatactaggtgcctgtctgccataatgttattaatagtgtcagggatgggcactctctcatggcatgggtcttaagctagaccagtcattggttggctatttcctcaatttctgctccatctttacccctgcatatcttggaattgtgggtctaaggttttgtggctggcttggtatcccagtccctctattggaagtctttcctggttacaggagatggccatttcaggttccatatcacccattgctgggagccttggctagggtccccctcatagattcctggaaaattccattgctctaggtttctagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgctctaggtttctagctaatcccagcaaatgccccccccccaattccactgctctcatctcctccccatccccaacccagttccctccctccatctgccccctccctgtctattctatttctccttctcagtgagagtcaagcaacccccattgggccctccttgttcttgtattgtacagaattgttttagatttcctgtttttttttttttaatttttccatatgaagttaagtattgttcttccaagtctgtaaagaattgtattggcattttgaagggaattacatcaaatctgtagattgcttttggtaaggtggtcatttttactatgttaatcctaccgatccatgagcatgggaggtctttccatcttctgatatcattttcaatttctttcttcagcaacttgaagttcttgtcatacagtttggttagaactacacccaagatatttcatattatttgtggctattgtgaagggtgttgtctctctgatttctttctcgactgttttatcatttgtataaaggaaggctactgggttgtgttttgttgttgttgttgtttttattttttagttaattttgtatccaatccctaggaatttcctggtagttttagaggtcacattttattctatcatatcatctgcaaatagcagtactttgacttcttcctttccaaattgtatcctcttgatcccctttagttgtcttatcgctctagctaaaacttcaagcattaaattaaataggtatggagagagtggacagccttgtcttgtccatgattttagtggaactgctttaaattcttctccatgatgttggctattggcttgttgtatatggcctttattatgtttaggtaagcttcttatattcctgatcttaagatttttatcacgaacagggtgttggatttttgtcaaagcatccaaatgagatgattttatgatttttttctttcagtttgtttatgagatggattgcatgggtgcagtttcatatactgaatcattcctgcatccctgggatgaagcctacttgatcttggtggatgatggttttgatgtgttcatggattctctttgcaagtattttgttgagtatttttgcatcacgttcataagggagattggactgaaattctctttcttggttgaatctttgtgtggtttaggtatcagaataagtgcggcctcataaaatgaatttggcaatgttccttccgtttctattttgtggaataatttgaggagtattgatattagctcttctttgtaagtctggtagagttctgcactaaaaccatcttgtcctgggctttttttgattaaagacttttcatgactgcttctatttccttaggggttataggtctaattaaattgtttacctgatcttgatttaactttagtaagtggtatctatcaagaaaatcatccatttaatttagattttccaattttgtgtagtacaggtaagacctaatgattctttggatttcctcagggtctgttgttatgtcccacctttgcatttttgatttttgttaatttggatagtctctcttctctgtcttttagttaatttggtaaaagctttgtctatcttgttgattttctcaaagaaccaacccttgggatcatcaattctttttattgtttgttctctttgtttctaattgattgagttcagccttgaattcaattatttcctgctatctactcctcttgggtgtgtttgcttctttttgttctagagctttcaggtgtgctgttgctagtatgagatggtactgatttctttataaaggcacttagcgaaatgggttttcctcttagcactgctttcattttgttctataagttcgggtatgttgtggcttgcttttcattgaattctagacagcctttaatgtcttcctttattttttccttgacccagtggtcactgagtagagagttgttcagtttccctaggtttgtaggccttttgttgtttctgttgttgttgaagtccagctttaatccatggtggtctgataagatacgggtattatttctattttcttgtatctgttgaagcttgctttgtgtccatatataaggtcaattttggagaaggttctttaggcactgagaagaaggtatattcttttgtgagtgaaatgttttgtggatatctgataagcccatttgattcataacttctgataatttcatcatttctctgttaagtttcagcctgaatgacctgtccattgatgagcatggagcattgaagtctccagctattaatgtgtgaggttctatgtgtgagttaagctttagtaatatttcttttatgaacatgggtgcccttgctgttgggatgtaggtattcaaaactgagatgtcatcttggtagattttttccttcggtgagtgtgaagtttccttctccatctcttttaattaatttaggttgaaagtctattttattagctattgaaatggctactccagcttgcttcttgggtccctttgcttgaaaaaaaaaaaggttggttttttttcccagccctttattctgaggtaatatctatctttgttgctgaggtgtttcttctatgcagaagaatggtggatcttgttttttgcatccagtctgttatcctgtgtcttttcattggggaattgagtccattgattttgagagatattaataagcaatgcttgttagttcctgctgtgtttacattggtggtggtagtgtgtatgtgtgtgtgtgtgtgtgtgtgagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgagagagagagagagagagagagagagagagagagagagagagagaaacagggaaagagagacagagagacagagagagagtttgtacacacacatgttcaagtgtgtgtgagcctcccctcttttcgttttgctagtgtggaattatttatttcctgtgttttcttggatgtagttaaccttcttgagttagagttttccttctagtgccttctgtaggactggatttgtggatagatattgtttaaatttggttttgtcatgaaatatcttgttttctccctctgtggtcactgaaagttttgctgggtattgttgtctgtctgggctggcatctgtggtctcgtagagagtataagctgtcagcccaggctctaaagtctctggtgagaagtcaggtaaaattctcataggtctgcctttatatgttacttggccttttttcttctccccttgcagcttttaatactctttcttctatacatttagtgttttgacaaatatgtgaagggggattttcttttcttgtcaaagctatttggtgttctgtaggcagttgttataggttttgtaggtttagatgagggtttctgagtttgtccttgttggatgggtgtttaggggatattctccccctaggtgttctgttttctctctgtctactggcctgagtagcctgcaattctggtgactagctagctagtgttcaggcccagtaggatgtttctcctgagtttttctggtctgtgaggtctggggtcttgggtgctaaccttgtctctgaggtcccagtaccagtatgatccggggtccctggtgcctgagggcctctaggaaaactggtagtgaggttgtgggctggaaaatgaagttcagggtgtggggtgtagtttaaggctgatgggtatattttagtcaagtatgtggggcgagggcttagggtggggtcttacctgttagtgactggtgctggcaggcctctgggaatgcaggcagagttgtggcatgggaaatggagtgcggggggcgataagatgtagtgtgtcactgttgggtgtgctttccggggagttggccaccaggggcttgtggggagcttgcttgctaggagtggagggtgagggaatggggggtagggatggggatggggttaccctggtgtttcaaggaatttttttttcataattaaataatttgaaaagggaagacccacttctaatccattttgttgttgttgttgttgttttggtttcttaaaacaaggtttctctggctggagagatggctcagtggctaagagcactgactgctcttccagaggtcctgagttcaattcccagcaaccacatggtggctcacaaccatctgtaatggggtctgatgccctcttctggtgtggctgaagacagctacagtgtactcatacattaaataagtaaataaataagcaaataaataaacaagtaaataaaaaaacaaggtttctctgtgtagccctggtcaccctggatctcactctgtagacctgccagcttctataacctgagtgctgggattaaaggcatgtgctaccatggcccagatctaatctgtatctatgagatgggaagatacactttcactctcgacacccttccactagtagcctatatcaagggaatggaagaagaaagcaggctctctctttgcctgcccactcccaagtgtccttaggagcttttcgaatcatttctctccccatcacagtccccgcccacctgctctgggtcactgtgaatcatttgccttttctagaattatgtgtggatagacagcacatgtgtacttacggactggtttcattcaccaagcttagttaccttgagatttatttatgttgttgtaagaacaacttgtttttattagctgtccaattatttgtttacttgcttgcttgcttgcttgcttgcttgcttattgtttatttctcaagacagagtttctctgtgtagctctggctgtcttagaattcactctgtagaccaaggtggcatcaaattcggagatccacttgcccctgcctcccaagtgctgagaacaaaggcatgcttcaccactgccctgcagctgcccaattctttaaatgtcatttattaagaacattttccattcccaagtgaacttccttgactccaaagggtggggggaccgcattccctcagccatactcctagcctcggattctaagggatattcagaacctgggagcaggtagaaaagaacaaaggaaaaggactttaagttcccagggtgccaaattctagaacagaaaataattgggagacataaaacagggtgagagatagtttgtaatgtttattctagggatctcagggggtgtcatctctgggctgatatggctctaacattgtctcccttgcataacttctgtcaatcctagcatagaggagaaagggaaaacacttttacatatttaatatactctctcctggaacttcggttatctagttaagtccaaaatactacatggaaagttctagaaataattcataagtttttaattgcatgacattctgagtagcatgatgaaatctcaccccatccaccccagcccactgggaacaagaatgctgtgttctagtgtgtgatctatatctgctacctacagatgcactctttatctgtccagtttggtaatcagaggatctcttctattgccttatatgttcaaataatccttatgttatttaatatgttatttaatattatctgcccccccccaaaagcaagcatggtgttattacaaagtaggcatcaaggcacacagcagtttgatactaaaccagtggttctcaacctgtggggtcacaacccctttgggggtcaaatgaccttttcataggagtcacctaagaccatcagacaacacagataattatattacagtttataacagtagcaaaattactggtaaaaagtagagatcaaaacagttttatggttgggggtcaccacaacatgaggagctttattaaaggatcgcagcattaggaaggtggggaagcagtgctctagacagaagtccaccatccactgtgggacttgagatatatccccagtggacatctgtatgtccctttgacccagacatgggaagagaaaacaacttttcttatatctttttttcaaggagcttcaattcaaaataagccttataccaaagtgccatgttcaagtgtggtatattggctattgagtgaggtgtgttcatctattcttgatgttggatgttttctaaaaggtcatgcttgtttcccagggtggtggtgttgagagggacctcgtgggaagtatgaaagcctactaagggctcttccctcacaagacattttctcatggaagcctgcaagatgagccagtgcatgaaaactcttgccacacaagcttgaaacctaagcttgattcccagaatccatggaagtagagaacacacacaaacagaggatttttctcatgagtactggttcattcttcagagatggctgttatgtgtgaaagagcctctctttggcttcttgttctgaaataaatgatcttctttcatgtgtactcccatcaatggcaggcaccatgatgtgacaaggccaaatgcactcaatggagatgagccagtgtgagtgccatgtcttcggacccccaaaactatgagcaaaataaacctgttcatgacaaagttgtactgcctttggtattgcgttatagagaaaagccaactaaccctttgccgcctatgttaaaaaaaaaaaaggaaaaaaaaaaaaaaaaccttcagtgaccacgtatgtgaggctttgcttctagactcttctgagtcctgcagagctgtcttagttagggtttctcttggctccatgaaacaccatgaccaaaaagcaagctgggggaggaaacagtttatttatcttatactttccagatcactatccatcatcaaagaaagtcacatatatgcatattggtgacttaatttggcagtgaaaaaccttaatcagtttgataggtagaactgttttcatatccgtttctttgatgactaagtgaaaatgaattccaggtttcttaacatttgtttgcttttatttttgttaccacatagcaattatatatgattgttgcagtataacatttcagtgtgtgtgtatgtgtgtgtgtgtgtgtgtgagagagagagagagtgagatgtgaccagttagagtaattagcatatgtgaaatctcagacatttatatttcttcatgttaataatattcaaagtcatctgagatcctcatttcaaaatctataattgatagagtcatcagccttagttactctgctgtgctttagagcactagagaccattgtctcacctacttgcacccttaaccagccttcccccatctcccctttctccattctctctcccagctctggaaacaataattccatatttatttctatgagatcagctcttcagtttgtaccaataagtaaaattatgccacttttgtctttgtgtacctgtctttaactcaacggggtattcttcagttccacagggcagctgacaattacagaattcattctttttaagccaatggttctcaacctattggtcttgacccctttggggttcaacaatcctttcataggggttgcctattatatattctgcatatcatatatttatatcacaattcagaactgtagcaaaatcacagttgtggagtagcaatgaaaataattttctggtggcggggggcaccacaacatgcagaacagttgtcgcattagaaagatacaaaaccactagcttaaatgctgctctgttaactgcttcacattattctgcttgttcatttattgatggacatctaggtcagttcatgcaaaggtctttgtaacatacaattcctttttcctttgactatacactcagtagtggcacttccaaatgagaacccaccctgttttctgtaattggaaaccagtttacattcccactaataatgtgtgagagcctctacttctcccactttctcatcaaatttattctcttttgtctttttaataatagtgattctaactggggtgagctgtatctcattgtttgttttatcttggatgattagtgtcttagtcactgttctatcactgtgaagagacaccatgtccaaggcacctcttataaaggaaagcatttaattgggggctcacttacagttcagaggtttagtatatcatcttcatgttgggagcatggcagcatgcatggtgctggagaagtagcttagagatttatatattgatctacacgcaaagaaagagagagatgatgagagatgatatggtggattgaatatgcttggtccatggggagcagcactattaggaggtgtggccctgttggagtatgtgtggtctttgttgtaggaaatgtgtcactgtggaggtaagctttgaggtctttatgcacaagctatgcccaaagtggaatcagacctcctcctggatatctgcagaagatagtctcctggctgcctttagatcaagatgtaaaactctcagctcctccagtaccaagtctgcctgcatgctatcatgcttcccaccatggtgacaatgaactgaacttctgaaactttaagccagccccaactaaatgtttgtctttaaaagagttgcattggtcatattgtctcttcatagcaatgaaaccctaagacagatagcatgggcttttgaaatctcacagcacaacctcagtgacacatttcctccaacaaatccatacctcctaatccttctaatcctttcaaagagttccactccctgacgaataagcattagactatgtgcgcctatgggggccattctgtctccagagtggtgggactaaagacatgtaccaccaccacccaacctaattttcgatcttctgttcaagtctatccccatactttcaggtattttaatacttgaccaccagtttgtggcattatttagggaggcttaggagttatggcttttctacatgaagaatgttacaggaggcagactttagagtttaaagactgagactaaaatattcaagaacttggtagaggcacctggggaactgatgattaattttttaagtgatactttaactggactagggattcctggaggactggtgagaattagtcataggtgtgcctgtgagcatactttggagaagatgggcagattgagttgtgagctgagcagagaagatccaccctcagtgtcaatgggccttgtcccaactgctaggagtcagaatagaagagaaggcagaggaaagacgagttggcgtcttacctgtgatgtcctaagacatcagaaatccaggcttcctggtttgtgaacgccaggatttatgtcactgcaccccttccctctggatgctcaagcctgttgcttctgatgaggaataatacaatctacatttttggttttaagacctttggacttgagccatgccataccaccagggtcccaagcttggggacagtgtcctgggactttcatattccactcttttctgctagatccactcccatctgtctgttcaattcccccctcctcccttgctcatatccccaggttctgtagccacagacttggccaactgtggattaaaaatattccaaagctaatagttgtagcaaatttaatgtattcatactccttctacttgtctttattccctagataatatagtattgcagatgttaacaaaatatgtatatatcaggtattataaataatctagggataagttaaattacataggataacttcaggttataagccaatactctatataagggacatgaatgttaagcctgaaccctgactaggagcagcaatgaaataagaaaggatggacacagagacactcatacaaaaaggctgtggtcaggtggggtgtgtgtactttgatggaacttactccctcaagcaatgagagccctcagtgtggttattgtgacagcacagggggaggggttagctagtctcgtaggaggtctctataggttagcagtctcacattgtaaacatcttggaggaggaagctgcagttactagtacttatacacactgcttaaccctccgtacagttatagttggaccagaaaaagaaggctttgacagtctcccataggcccaaggccttggtccttgttgtggatgtatccatgtcaacagcacacattcacttaggactttatcactcagggcttcctctgatcactacatccaagcatccttagacttgggtatctgcagaaagccctagccattctcccaagtatcaaggaaaccaatatgcctgcctcttattgattttgtctatctgaagaacccaagcagaaggtccaaaacaaaaaggagtagtaagtcctaagatatctgtcacttctttacctctaatgatcattcctgaggaataggtatttttttaatcgtcatcccattttacagatgaagagaaataggcacaggtgaggtcaagtacaatgtctaaggccagtccatatatggtaacagaggcaggatgtgagtctgtgtttttaccctatcaatctcctgcctcacatgtaagacctttttccctttccccagttgggccttccaagctctggccttctttactctcaagggcatctttccagtgggatggattagtctccaaaccattggatgctatgcttactcccattacattaaatggttatattttgattctgtgtgtgatagctaaaccagagtgtactctatgtataaatagatttaacaaatacactcactggaattcaaccagacagaagctgcttcttcgatcagacattcccctccgtgccattgccaaaaaaatgtgtgctcacgtgatttttgatgtgttgcaagaatccgaaataccatctggatcatcaaggaccgtttaaataatctaaaaataataatatagaagaatttatatgatgagcacatttttgatgtactctgacaactacatgttaatgtctgttgtttactgtgatactcacttagccaaaatattaagtgaatttgatcttatcttgctgtacatatgctggctttatttatttatctaccatctgtctgtctttctgtctgtctgcatgtgcatatgtgtattcatgtgatgcatgaatgtggaggccagaggttgatttgaggaagatatagatagatagatagatagatagatagatagatagatagatagatagatagatagattggtttggcaagatccagagatctacccatcccacatgcccagtgttaggattatagatgcataccactgcgtctgttacatggctcctagggatcaaagtcaggttctcatacttgagaaacaaccactttatcaattgaacaatcttctagccccgggttctggccctttccagaccctcacagttacctcatctttgtagtcaagttgcttgtaaccaaggaaggtctattggcatttatttctacaaaggactcagatgtgagtgatcacaggtggcctacccagaaaagcttactgctgaggtttggttccatgcccaggcctgagatagactggatcagaagcgaagtgatcaatacaaagcagatgtatccatggctcagagcctcagtggcataaaagctagtctggaaggtttccatctgccctaacatggtgtggccctggaggttgttagaagtcttggggtatgccctctgggctgatatcttttaggaaagaagtggaggagcggagattatttgttttattacctgtccttaatagagaaagaaaatatgtatgaaggcttcctaaagaaagcatgcatgatttgtgcaaggtcttgaccagcagcaagccaggtgctggtccagagagtcaggaacatcaaacaatgatgggcccagtcccacttttgagtagtttccagattttttacatgtttgttgttcttggttcccagcaactagaaatgcatgcctcccacactgggtagggagaactcaatactcaatgactctaaagagttggtaccagctagaggcactgtggggattaaggggtttgcctctctaggggatgggggactggagaaccagggaaggctttttgggaccagtaagtgaggcaagagtgggtggatagcaggttgcaggaaggagaaggtaattcctctctatccctgctatctccttcttttccatatagaccttctgcttgctgtgggctggaaggtgggatgggataagatcttggtcaaggcttctccctacctgaggtggtattcttctggggagacatgcatactgagcagatcctaaaaggaaggctttgtgatacagaacatggaagatgttcctactgggtagtgggagccacgggtcccactcctagtatgggcctgaagtctccagagccccacatagcacagccatggtctttctattggatgggaccaagactcatgatctaactctcctctcttccctggagtctgctgctgtcagggccatgaacacagtcagcccaacatccagatcactcttatgttgtctattactgctaattggcaccctcttttctatatgtggcacagcatggatgtgattacataagaaatcttttcaaggtcaccatggctgcagggtgaggactgtgaggcatcccaggcaattgtctagggcatctgctcttagcagagttgactcgggtagggcatagctcagtggtgagcccctttctggcacggagacgtttgtttgtgtgtgtgtgtgtccctgggtcccatccctaggactgcaaaaaacaaacaaatatataccaaaacaaaacaaaaaaaaacaaaacaaaacaaaacaaaacaaaaagcctggctcttaaaactcatctcctcctagcattcacctatactggcttactaaatctttacaaatgtcctatgaggatgctaccatcatcctgttttataggtgacaaaattcagacacattcaggaaaatttttttctttttgagattagaattatgtccccaaatgccgaggttgaaattctccttgtaatatctgggtgtccttgggataaagggtagtactgagaaattaatttagtcacccagactgtaggggatatgggggtgagggtgatgttgagggatacacccctgcttttaaggagataacaaagaaaacaaggatgcattgaccaagaaggcagctctaagctccagtccacaccgacacaagaatacccaagttagaaagagaaatggcctttctttaggggagagcaaaagagaaatatattctaagtgcattactctgcacttaaatacttagacgttgacagagatcagcagcactttagataaatccacccgcttttggtggcttcaagctgagcccacttctgcacagttgaaagtagctttcttctgcacgcctcccaaacccttccttttgcttttctttgaaaagacaaaaaagagaagaaaactaaaacctcatctagaagactcaagagcacaaagagagaagtgattttttcatgaacaatctaacctaggtggtttcagacactagtatgtgttgtgctcatgggctaggaattgatgagggattttgaataactgtcacgggcaatcaaagccaaagagaagccaaaaaggctttaaaggagcactgagtggctgggaatgtggtagagtgcttgcctcccccagagttgtataaactgaacgccatggggcaaacctgtagtcccagcactgggtacatgcacacatgaggattagaaatccaaggtcatccttagctgcaagtaaaaagaccatctatactacataagaccttatctcaaaaacaaaacaataacttctttttgttttattgggggcagatattaatatttatttataataatattaataattagaaatgtaaggccatctttctgctgtgtgccactatatatgtgtggttagcatattctccaaaaagttgaaagccaagactcaaagagactcaatttgcagaccacatccacagaagtgagttctccaaaaagccaaaagaggcagagagcccatggtggagcagagagctcccacgtcattgacgaataagtggagaagcaaaggaaaggaaggatcagttgtacgtagggcagtatctcactcagccggaacgcagagtgagctgtggaggcatgctgcaacaggctgaaccacggaagcacagtgctcagtgacagaagccagcacaaagggcaggtgttgcctaactctccttgtgcagctcctgagagtaggcagactgatggggtcgggaaaatagagacaaagctaccagacaggcgattaatgggtgctaggttgagtttgggtctatggacaggttccagaaatattgtggctcatagcactgtgaacacataaaacttactagtgtggtaaattttctgccatgtatgttttaccacaataaaaatatcaataataataaaatagacaaacatatatatgcatatatatatatgtacacatacatacatatggaagaaagagcccacccaccctcagtagcatctacagaagggatctgtgtgggaagatatatacagaactcatataaagaaattacaaaattctactaaggctcattctaaagagagttctataaacagagagagggagagactgtgttcctggttcaaaaactcatttgggtaaggaaatcatttctccccaagtgaatctctaaatgtaaggcaaccccaatcaaaatccaaatatctgttttgccatttactggcaaaacatttagctgcatgtttctgcagctcaccataaatactgaatacagaaaacgcaagggtagctttgtaaagaaaatggggaagggaaagggaagagaggaagagaggttctcactgtcactaaaagaataactgtttgtgtttggggtaccagccccaacctaaagagtaaaacatgtagaatacaaaaacaaatttaaaaaaatatcgactttaataaaaagtgacattttgagggagtagccaaagaatggactctataaaaacggtgccaagagacctacacatgacaaacttgtgcagaactaagttctgctaaagagcatatgagtgacgtctgggtgggacaatgccagtatcccagcagtgtgattacactatcagtctacagaacattatcactggaggaaactggataaaagctaaatgaagccttcccatgcacttcatacaagtgtgtgttcatctgcaattgtctcaatagaagctttaattaaaatgatacagagtgaaacaaactattcttaaaacattaaaaggctgaaattttaaattaatatttttattattttaaaagatgtttttattttttattttatgtctgtaaatgtgtctatataccatatacagctgtgcccacagaggccagtagagttcatcagatccactggaactggagttacagatggctttgatctgccatctgggttctgggagctgaatctgggtcctcagcaagagctgtcagtgctcttaactgctgagccacctctctgttcctacatcacattttaaaaatactagaaccctgagtacatacccaaggtaaacaactttccaagccaaaagctacaatggaacaaattggttcacttgtatggaaattaaacttccacctgactacaacacatttatgtgagaataagaaacaaacacatttggaaaaactatctgcagttgcatatcaaaaggcagaattaaacctgagaggggaaaggaggcagaatcgatctgggacgcatgggagtggttgtgatcaaaatacatcacacgcttgtatgaagttctcaaagaattaacaaaatatatatatatatatatatttaaggaagagttaaattttcttaatatatgaagagttcttataagtcaacaagaaggataagtattttcataaggaatggactaaagatgaaactacacagctcacaaaagaagaaacacaaaaacccaacaactgggcagaggttgggggtggggaggcggggcatacagagaatgaagcagaaaatacaaagaacgaagagacaagacagggtcctgaaagagcatgtgccctgtcttcactgggcaagcagtgtttggccttgggccgtggctcagtgaatgcttgttcaacagtacctagagatgaagaatacaggccggctgccaagctacagatacaattgagatgcagataagagaaaggtgggggtaggggatgggttttttatgcataaaactgaacgttgggtcgactttcatggtagagtctattctgtcagtggggttagaaatgacatcattggtgggactggtctttgtgtctgtcccttctagaaagtctccactgacaatgctcagagggtgctctgccattgtcttatgagtcctttctctgctccctcctcctcctctcgccctagggataagggctttttttttttaataccttgggttccttggtgaatgacagtgtgccatttcctctccccattgggctcacattagtacctctgaagccactcacttgaaaccctggcatttatattaccagccccaagttcacaagagcagtgaatgtcactgtttgttccctttgtatttaaataaatcctaacaaatacctcctttctgctcacactggcttcccacgcccccttttcgtttttttctttgtaaacaactaacaaaccacagtggtagcctagttctgaacattcattccctttggcagccgtgttctgtagttctgtatactgatcccaattgcactacaagcaccataatactttttaaaatgtggctttttcctgtgggctggcaagatgactcagctgtaaaggcactcaccagcaaacttaactttgatccctggagcctacacggtggcaggtgagaaacacctccagaaagctgcacatgcaaaacaaatcaagaaatgtaattttttttttttacttaaaataatttctctcctggctttgggcaaaggaaagctataactattttctagaactagtattatcaaaattaaatattgtaaagagaaagcccttgaagaccagcttattacagggcagtggttcacttccctgccaactcatcagttcctttaagagaaataaggagccttgtgtaggacagagactcctacaaaggagcagagtggagaaattaagagaggggcacaaagggggacaagaaaatgaggaagggagagggggaaaggaagaaattttttctgacaagacctttgattaaagagttactgtccctggaggctcatgtgtttggatgctggagtcccagttcatggaagtgttctggagaggattaggaggtgtggtcttgttagaggaggtgtgtcactgggtgtgggctttgagagcccacactgttggcattttgtctgggttccaccccacagttacctgggcaacagccaggtgtgcctgactcattataaaaggggctgcttgcccccttccctctctcttctcttgatctcttcccctcttccccctctgtcccctctcttcttattcccttctcccctctctctccacaagctcatggtccacctctactcctccactctctctctctacctttctatgtctctactaccctttcaactcccccccccccattccctaaatgatgtgtttataaaaagatgaagagaagggaaatatgttctgtggaggtgtggtgaggtatgggagaagggcagtagacagagtccctgacaagggacagggccagacttgcttttcaggtggcaaactggcttttcaggtggcagcgaaccacaaatgggggaggggggtgtctacactgaaagttgctagcaagaaagtgccagtttggtggccatgtagagatactgttttctgttaactgtgaattagaccaagacatcccagtaaatagggccaaagcggcaaagactgacccaggggtgagaaaacagggttattaactgccctgaccagtgtcctgagggcattattaataaccagagatattctagcacaggccagactgccaagtcatcacatgggagcctgggggctacacttggagctagtgctcctgagccagagaacagtttattcagggattctcagccacaagaaagagtctcaaaaggagaggagaatctcacccaagggggaaaaatgagggtcagtgaaagactgaatgtctcccatcctcaaggacaacacagatgcagctctgagctcatgaactcatcccctggacccctgcagatggttacgttgaccagtggagggaaggggcttaccagttctggactagcaagcatggatctccatgtgatagctggggtgggatgcaaacctgcagactttctaaatccgagtctcaacaccattgatgtgtttataaaaagataaagaggggggggttatgttctagcagatatgtggtgaggtatgggggaaggggacggctcagcaggcccatgccaaggcatcccttccccctgaggcaccaaccacacaagagtataatatagaacagaatttattcagggcatggggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatagtgggtcaagctgttgccaggtaactatggggtagaacaatgctaacactaaataaactattttatacgatactgtcatgtgactagtacttcaggggaagggatgcctcagcatgggcctgcagaggaaccccctccccccacaccatacgcctccaccaaacatacctctgaattccttttctattttataaaacacaacacacaccattccgattggttctctttccctgcatcatggttattgtcgcaacatgcatgctcgcagctgctacaccagtgtcatgcctgctactatgatagtcatggactaactatgaattagcaagcaatctcacaataaactcttctatacactgaaaaatagagttactgtcaaaatgaacatcagtctgcttcacgttcctagaaaatatagtgtgcttccttgtagaatagaaaatttcatgtttgtaggaagtaaggaggactgtggaagagcattgtcatgatagtgtaatgataactcatttgcttcaaatcctatttaaaaagaaaagtcactttagctgggtatgaaagcatacagctttaatccaaggaatcagggggcagatgcaaaggctgaaaaatctctgttagttcaaagccaaacaggtctatctagtgaattccaggctaggcagagctacacagtaaaaccctgtctcaaaagtaaaaaaagagaaaagaaaagaaaagaaaatactttattctaattaatttacaaaataaaaacatcacacagctgacttttctaaggagaaatctgaccagagatggcacacacctttaatcccagcactcaggaggcagaagcaggcagatctctgtgagtttgagaccagtctggtctatagagtgagttccaggacagccaaggatacagagagaaaccatgtctctacaaacaaaaatatatgtgtgtgatgtgtgtgtatgtgtgtgtgtgtgtgtgtgtgtgtgtgtgtgtgtggcccattccaaactccatacagatgagtctaacctatgggggcagtgctgggaagatacagagagaaaccatgcctctacaaacaaaaatatgtgagagagagagagagagggagagagagagagagagagagagagagtgtgtgtgtgtgtgcccacttcaaactccatacagatgtgtccaacccatggccctggggtgtgctggaatatttattaacatggcacaatgcatttgtataagacatcttatcacaatgccaagagtctggatgcccctgccatctcatctctgggaccttctctgcagtgagtgaatggatgcctccgtggcatcctgccgcagttggggttggcttgtgccgttgtgctttaggctttcacttttgcactggagtaacttggtcctcagagatgatgcttttccactacgtctgcttgaacttgattagactaacacatctgcatgtctgtaccatgtcaacaagtcactgaaaccctccaggatcctaacatccccctggttctgggcacacgaagaactgttttctcagccaagcagtggtggtacacaccattaatcccagcatttgggaggcaaagacagacatctctgattttgaggccagcctagtctacagagtgagttccaggacagccagggctatacagaaaaaaaacctgtctccaaaaaatgaacaaacacacaaaacagaaacaaaagaaagaaagaaagaaagagagagagagagagagagagagagagagagagagagagagagagagagaaagaaagaaagaaagaaagaaagaaagaaagaaagaaagaaagaaagaaagaaagaaagaaagaaccattttctcatgagatcaaggaccaccaggctatggctgcccttgccagttccctggggttcctggtaagcaatgccaggcctgctaggttcaggatctccatccacactgaagctccaaatggtgatatcatccagtgtgcacccagcaacagagcctacaaccacactgctctggtggctgccagttaagccttagacccaccctctagagtctaaggtagaggctgagcatcaatgaagaccctggctaacaaaagaagccatgcagtcgcttcagatcctgcgtgtatgcctgctccagaagtgcaaaattctctacctcagattctgatgatgtcattcagcatccctaagccacccttgttcttgttccaagatggcacatggagggtaaactgggcagagcagagagccgctaatgttctataggtctctgggtttcaatctaaaggaatttaagatgccgatagataggaaaatggggcactgagacgggaggggtaaggtcccatcctacatccagcagtagatctcagctttctgggtaccaagacccagtctagggaacccttccacatcaatgttctgcagaagaaaattaaaaatggcagacacaagtccatagagcaaagccatcttccatattgataattcctcaagatgcctgggccagatctcctccctgtagttaagggcaaggcagcctccctcagtcatgtgccctgcactgtggtatcattccacttaattgaaccatctcttccaagtctgagggagggcaatttagttcgggagagaacataattatatctacttgctttttaaaaaaatacttttaagatttaaaagttaggaagcactagaatcagaacagtgcctggagctaagtaagtcacgtgaccctcctcttcccaaaccccctcccattttaaatgaggtaaagtcagaaataatgatggcatttatgagagctgattcctaccatgattctaacaactgtctgtaaggaggaaaagggcccgaggagcacaaaacactcggcaaacgcccctgttgtttgtgcctctctcaaggaaatgaaattttaaatttctcttcaggagttggtgtgtgccgactccccacgaatccaggtttttgtaacctgagtacaaaaattactgtaattcacagtcatgcatctgatttagaggatcctgatttgcccgcatccccgttgtctgctttgtccttaggatggcagtaatttaaaccttacttgtaaaatactcaccgcttaagtccagaagttacttgtgaaatggcttaccctattaaaagaattcccaaccctttgtcaaaggtggctggctgttattaaaatgagagaggagtcataaccttaaggatatcaaattccagaagtactgttaactttaggaagaacgtgtagcatgtagcatctacatctgctgcacttactgtgggcatcggagcctgggcttccttctggctcggctggagtcaacctgcaatgcctttgtcacttgaaagatggtatagatggaactactcttcaggtagacaggcaatctgcctggcctgcgtggctggggagccctgaacatgcacagggttcatcttcccagaatcctgcaaggaacaaataaatagaatgagcccagatccagacgccagcacccagatcatagaacattgtaattcaatgtatcttagggttcacctaggtcccccacacttattttatcaaagggaaacccagaatgagctgcagccagaataggcttaggttaaggacggttagaaccactgagactgccaccaaactagcccggtagctctaagcaggttgtagaactcagcctgtcagcgttccccagtgtgataggagtaggcggggttcccgtgggaaatgtgatcaccaccactgaacacaatgtctgtctccaacaaagggctccgcctatgcaatctgtcatcctagctcatcctcctcctcgagacacttatgtttgcctcagagagctgaaatgacagtcaagtggtcttcctctcagggacatggagacagaggtccaaagctcatgaactaacagtccatagaacaaaggcggaaattctttaagtcttctctgctactgtgtagctgcagctgtgacgatcaactttcggttctgtggttgcgggtcccccctggccaaatcaaccagcttctctgtcatgggggttggggggagtctcagacagtgatccttcaacctcaaggctgtccttattgtctaggcaaggaactggtctcaggtctggatgtgtgacagagtaggaagggtaggggacctattttgaaacaaaccacttttaacctagagtacaaccccaaactgcccattgaccaccattgagcacacacctacaagtagatgcccacctggaaatccacttttgaaccagtgtccacctccatccttggtcacacctctgtgtctctttgttcttcgttcttccttctcatctcccataagctaaaacctcattcttcaaaacagaactgggccttcccccacagaaggtcccccctgtaggctctgggttggcaggtagagatgccttgagtgtgtctccaatgttttgtgtgttaaggcttagtctctaggttagcaatgctgggagtttgtagtgggaagccacaggatgtgctgccctccagaaggatttgattcacttcttcagaacccctgcgtcgttctcatgagagagttactataaaaaagagcaagatggctgcctatcatcctcgcttctgttttctgtctttgccatatgatcattctctcttacacatccttcctcaatgacaacatctgccaggacatgatgtactcaggagagttggctccatgctgttcaaagattctgcctacagaattatgagctaaagaaacgtcttgtcattatgaaatgttcagcctcaggcattttgtcaccgtaacagaaaacggtgggaagctgctttcctctattgctttcctttctcatgggtaacataagaagtagcaagtgctcaaattctctggagaacattataattcaaagaagaaacggcaagctactgtctgatcagccatgaggcatgtagttagcctaatatttctgaagattgttctgatactgttacatggtataatgtaacatttgaaatgcctcttctgtcatatgggaatcagagctgcagtgatctccaggaacacactccgatttggtgagaatgtcaggagatacccaaatttagattcttaactctctctaacttcccctaaatcaaccctgtctcctccagggccctgaccctagctgatggattcttctaccagctaccgggtaaggtagattactctggccacagaattatgacaaggcgtttgaaatgaaggtatcctgccctcagtccccctggttcctgaattggagtgtgtcagggtgagtcctggggagctcagactttagcaagctccttgggggagtgtgcaggcctactgcagctcaggagctctgccctgctggatctttagttcactctgctttatctctctagatctgtcagggttctctagagagagacagaccgaagaaatacatcttacaaagtctttattagattggcttacaggaccttggctaggcagtccagcatgggccatttgcatgctggagaggctgaggacccacgaagctggttgccaatttcataccaaaaaacccagaagattgaatggttttcacattgcaatggtaagaagctaagaagccagagcccaatgtcagcaaagagtgtcgactccagcaaggagtggaggcaagaggaggcactggcagagactgtgtgtctcttagttgatcccagatccaatgagttgacaattctaaccaccttacagagcttccatcctctctgaagccagacaacagtgtctgctattgggcatgactccaaaaatggttggcctgattttatcaaccacttacattgtttctggtacttgatctccaaggccaggttcaaagcccaagtgatgacttcccaggggaagcatatcttggctgggaacacttgaccttggatattcaatctctgtgcttacagcattttctttaggagactctagtcaaggactttatcctcagacatttgtcttttatatccaaagaagtcttcctagtggaaggaaatgtaaagtaaggcagcggaggacaccttcagaacagctcgagcccggcataggggcatccttcttaaatattcattagatgaagaaatcggctttacaagctgcatacacacagcattaaaaagcttctgtgagccagtcgtagcatgtgtgaagggttcgtattagcctatgaaacacagggcagtcaggaatggtgaatctgatggctttaaaacatgctgtatgaaccaattctaagtggctctgccatttagtcatttccctattatgtgaccttaacgtggttaagagacatattattcagatctccactatcgtgacaaagtatttgaaataaggaactcttaaaaggacagatttagggcatgcatggtgactcacttgccacttaagcctgatgaccagatcccaaaagttgtttgctgacctgcacacacacacacacacacacactgataatgatgattagaataataatataatatttattttggctcatggttttaggaattacagttcatggtctcttggcctgatgcctttaagcctgtggtaaggcacgaacaacctagccatagtacatgagaaaatagcccacctcctggaagctgaaaagcagagagggaagaggacagggagaacaagaagcagagagaaagaggtgagggagggagagaatgcacaggcccgagccccagtgatgtaacttcctctcactccaccccaggacttaatgtttccaccactacccagccaagctgctgtcacgtggcctttggggatttcaaatgtagtctatcacatggtaggcatgcaggggccttggtctcatgtctggtattttggaggttatagtaagttgatgtcattatcaacaaatgacaattgctacatatttattcccaatttgcttccaatttgtgacaacgtctccgtcccttcaaagaatacgtgagtcgccaaaagtggaagcactctcgtaatacacaaaaggttttccctcctctgactgatttgagaaatgttctcttgaggaaacacttacataacaaatgatggtggggagagtctgttaactattaaaagagacaaaagagatgtctgcactgtgagagaacccagttcatacaggttgtctgtagaaaggtgtttctgagagagcggaatacagatcaggcttatctgatgattaggaattagattgtattaggtaatagaacagtggttatggtagacaaacaaagtccttggcagtcagagatgctttgtcaatgagtgaattagtgtgctgtatggtatttgctttataatactccagcaaagagtgttgcggtatagcactgtggtagaacacttgcttagtatgaatctgatcctaagtgtgtgtgtgtgtgtgtgtgtgtgtgtgtgtgtgtgtgtgtattcattttttttaagatttatttattattatatctaagtacactgtagctgtcttcagatgcaccagaagagggagtcagatctcattacaggtggttgtgagccaccatgaggttgctgagatttgaactcaggaccttcggaagagcagtaggtgctcttaaccactgagccatctctccagcgtgtgtattcattctttgcctttgtttctttctgttgttgataatgtgataaaatgccctgacaaaggcaactccaagaggaaagaaaaggcttatttcagctcacagttcaagggtacagtccacgatggcagggaagtcacaactgcttgaaggacaggagctggtcacagtcaagaatcagagagcaacaaatgcttatgttcagctcactttctccattttatatagtccagaatccaagcctagggaatggagccacccacctcaattaacctaagtgggataaccccaccagcatgcctgaggcccatctcccagtgattctagatctcatcaagtcagctcttagataaccatcacaatatttcgccacgcaaaggagtaggctaggatagaaaagtaattggtgctacagttagtatctgcgctgccctccaaatctgtgtgctaacatttgagtccccagcctaggagaaattgtggaacctttagaggcggggcttaccgggaggaagttaggctactcagggagattatccttttttaattaggtatgtgtgtcagtggagatgtgcagttgagtgcaggtgtcccagaggctaaaagggtcagaagtcagaggtagaagcagagaaggtagtccaggaagttgtcctctgacctccacacatgcactgtgccagttatgcatgtgcctacgcatacattgtcatatgcacacacattcacatggcaataatgatgataaatattttaacttcaaaaccaaaaactaaagtctacaactatgcatacttgcttcatgcaatcccttcagttccagtgatgtcctgtccccctgacagcttagtcaggtggggaagcactggcctggaagacaatgagatattaagctccaaatctggccttacagcgttggggagtaacttcctttccccacagtctcttgttctgtcaaatgggaccaatagactagtgatgcccattttccgggcgtttagcctgatctctattactataatgacatgtcccaggaaatactctttttaatcatgcatatgcatgggttgggggatgggcccaaggcttataaggaaaagaagtgtatttagctaacagctggggaggtcccagtctgagggaccacaatcagcaatggcaccttactagaagagcagagccctaagatggcagggatggaagggtaccatgaccctcacatggtctctctcctccttatagattcacctcattcaattcaagggtcagttcaggtcatcttatctaagcctaaccatgccgccaaaaccacaccccaaaactcccactttttattaattaatttatttattcactttacatccccatcatagtcccctccctcctctcctcccagtctcatcctttctctccccttctccagtttccccctccccttctctaaagccccaccccacaccataccaacctgccctggcccacatctaaacatctcggtcacactgttgtccatcctcctcataagtaacaggggagactaaacttcaacatgagactccagggacatacacattccatgcaaacccacatcattcatccatgacgagtcagcctagcatgagaaaggccttggtcacagggtctatagccttttcctctgccaagaagggacccacttattcactgtccgtggtgtcttatgttttaacctttatggatatgtattatttcaggtacaatgattatattgaggtaaacacttttgatctatcttccacatgattaaattatctacaactcaggctagtaggtagaagcggggaagcacagcttgaccacctaaatttaattagagttgcttacagaaggataggcaatttatcagtgtctatagctgtaaagaaaatatctcttcttcccccacaaccattaactgtatctacttggagaggtcactcataattccatccccgatctgtgaccgaattggccagagctccctggacaattaatgggtccagtcttgtgcagatcttatgctgagagtcacagctgctaagagttcaagagcataatgaacacatcatgcccagagtgtgtgtgtgtgtgtgtgtgtgtgtgtgtgtgtgtgtgtgtgtgtgtgatgtgcgctcctctccagtgctgggattgcagtcacatacctgtacctgtttttttaaacaccggtgtctatggattgagctagggtccttcacgttaccaactgggctatttcccagggcctctgcactcagctgtccataatgcttcaactcttgccatttttctgctactttggctgatggaagagatggctgtgatccagtaagcccagcaggtgactgaaagtcacaatgactccttctttaattaagaagttctatagagccaaatcaacagatggaatccagaaatgttcaattcttgaaacttgtcaccaattcctcatcactgtacccaaaggtgcctaggtcactctgcccaaagtgaggcttcattcaaaaacctcatataaatagtccatcttgttccttaccttgatatagactctctgaggtcaagggtcaccattttcactagatcaactgtgcctgcttgcaagagaccatcacatggagcttgtcgacaggtgactgactgccctagagaagaggaggttggagagaggatcaaggatcagttaaactcccctgagaatccagtgtttcctcccagccatttgtatgctctactgccctaattgcatatggcatgtggtatccagaagtgtgattatctatctctctaggctggaggaggttaaatggggactccatttatgtggctatggggaggccatcatctatgctggacgaagactttcctctgtggtagtcacctatgctcctgtaagcactctgtgtgctataaggaagcccagtaaactcattggttccccagggtgaagttcgggtggagttatactttggttcgtcattgggagcttgcatgcaggttgtagtttgatttgcctttggggtctcgtaagcaaggggtagacattgtttacagctctccagggaagggattctcacaaggagcttgtccaggtcatggatggctgtttaaattcattctggatgctgtaacaaatgccataaggctggcttagaaatagcgctcacagttctggaagttcaaggtcaaggttctcatagaatccccgcagtgttctcccatggcagaaaggatgatgtatgtcctctgaggtgtctcttgttatagtttgttgttgtctggaccaggctgcctttgaactccctatgtagtctacagtaaccttggacattagatcctcctggctccacctcccacatgctggattacaggcacctgttaccacacccagcttatcagacaagcactctaccaactgagccacatccccagcccccaaggtattataaggacacagataccttgaaggtccctcacccacatactaatcctctcatataggaccattttctaaaacttccaacttgtgggtgaagatcaacatgtgactttggggagataaaaatcattcctatcagccgggcatggtggcgcacgcctttaatcccagcactcgggaggcagaggcaggcagatttctaaattcaaggccagcatggtctacaaagtgagttccaggacagccagggctatacagagaaactctgtctcaaaaggaccaaaaaaaaaaaaaaagaagaagaagaagaagaagaagaagaagaagaagaagaagaagaagaagaagaagaagaagaagaagaagaagaaaaatcattcctatcatagccatggcccaacacatagcacatgggctcagccttctgctttctataaggagcactcactctcctggttcaggaaatccattgagtccatccaagtaactccaagttccttcagtagttgggaactaattgcctaacatgcttgtgactaagtggtagacaatgacattgttcaaaaccgacttgttaaactcaaagcacttaacgcatcaagcccaagtctctccaactctaaccacctcgtctgagcttgaggctaaagaattatgatcctaaccagagagcgaacaacaaatttctctacataatggagataaataagaaccttcggggatggagacatggctcagcggttaagagcactgactgctcttccaggggtcctgagttcaaatcccagcaaccacataatggcttacaaccatctgtaatgggatctgatgccctcttctggtatgtctgaagatagctacagtgtacttacatataataaataaataaataaattttaataaaataaataagaaccttcactgcaagatggcagagaggacttcgatttttgaagcaaggtttccaaaggagaggtgatattctgatttttttactttaccatcaagggtcctaacactcaaaaatctctatcccattgttccttgtctctcactccttccttaccaagtatcccattcattcctctatactattttgatataagctaaactcaatatcttccattatcttggtctgaggtcttttgcttcccaataaaccacaggtcagaaccatgattttagttggagaattgaatggttatgaattaagtggttatatcattggatgagaaagataagatttgtcggagataaaagacattccacagttgtggcccaagcatgtcttgcatgggctcagccttctgctttctatattctatgtacactcacaagctctcctggctcagagaatctactgagtccatcaaagaaagtaactacacgttccttcaatagttaggaactaattgcctaacgtgcttgtggctcagtgataaggtgcttgggaaaggtggtcccttgacttcatctccagtcaccataaagccataaccccagaagccctctcagcccaagatctggtctgaccatttcccaagggaacctagggcaggcagccactagttggccagtagcaacaagaccaagggcaggcttgggaggagattccaaggaacggataatggttaagggttggcatcccagtgatgggacacaatgagggagataaacttgcaaatgaagggaaaggcatgaggaccagagttagaacctctaatgccagtgcttaggaggcagagactggatgtctgcagggcaccctgaccagctaagctagcaggagtcagtgagctccgggtctagtgaaaggccttgcctcaacaaatgaagtggactgcacttgaggaagatacccaacatccacttccagtctccaaatgcacacacatgtgcacacacacacacacacacacacacacacacacacacatacacacacactcaccatgtgcatacacacagaagaggagaaaaagagaccatcattactacttgcatgctccttctgcctggacagtacctcctgggtttccaagaccctcagtgtaaccttcccagaaccccaagactgagatggatgcccctctctgcagctgccaggaagtcctgtaccacttccaagcccagtacttaccatacaatataccagtcatcctgcaaaaccggaggtccagggagacagagcacttctggctttatccctggttctgtgtttgtggaataaatgaattctgaagagtctgcaatcgcctttatttttgtaggagctcttgtgtctctgaacaaggtctgttgattatggatgctcaagttccatagtgtacaagagcatccagcaaaaggagggaaggaggctgagatccagtcttatccttgtcactaagactctttcactcagaggaagaggggcctttccccgcttcacacaatagcaccatatgggcttgcagcaggccaaactctgtatgctgaaccactgcctttcaacagagatggggatgctctgctttcctagaaaggctagggctgagggattctataattcttgtttcttcccatccttctccggtctccaaatcttacacaccagtgagtctcaacctgtgggtcatggtccctttggggttcgcatttcagatatcctgcatatcaggtacttacattagaattcataacagtagcaaacttacagttatgaagtagcaacaagataatcttacggtggaggggagtcaccacagcatgaggaaccgcattaaagggtcacgggtttaggaaggtcaagaacctctgctctacaccaactcctctcccaggaaggcttccactcatgcttttctcctctggttttgtcttcttcagggtttgggatgacaacaccagccacaacgggagggaagatttttctgatcttttatggtctcattggatgtgcaagtaccatcctcttcttcaaccttttcctggagcggctgatcactgtcatcgcctgtgtcatgagatcctgtcaccagcagcagctgcgcagacgtggggcggtgacccaggacaacatgaaggctcctgaaaagggggaggcagacagcctgactggctggaagccctctgtgtactacgtcatgctgatcctatgcttggcatcagtggccatctcctgcggagcctctgctctgtacaccaccatggagggctggagctactttgactcggtctacttctgttttgtggctttcagcaccattggcttcggggacctggtgagcagccagaatgctcagtatgagagccaaggactctaccgcttcttcaatttcttcctcatcctcatgggtgtctgctgcatctactctttgtttaacgtcatctccatcctgatcaaacagactgtgaactggatcctgaggaaactggatagcgggtgcttcccaccatgccaaagaggactcctgcggtccaggaggaatgtggtgatgccgggtaacatccggaacaggtgcaacatctccatagagacagacggggtgatggaaagtgacactgatggacgacgtctctcgggggagatgatctccatgaaggacaccaacaaggtctccctggccatcctgcagaagcagttgtccgagatggccaatgggggaccccaccagaacagtgcatcctcccgggatgatgagttctcagggggagtgggagcctttgcagtaatgaataacaggttggcagagaccagtggagataggtaggaaccagaagtagctgctatatgaagaaaaccagggcatgtggggaataagacactgttacaccactggtaagctcagctgtgcctctggctgttgcaattaatatctccagtccaggttttgaaatctgaccttggcctcaggcaagagtagcctctcacagttgagggctggagcctctttccctggctcttactttacttttgaattccaagtttgacatttggaactgctaagggccttgccttcttccagagttgtaatggtctgagggagactggtccagttttggtttctccaccatgatccattcttaggaagggagagcccccaaaaagcctgcttctgtcctggaacgtgagtggctgaacttcacccagcccctcaagaaaaggcaacaaacattccagagtgtctctgggccttctgtttgctggacttccttccaaacatatctattgttggttccattgatggggacactatctcatcttctcttatacctgcttctctgtttgggagtcttggtttctttttgttttgtttcctgtttgactaatatatcttttggatcttatgtgataagaaaactaaatccaccttcaaacctttaagcttggcagtgagtagaggaagagggaaactccatcttgtaactaaagcccacagcttactatgtcctctctgaatggttacacggatcgtgtcattttaccagggcttggagcctggtgcagaggcaactgactatttattagagttgaacatttaataaattctcattttgttaactacgaggccatgagtaatcattgcagacagtgtaaaggaagctggagctatgagcctcatcatggagtctgagctggagcctaacattccagcccacataatgaagtgtggctttctggtcccatctgcttctgagactgtgccaaggacagagatgtgaaactcccagaccattacagatagcctccttcctaggaatggaggttgctagccttctgacatgcaagagaaaaacgtgtaaggcatagcaggagtggttttttacaagattaaaatgggtacacacaggactctcagaagtgattaggtggaccagaaaagaagacagcagaaaaccagtcaagggaagggcagatcggagctttcgaggtcagggcaccctagggcattgtctcacaccacccttgactgtcacaaaggaagctgcaggtgactcagagaccagcccctcatctgagtctcaggcctagctagatgcagttgggagaaggactcaggaataaacttgggtctcttggtcccttctccatccagttctgagccctctctccaggcttctctgtaggctgtaaaaccttttctttatcttacagtttgtgcctacattgctcttaaaaggaagcaacctggagttgctaccaaatctaagtgggtaattgtcaccacaaagcaagctgccccctctgctctgtgccaccaggagctgggtggtccttcttaacagtttattgatgctcatattcctggtacaagagcgagcatagagcaggtccttgcttccctgtgcaggtccctagagaccacattgtgtcaggagaccaggggcatccttgcagtcagggctcatcaagtgggtcaacttcaaaagaggatgcttacagactttctccatcatgatacgtggattcctgtaagtgggctccaatacacccataaactttccagctgtgatgtctgtctgttgagacaggtactcgtggctccatctggctttgaacacgtgacctttttagtttctgcctcccagatgatggaattacaggagtgagcgacagtgcccaactcagccaaagttttagaaaattgaacttgggttccctcaaaatcgtctttgaatctccgagcttgagctggtttttctctgggctgagagctccctagggggaacactggagaatcagtgttaagagaagtgtatggaagagaaagaaggaagggagggagggaggggagggggtcaggaggagagggagggaggaagggaggggaaggatggaagaaaggaagggaagaaggagtaaaaaaaaaacttgaaaaattaggaaccttcacttaataaagtctctctattgttactcatagacatgaactggttaacaggacattttagacagtaataatcaaagcccaagtccacgaggctcctgatggagtagcagatacacacagcaagggaggccgagtgcatgaggctccagatacacaccgcaaggaagcaagcttgctaacggtagctttcctgggtgatgatggcagccatgcctttcctgggtgatggcagccatgctattgcctcttgccacctcggttatcacctggtaggctttccgctctccttaaccaggcatagcaatgggcccaggatcctgtgtcacgagttcagggtctccctactgatgttgctttcaggctttatgtaggaagtccgggattttctctgacacaggaatgggacccccggcagcccatttctctgaggatcagcccatgtcgcttgttgtggcagaactccacgcttccatctcctcaacattcccatcggctcagtttataattcattttgtttttaaaagagactgtcataccaaatgaaagcctgtaagcacttgctataaataggcgatgataaagtaaagctcaaactgtgttattaaattctatccaaatcctgtatctcggcaaaggctctaagcccgaaggcttttctctcttagaaaaaatggagaataggtggccgtagtagtgcctgctgaggtgagaggacccagagctcaggaccggttttttgatggtatagtaagttccgggccagccgaggccacgtgagaccctgtcccaaaacaaaaggccagagagatggctccgtgggtaaaagcttgctctcaagcctgagttcaattcctgagacccatgtgatggaagaaaagaactatcacaagctgtcctctggccgtcacagcgtgtgcgcgcgcgcacacacatgcatgcacacacgcgcacccacaaaaaatttaaaaaaaaaaacctatgtcatttcatattgttaaacgacaacagaaaacatgttatcaaatgtcgggaaggggaggggacacctgaatcagacttgttctatgatggagtcaaaagaaccaggagagagttgagaagaaacaattccttataatgtgattctgtgttaatgccacactgagggccgctaaaggcatctcacactctgcccatatccttggtgtccacatctggaacagcagcacacagataacagagcactgtttctgaggtcaggccagtgtgtgaacaagcagctctttgtgtgaggatgccagggcttggatctgagcgctggaaagggtgggcctgtcacttaccacgctgagccccatctctgtagaacaccagcttcctctgcaagctgctggaaagatccaataaagtgatgcccagggagggcatcaggactctgagaaaccatttgggcagtgggctgcaggtttggatttgaagaggggaggtccactagcactgcatccagctgggaaagattttgcatgccatgccatttaaatgaccgtgtttctcccgttattcaacggtgtccccttggttttgttccacctcccacaccccaccaccaaatccttgtatctgttccagagagcttccatttcagtatcagctgacctcatccagtcacttgatacaatacaacgctttggaaacgatcacacacacatacagtcacacacatactttctcaatacacacacattcacacacacatacactctcacacacacattcatatacaaacattcacattctcaaacacatatactctcacacacatacacagacattcacatgctcacacacacacatatactcacacatacatgcacacactcacacacacatatactcacactcattcactcacacactctcacacacacacatactcacacacatatactcacacactcagcgttttaagatctagggcttactcatatttgtaatattttcatgaccacattttggaacaggcaggcacttgtcctcaaactcctctaacctttttggatagagagggataagtaactatctgattttatcccaaccactgagaattaggatggcagagnnnnnnnnnnnnnnnnnnnnggtttgagagtatatctgggagtgatctcctttggtgttctgatggcaattccctaatgcagtagttctacctatggacattaattacagttcttctatagagaactagttccccttctgcccaccactgttttaaaatggtagggaagtttctgtaacattcctttcaaggcacctttgatgacaatgaattaattctttcagtcgtgatctgtctgataaaagtccttgcctccactttctctataggtgtgtgactgagtggggagagagagagactgtatgttcacatgtggaggtacatgtgtgtgcatgtatgtgcatatggaggccagaggtattcctaattgatcaccactttatatactgaggcagggtccctcactcgaacccagagctcactgatatggttagtctgtctagggagcttgttccaagggatggctgttctctacctcctgagcaatgggtgtaccaccacgcctgcccagcatttctatgcatactggagatctaacctccaatgctcacgcatgcacagcaagcactttacctactgaagcaactccccattgacagaattctacactgccaggtttgaaaaaataatgtagcccttcaaatagtaccacacagttatcctttgatttgtgtggcttctactaagaattttgctaccgttttcatggttcttgagaacataatgttccttttttttctctagctggtttctaaattttttctttgtgttttgtatcgggcactttgtgcacagtgtatatgtggtgtgtgtgtgtgtgtgtgtgtgtgtgtgtgtgtgtgtgtatgcgcacacacacatgtgtgagagagaggggtacaagattaatgatatgcacaggcaaaatccactgatgaatatttaatgatataaaagttcaaagcaaaattagtgtgtttgcagtctcaaggggtggctatcaaaatatttgatagttagggctggaactgtagctcaatgatagaattcttacatagcactgtgaggccccaggttcactcgccagcaattataattatttcatacttatgaagaaaacaaccacagtggcaaattctggtaggcatcatgattctcaagaaaactaagttaacattgtagtgaaaggtgtcgcatctgtgttatctgacacaacatgccaagccctgtgttctcacagtgacccatccctgccatgtggtcacatgaggacatcagctgaagccacactgaggagcatcctggggaataactagccaggactcaggtcatggagacagatgagctacgtggagagtgcagaggagacagaacaaagccgtagttcatgttggcccctggaactaaggtagtttagggtcctgggttggatcatgaagtgtgaaagggacactaaaatgggaacaaagtccaatgaatggtggtgtctagttgatagccttgcccaagcttaaatccttagtctgaatgagtgttctgtggttatgcaagatgttcgttcaaggggaagttgggtaacaagtatatgggaacactctgcactatttttacaatcgcatataaggataaaattatctcaaagtaaagaaattaaagagaaacaaaacaaggcgttccgcagctggcatagccaggcacacctggactggggcgtgacttgagctcacagctgtgacacaagttcagccttgtgtcctcagcagctggggacactagcttgaagtgaagtttttttgggaggtggggcagttcttgagccaaaggctgcagtatcagtgactggaaacttgctacagatgcaaattttcaggccataaattcaagaaaggaactccaaatcccaacgttagcaggttctgaaggcaaggttccagtgggctaaaactgggaagccactggaatcgagctctaatgatgcagttttttgggtggattcgggttattgattgtacgattcacatgtgcagaatgtttttctgaattggttatgagtattttgctttgtttttggatcaggggatcaaggctacatattttaaggctaagcatagagttcatgcgaccctgtgtcaatacacacataaatacacacacacactgtaaattaattaatagataaggtctactcttttagtcatgtgttaggaaggcagacatggtccccattgcaccttgggcacataactgtgttgtggttttatgctggtgccatgaggacaggaatccagactgttcctgcaggtcagtaccatcccactgtctctagggtgggttaactgtctctagcatatactcttgttgaaaatgtccaccttaaaggccgggcggtggtggcctggtctacaaagtgagttccaggacagccagggctacacagagaaaccctgtcttgaaaaaagaaagaaagaaagaaagaaagaaagaaagaaagaaagaaagaaagaaagaaagaaagaaagaaagaaagaaagaaagaaagaaaaggaaagggaaggaaaggaaaagaaaaagaaaaaaagaaaaagtccaccttaggggaggcagccatgagaaccagcctccaccaaaattctaatggcatcaccagctctgagattccctctcagtcttctagaactttctcttcaccacctcctctgttaagctgagcaggcccacttcagcctgcaaggtctctgcccctatgtgtccccaagtcacctgcttactcatagacagtcttaccatgctttattttatttttgtctcagatttttgctagaatattcttgtttgatagcttaggggcctgttttttttttattattattattctctccttaaactctttgaagattaaactgggtttttatctctctcctactggcccatgtggggatcaataatagccttttattcacccttggaagaaaagatctaagttttagaagcaatgcttattatttttctcagtactgtactttaagacaaaactgtgtagagatggaaaaataagaacctgcattccatcaagcaatgtgcttcagaacactaggcctaccagacagaaagaaacacgtctctggtacatagacaaaaggttcatccccagggaagaaaaaagctttttcaccaccctaccaaaagtaacctgcagattcaatcaatccccatcaaaatttcaacacagttcttcatagaaatttaaaggacaatacttagctttgtataaacatacagagagagagagagagagagagagagagagagagagagagagcactacaatagctaaaacaatcctgaataataaaagaactgctagaggagtcatcatccctgatctcaaattgtactacagagctttagtaataaaaactgcatggtattggcataaaaacaaacacattgatcagtggagttgtggacccagaaatgataagttcacacacttacgcacacatgatatttgagaaagaaacacacactggaaaagacagcatcttcaacaactgctgtttaaactggatgcctgcatgtagaagagtgcaaatagatccatatttaccaccctgaataaaactctgctccaaatatatcaaggacctcaacaaagggccagatacactgagcctggtagaaaagaaagtggagaagagccttgaactcacaggcacaggaaagactgtctgaacagaatttcttagtacaggcaccaagaacaattaataaacaggacctcataaaattgacaagcttctgtggggcaatggacactgtcattcacacaaaggagcagcctacagaatgggaaactattcttaccaacctcacatccaatagaggattaatgtccaaaatatatgaagaactcaaaagaactggattcaagaaaataaataatccaattttaaaatggagtataaatttaaacagagttttcaaaagaggaaataaatagctaagaagcacttagggtatgggaaaacactcattcattgctgagaacttgcaaatttgtacagccactatggaaactagcagacagttccaaaggaagctaggagcagttctacctcaagatccagctatactacctctgggcatatacccaaagctctctacatcctaccacagggactcttgctcatccgtgttcattgctgccctattcataaaagccagaaattggaaaccacctagatgttcatcaacaaatgaaaggataaagaaaatgtatttacacactggaatattactcagctgtttaaaagagaaaacactgaaatcatgaaattcacaggtaaatagatggagttagaaaaatgtcatcctgagtgaagtaacctagaccccccccaaaataaatatggtatatattcacttatatggtggacattagctgttaagtcttgataagcaggccacaatccataagcaggggttaggtatagagtcaggggctaatggggtggcaagactctccctaggaaggggaaatagaagtagggggatcaaataggaaggggagggaagagtctggaaaggaagagaatacagaaaggacagctaaaactaagagttgagaggccatatgaaaacataatagactagaagctgctttaaatatatatatgtatgaaaaaaatctaagtcagagtcaccaaacaaggggaattggagccccactgaacatctctcatcaccaaatgaagcctccagttctagaaatgggttatatctaattgagttgttaccaagggggttcgatagaagccctcagataacccaagctattgtcaaggtattgggtgctctctacaaactgatggtaaagtcatattgctgaagatgagacctccatgagacctccataattcactgaacacagagaagtcaagttgttgcctacctagagccttcaccccaactaactagtgttcatggttctggaaggcactctacataataccagaagagaaaggtaaacaccaacctgtagggggaggttctgatgataaagtcctgctccccaattggttcttgatctgtcagtaaagaaagccatgggccaattgctgggtggaaggtacaggcaggacttccgggacttccaggtccctggaggagagagagagacacagggaaggagaagggagttcactatgccttggagagatgacaaccaggcaaccatgtgagatctcaaaacagagtggccacatagactgctcttacagcaagtagtcagagtagtttagcaagtgaagttaagggcagatgggagagacagagataagaaattggtaagggcatgcttttctaggagggaaagattagcacccagcaatttcgtcagaaggtgcattgaaaacatataactctgtgtgtgtgtgtgtgtgtgtgtgtgtgtgtgtgtattttatctgtggattcaaaggaagatgggtgggggctggtagtacagtcactccccagagctaaaggcaggtagagcaaaaactatatgcaataccaacccagctataaactctgcatctgtcatgtgacctgcctgcaagatacaccagtgcaataatagcacaaaagttgtgggagtaaccaacccactgtctgattgaagtaactaactgactatctgattgttattccatgagatgaaacccatgtccaaaactgcctgggtggccaagaaactgagactagatatgccatgaacctaaaggaaaaaccactgtactgctgaaggaacacagcagtaaaatgaccctagtgacattttgctatattcatagatcagtgacttagtcatcatcagagaagctgcctcctgcagtagatggaaacaaaaagcccaccactagacatgtgcagagaatgagaggccttggaacatttagttccaaaagtctccatcaaacccctcccctctgggctcagagagctccgtggaaaatgaggccaagattgtaaaagccaatggagatggaagacaccaaagaaaaaaggccttcccaacacggtagaactgatgaacgtatgcattcccagagaccttggcagcatgcacaaggcctgcaacaggtctaagccagacggggtcccagtgctgagagggaaaggagacacaagcccaagtacctaacccagaagctatctctaattaagaaccattcaaagaggaaaaattcattttctccaacagagtctcactgagtctataaaccacacttaagggcaggccccatgcatagtgttaaacagccaacacaaaacaaactggagggtatcttacaggatttttcttttctttctctctttttttttctttctttttttttttttttttttttgtctcaaaatgctttgtcttcactatttcttttttaactttgcagatcttttgcttatagactatgatcctcaattttatttttatgggttttctgtgaatgtgagtgtgtgtgtatgtgtgtgtgtgagagagagagagagagagagaaagagaggagagagagagagcacgcctctgtttttttcttgtgattttttt

SEQ ID NO: 128 - DNA, 2268 bp, Mus musculus
gagaactccagagaggacagggaggcggcgacgacaaagcggattcgaaaccacgagtccaggcggacgtggggagctggctacacaggaaccaccgaggaggcggcggcggccgggagatccacgccgccttggggaacgcgcggcgggcatgggcgagcccgcacgcagagcaggctaaggtcggcagagcacatcctccccggggcgtgggcacaagtccgcgggcagcaaccctcgcggagctgtcctccagtgccatggctggccgcggttgcggctgcagccccggccacctgaacgaggacaacgcgcgcttcctgctgctcgctgggctcatcctgctctacctgctgggcggcgccgcagtcttctccgcgctggagctagcgcaggagttgcaggccaagcagcgctgggaagagcgcctggccaacttcagccggggccacaacctgagccgtgaagagctgcgaggtttcctccgccactacgaggaagccaccagggcgggcatccgcatggacagcgtgcgccctcgctgggacttcacgggcgccttctacttcgtgggtacagtggtttctaccatagggtttgggatgacaacaccagccacaacgggagggaagatttttctgatcttttatggtctcattggatgtgcaagtaccatcctcttcttcaaccttttcctggagcggctgatcactgtcatcgcctgtgtcatgagatcctgtcaccagcagcagctgcgcagacgtggggcggtgacccaggacaacatgaaggctcctgaaaagggggaggcagacagcctgactggctggaagccctctgtgtactacgtcatgctgatcctatgcttggcatcagtggccatctcctgcggagcctctgctctgtacaccaccatggagggctggagctactttgactcggtctacttctgttttgtggctttcagcaccattggcttcggggacctggtgagcagccagaatgctcagtatgagagccaaggactctaccgcttcttcaatttcttcctcatcctcatgggtgtctgctgcatctactctttgtttaacgtcatctccatcctgatcaaacagactgtgaactggatcctgaggaaactggatagcgggtgcttcccaccatgccaaagaggactcctgcggtccaggaggaatgtggtgatgccgggtaacatccggaacaggtgcaacatctccatagagacagacggggtgatggaaagtgacactgatggacgacgtctctcgggggagatgatctccatgaaggacaccaacaaggtctccctggccatcctgcagaagcagttgtccgagatggccaatgggggaccccaccagaacagtgcatcctcccgggatgatgagttctcagggggagtgggagcctttgcagtaatgaataacaggttggcagagaccagtggagataggtaggaaccagaagtagctgctatatgaagaaaaccagggcatgtggggaataagacactgttacaccactggtaagctcagctgtgcctctggctgttgcaattaatatctccagtccaggttttgaaatctgaccttggcctcaggcaagagtagcctctcacagttgagggctggagcctctttccctggctcttactttacttttgaattccaagtttgacatttggaactgctaagggccttgccttcttccagagttgtaatggtctgagggagactggtccagttttggtttctccaccatgatccattcttaggaagggagagcccccaaaaagcctgcttctgtcctggaacgtgagtggctgaacttcacccagcccctcaagaaaaggcaacaaacattccagagtgtctctgggccttctgtttgctggacttccttccaaacatatctattgttggttccattgatggggacactatctcatcttctcttatacctgcttctctgtttgggagtcttggtttctttttgttttgtttcctgtttgactaatatatcttttggatcttatgtgataagaaaactaaatccaccttcaaacctttaagcttggcagtgagtagaggaagagggaaactccatcttgtaactaaagcccacagcttactatgtcctctctgaatggttacacggatcgtgtcattttaccagggcttggagcctggtgcagaggcaactgactatttattagagttgaacatttaataaattctcattttgtta

SEQ ID NO: 129 - protein, 487 aa, Mus musculus
ELQRGQGGGDDKADSKPRVQADVGSWLHRNHRGGGGGREIHAALGNARRAWDHAEQAKVGRAHPPRGVGTSPRAATLAELSSSAMAGRGCGCSPGHLNEDNARFLLLAGLILLYLLGGAAVFSALELAQELQAKQRWEERLANFSRGHNLSREELRGFLRHYEEATRAGIRMDSVRPRWDFTGAFYFVGTVVSTIGFGMTTPATTGGKIFLIFYGLIGCASTILFFNLFLERLITVIACVMRSCHQQQLRRRGAVTQDNMKAPEKGEADSLTGWKPSVYYVMLILCLASVAISCGASALYTTMEGWSYFDSVYFCFVAFSTIGFGDLVSSQNAQYESQGRFFNFFLILMGVCCIYSLFNVISILIKQTVNWILRKLDSGCFPPCQRGLLRSRRNVVMPGNIRNRCNISIETDGVMESDTDGRRLSGEMISMKDTNKVSLAILQKQLSEMANGGPHQNSASSRDDEFSGGVGAFAVMNNRLAETSGDR

SEQ ID NO: 130 - DNA, 144068 bp, Homo sapiens
aaggtttcagtcttcttaaatcctgcttcttgatctcctctaataccatagcacactcaagaaatgagcatctttaattgtgcttggattggcagaatctgcctttagctggaggagcagacgtaatggctttaatgagctacttaactactttctagagacaaccaagagacacttgaagagcccagtctgagacctggttccacctttccatcccttctgtgtccctgcctccagcccccacccccaggacacatctggcagtgaagggactccaattcctgttctagggagtggcccccacttgtgctcaaagtataattaagtggcttaaaagtaagtgcaagggtccggagaaggacttgactgcatgagggaacttttagaggttatagaaatgtttctaccataattgtggcattggtaacatttaacaaaactccttgaattatataccaaattggtaatttttattgtatgtaaattatagttcaataaagctgatttttaaaatactcaatgtaaatcctgatatgtgcattcattgtatgtaaattctacatcagaaaggaaaaaactaaacagttgttgaattccagttaatgatatacatgctgaagtatttaggggcaagcatatagatatctgcagtttactctgaaatgcataaaatgtaagatatattaatggacaagtagatacatgatcaggcaagtaaataaaaatgtaattgtccaatctaagtggtcaatttacaagctgccattgtaaaattattctttgatgtgtttgaaaatgtcattatacaatgttgggggaaaccaggtgacttcaggtttttggcagagccaaagagttcctattggaccaattctttagcaaataaaaactgtaagctctggaaaaaaaccttctttaaaaaccaacttcttaaagatactgaaatagaccaaaagcaggcagataccggagaggagtcagtggaggaagggcacgggactgtgtgagttacctgtttttttaccaccgttagcctgaggccaggtgtccgtgcactgtgcaggacaggtaagcctccagtgtacaatctacagtctcgctggcttgaggaaccagagtagagagttcagagcatcacagcctctcgagagtaaagggggaaataacagaaaagcaagccagagaggggattcctaaattctgtatataaactgctcaaatctctagctgaccactgaactatgcatgcagaactaaggctgaaagaactgaactaaaagttgaactacttcccactgcaggggaaacagttttgtcactgagttcaaccaagttaactgcatgttttaaaataattatttttcagaggaatataagagaatcctgagtttctacaacacaatgtaaattatacactaaatacaatgtctaggatacaatccaaaattactcactatctgaataaacaaaaaagtatgcctcattctcacgagaagagacaaaggagatcaaccccaagaagttctagtcaaagctattaaagcagctattaaaactgtgcaagaatgtgaaaaaagttcccatggtaatggccgaaaaactcccaaatttggtgacagacataaagttacagattcaagaagttcagtgaataataagcaggattaatacaaagaaaaccccatctaggtgcatcatagtctactgaagaccaaacttaaagagaaaatattgaaatcagctacaggaaactagggagtaatgatttaaatgactgctgacctctctttagaaacattggaggccagaagacagtgcaacatcatctttaacacgctgaaaggaaaaaaaagtcaccccagagatctgtatccagcaaaaatatatttcaagaatgaatacaaaaaaaaactaatattttcagataaaaggaaactaagagaatttgcagatctaaattacaagaaatgctagaggaagttcttcaggctaacgggagattttaccagagggaaactcaaatctttaagaaggaataaaagccactgaaaatagtaaacatccgagtaaatacaaaggatgtcttctttctcctctttaaactgtgcattactgtttaaagtaaacaataggcaggtgcggtggctcacacctgttatcccagcacttggggaggccaaggcgggtgtatcacgagaacaagagatcaagaccattctggccaatatggtgaaacctcatctctactaaaaataaaaaaattagctgggcatggtggcacatgcctgtagtcccagctactcaggaggctgaggcaggggaatagcttgaacccaggaggtggaggttgcagtgagccgagattgtgccactgcactccagcctggcgacagagcaagactccatctcaaaaaaggcaaaaacaaaaacaaaaacaattggtgggattttagcatatgtaaataatttgaatgacaatcatggcataatagatgcagggaagggaataggaaaggatcctatacagtaagctatctatattttatgcaaagtgataccatgttagttagctcttaactgtgaaacgttcatccctggaacaaccacttaataatgtagagatagagctaaaaagccaatagataaaaatgtctgctctgagaaagacaccattaagagaataaaaagaccagccacagactgggagaaaatatttgcaaaacagttatctgataaagccctgttaaccaaaatatacaaagaatttttacaattcaacaataagaaaacaatgagattaaaagatgggccaaacgaggagtttgagaccagtctgggcaacaaggaaaaaaaaaaaaaaaaaacttagctgggcatggtggtgcatgcctgtagtcccagctacctgagaggctgaggcagaaggatcacttgagcctaggagttcaaggctatagtgagctatgattgtgccactaaattccagcctgggcaaccgagcaaggctctgtcccttaaaaagaaataggctaaagacacctcaccaaaatatacatgtggcaaatacacataggaaaagatgctccacacatcatatgtcatcagagaagtataaattaagacaatgagataccactacacatttattagaatggccaaaatccagaacactgacatcaccaaatgctggcaaggatatcgagcaacagcaactgtcatttattgctcatgggaacacaaaatggtacagccactttggaagacaatttggcagcttcttataaaactaaatatagttgccatatgatctagcagttgcacttcttaatatttacccaaaggagttgaaaacttatgtccacacaaaaacctgcacacagatgtttatagcaattttatccataactgccaaaacctgaaagcaaccaagatgttcttcaataggtgaatggataaataagcagtggtacatccagataattgaatattatccagcgctcttaagaaaatgagctatcaagtcatgaaaaggcacagaggaaacgtagatccacattgctaagtgagaggagccaatatgaaaagactacatactgtatgattatacctatgtgacattctggaaaaggcagaactttggagacagttgaaagaccagaggctgcaggagtgggggtggtaggatgaacaggcagagcctagaggatttttagggcagtgaagctactctgtgtgatactataatggtggatacatgtcattatacatttgtccaaacccatagaatgtacagtaccaaaagtgcaccctaatataaactatggactttgataatgtgttaatgtagattcgtcagttataacaaatgtaccgctctgttgggggaggctacgtgtgtgggggagcaggggtatttgggaaatgtgtaccttcctctcaattttgctgtgaacttaaaactgctctgaaaaatactctattaactaaaaagacccagttaatccaaaagaagtcaggaaaggtggaacagagaagccaaaaatagtggggacaaacaagacaaatagtaagatggcagacttaagtccagtcgtataaacaactacattaaatgtaaatggtctctatctgcactaagacggcagccacaggccacgtgcgatacttgttaattgacattaaataaaatttaaaagtcagtctcttcattgcagtagccacattttaagtgctcagtagtgactcccatatttcactagtatattgaagagcacagatataaaatatttccattatcacgtaaattctattgaccagcattggtctgatcaatcatggagattatcagaactgatacaaattccccccaaaaagacccaactgcatgctgttcacagcaagtccacttaaaatacataaactacacagataagttaaaagtaaatggatgggaaaagataccatgcaaatgtcaagcaaaagaatgtggtgactggattaatatcagataaagtaaacttcaaggcaaagggtattaccagagataaagagggacatttcatattaataaaagggtcactacaccaataagatacaataattataaatgcatatgtttaataacagcttaaaagtacatgaaacaaaaagtgacataaaggtagaaatagatgattacacagttacagctggtgattttaaatattcctctcaccaatcaatagaataactagatcaaatgtcagtaaagatagatcataaaaataccatcaattacttttaactgacatttatagaacactacagccaacaactgcagaatacactttcttttcaaatgcacatagtacattcactaaaatagaccatctggttggaccattaaataagtctcaacaaatttaggaagattgaaaacatactgaatatggttctctgaacgcactggaaataagttagaaataaataatgtgtcttttttaaactccagatatttggaaattaagcaacacgcttctaaatcatgtgcccccaaaaaaatcagaaaataatatgaataaaatatgaaaatacaacataccaaaatttttaggatgcagctagcaccaggctaacagggaaaggtatagtttaaaaatactaatgagagccaagtgagagggggtcgctggagaagctccaaccagcctgcctactgaggtggagctggagcctggggaagttcacgacccttgcagcagggaggagcccggcccctcctcttctagtgtggaacctgggattcaagctgccggctggaagcgctctagcagggactctggcctagtaagagtccctgcttctcccttttcttccctttcacccaataaagccctgcgttactcaccctacaaaccctctgctaacctaaattttcatggccgtaggacggacaaggaccccatctttagctgaactaaggaaaagtccagcaacactaacattagcaaagaagaaaggtctaaaatcggtgatctaaacatccaccataagaagctagaaaaagaagagtaaactcagaagtagaggaataaaaagaatagagtggaaaccccaagtgcaacatatcccagaaatgcaagattggcttaacattagaaaggcaatcagtgaaatacaacatattagcagaataaaggagaaaactatatgatcatcaccatagatgcagatatggcatttaacaaaattcagtactcattcatgcttcattaaaaacaaaaaactcggccaggcgcggtggctcacgcctgtaatcccagcactttgggacgccgaggcgggtggaccacgaggtcaggagatcgagaccatcctggctgacacggtgaaaccccgtctctactaaaaaacaaaaaattagctgggcatggtggcgggcgcctgtagtcccagctacttgggaggctgaggcaggagaatggcgtgaacccgggaggcggagcttgcggtgagccgagatcgcgccactgcactccggcctgggcgacagagcgagactccgtctcaaaaaaaaaaaaaaaaaaaaaaaacaaaaaaccaaaaacaccagaaaactagaaacaacaataaaaggaaacttccttaatccgatagtttctatgaaaaccccacagctaacattatataaatgatgataaaaggaaagttttctcctaagatcataagacaaggatatctgcttccacttctattgaataatgtactgaggctctagccgttgcagacaagagggggaaaagatgataaagatcaggaagaaaaaagcaaaacttgtagatgacatgattatttacaaagaaactcctaaaggaatcaacaaaacatgtacaactgatgactaaagtagcaaggttgaagaattcaagtatttttgcaacaatcgtgtatttttatggactacagcaaacaattgaaaagtaaaattttgaaattccatttacaataacatcaaaagaatataaaatactttagaatgaatttacaagagatgtgcaaaatctccatatgaaaacttggttaagaaaccctaaataaatagaggaatatacctctttcatgaattgtcaagatgttcttcccaaaatagatccaacacaatcccagaaatcaagatcccacagctttttggaggaaattaagctgattctatgattttttagtggaagtgtaaaagttttataacatccaaagaatcttgaaaaagaagaacaaagttagaggactcaattatagtcccactaaagacctactatagagctataagtatgtaaatcctgtggtattagcataagggtgggcaaataatgaacaaattaaattcctgaaactcaggcatatttatcttttcaacaaatagcattggaataactggaaatccacctggacaaaatgacctttgactcttacctcataccataaggaaacaaacttaaatggatcgtagacccaaatataaaagtgtggggagacagaaaacctatgcaaccttgaaggaggtaatgatttctcaaagggcaccaaacatacagaaaacatatttaagaaaataaataggcaaatcagagttagaaaatatttgcaagatatgtatctgagaaagtactcgtatcctgcatatataaaggatctctataattcagtaacagagaaactaattttttaagtgggcaaaatatttcaacagaaaattcacaagagaaggtacacaagtggccagcaagcgcattagacatcagggaaatgcaaattaaaaccacagtgagatatcgctacatccaccagtatttttagacatcagggaaatgcaaattaaaaccacagtgagatattgctacatccaccagtagttttaaaattaaaatgactgatactgccaaatgttgacaaagatacggagcatccagaactagtgtacactgtcagtacagctgctttgggaaaatgtcgggcagtttctcataaagcaaaatacatacctaccctatgacccagcaattccgctcctaggtctttacgtaagagatatgaaaacatatgtctacatagttgtacaagaatgttcctaacagttttatttatgatgaccaaaattttctaacagttctcctttctatcaataggaggagaatgaataaacaaactatggtatacccaaacaatgaaaaactagcaataaagaggaaggaattactaagacatataacatgggtaaatctcaaaaacataatgttttccaccaaagagtacataccggcatgattccatttatatggagatttagaacaaaaaaacagttctataaaagcgaaagtaatcgatggtagaaaaattctgaacagtggttttctctggaggaatgtgggtagggagttacagggaagggacttagggggaccctgttggtgatgtttggctggtaggttggataggtgatttgcagaggtgtacccatttgtcagaactcacctaatgatacacttaagatttgtgcatttcattgtatgtaaattttatccgaaaaggaaaaaaattctgcaagtaaatattgaaccctacgtagtgatatgcaggcagaagtactggggatgagggcggaagtgtaccaagctctgcaacttactctgaaatgcatccaaacaagatgggttgatggatggacagagggacgggtagatatctaataaatcaagtatagtaacatgttaattgtagaatctaggtggtgggtatacgggtgttcactgtaaaattctttcaactttttagaatgtttgaaatttttcataataaaatggatttaaaaggtaattgcagtactcaccctgggtgtatacacatgcacccattctcgcgatgcccctaaagctcttgcccctcagaaggctagatgaaagaggggcattggggagtgagtaacagagccgagaggactgctaacagcaccagggtttctgatgaaaatgcactcgccagagctgtgtttctttattcgaaatcacacggttttactcaacagggctcctagcccttctgtctctgctcctggtgcgtaagggcggtgtgtggggctctgcgcctgaaaccgctctctcggaaggtgggaagatgcccacgtatccattcctctccgcgtacagattcgctcccacacgcccgggcgggtgattccggagggccgcgcggggctgtgtgcgcgggcgggggcgggatgtgtctggagggggcagagcgccctctcccggccccggagggcccacgcggaccggctgagcgtcccaccagccggttctgcatccactacccagatctccgcgccctggtgggagcaccgcagccccgggtcggcccttcgaacgccgagcgtctacccgcggagaccagcgcaggaggcgggcccgcgcgcaaggaggcgggcgacagggtggagtcgccgcagctggcagccgcacggctctacctgttgcagcgtcggagcgcgcccgcctgagaaggcagagcgcggtgcggacctgtgctccgcgcgccggctggcagggcagggccgcggctgccaggaggcccgggaacagtcccgacggagcggcgcggagagggcgctccccggaaggtgagatctgagcgcggcagcggcgccagcgcccgctacaaggcggggtctcggggagggggccccggcggtttgctggagagccttgctactgttctgcatgaggtgggggatgccttctgcgcggaccccgcgtccaggcaaaactctggaacgcactaggcagccaagcccggggggaagagatggaacgctccaaggtcaaggtctcctggccgcggagcccttccagcccccagtgtttggcctcctctccggaagcggggctggctcgcggtgcgcgcttggtccgggcggagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctggggaggcacctacaaagccagcagactgacacccgtgtcctagccgtcggcggcctgcgaagcgatagtcaaaggaaccaggacccaggaccccggcgctctgcttacccgcagacctccggaccgcgccccccccccgccgccccgccccgccccgccccgccccgcgaccgtctctttgcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgcatgttaacaaagtccccaaaggattggaatgatccttaaattggagacgctctgctctgggagattttcagtctaatgaaggagacacggcttgagttcatggggaagaaggcttttacagatagggacaggaaactaaacatttactgagtcagtcagaggggaagtgcagattttaaaagattctgccctcgacttcacacttaccgagaaaaaatcagaacagcagactgaaagtgaggaagcaaaagtgccaatgacggttcaaaagatggaaaattttccaccaggaagaaccagggaagtgacctttgggctgaatcaattcgtgttaggcataacttgggtttgggaactgaaagcgcggttgcactctagagtaggagagaatcgcactcaggggccccatgagctggttggagtggtggaaggaagactaggaaggtctgctggctaatgggatggaggcgggggtaggaccttcactgacagactgaggagctggaatttacctagaggcacctgggagccattgagaattttttagcaaagatgtagcacagctacaatcagctgtgtttatttcccagcagaaggaaaatgatttgggggagtctgcgccacacccctaaagattgttcatccttgaagaataatcaagtgattaatgggggttagggaagatgctgtagaaataaattctgaggggggcaaaaagagacctggagcaggggagggaggttggaagagttagacggagaggaagtggcctccaagctgcaaaaaaggctggcagttgcaaacagcccagggtgcatgtgctgagcgctctgtagctactgcccctgtgcactctagaagagctcgctggtgaggtggggcgacaagttgagcctccttgaggctcccacacatggctgtgctacatagacattctgccaggagaagcagcacaaaagacaaaagagattggcttcaggtcagattcatcatgaaagacttcccagggctagtccaggaatccagggcttcagctgatgcacaggaggcgaggcagaggaccagtatgattagggacacaccggctgtatctgaagtgcctggctcccagcccccatcccatcccagatggtgcggcccatcagcaggccatgatggcaccaccataactgggtatcaggcaggaaaccttgcagcagaccagaatgggcccaagattggtgaaggaggaataacacccccatggttctccccctgagcccacactatctgctggactcttagccgtgttccacaagcccctcctcacatcacctcccacgtcccagaagacagttccagaatctccacataggcaagacttgggatgaacaaactgattaggaggtgtcactttggaagtgaccttgactctactgtgtttgcatagcaagtacaggatttttttagattgaatggtaacttagggtggttttgatgggagatttgatggctgaatctttcccaccaccatgaaaaaccatctcttggtgctcccagtgggcacagaggcaggaaggagcagagtgtgtgtgtggacaggtgcatccatgtagcaggaactgagagtggcatgggtaggtggccatataggaacatgggctttggggatacgaatatgacaatgtggcatggaggagtggaaagaaacctggacaaagagtctggagtgggagcttttcatcctgcctctgtatcttgggcaagcctcttaactattccgagccccatccttttctcatctgaggcatctacagagtgcccaccttggtatctggcacatcagctatttggtgaatattagtcctgccccctgctccctccgtctgcgtaagcctgcccctgtcacagggttcttgtgagggacaatgagctcttgtaagtgcgtgcgtgttaaaaggtaaaaaacatgatgtcagtgtgggctgatttttatttctcatttgtaacatttccttttaaattgtttcactaattgttgtaataacagcactggctaacctttatcagacccgtattaggcacatactgtatgattattatgtgaatgtgcaatgcagctcattgctgtgtgacattcacacttcatttcagccaacacaactccatgaggtaggcataacactcccccgttatagatgaaaaagctgaaggttcaggttttttgtaaaataaagtataaagaagaaaaaaatcaagttatatgcagtaatatcatccaaattaaccattgttcatgttttggtccattttcttctggtctcctttttcctctgcgtatacttatatacatatgcatttttaaaaattagaattatattctataaaccactcatatcttgcatttttattgtaacattacatgatggtgtttttcctctaaaaattaattccaccatgctttattctgcaaagactttgaggtagcagacaaagtatacaggaaaataatcataaaatacaaataaaacttcagaaccagggaaaagaagaacagaaatacgggatgcaagtggagctacgaagttgctagagaggaactttgtcttagtttgggttcccttagaagcagagcttgagccaagaatttgagtgtaagcagtttgttgggaggagcaagggatacaggtcggtgcaagggaaagtgaatcgaggaaggaaagtaagttaatccaggatacgctattaaggcaggtgccacagtgggcaactggtacctaatcccaaatggaagcttggaagcaaagcaaagctcttgacccagatatcccatgcaagaaagctgggatgtttacacaaccacacctgtcaggaattggttaaaaagctgtctggggaggatgagaaaggagcacggggatgtaatttccaggtacttctggccttattttctttcatggacagcccaagggtagccctcacgcagagataggctctgctgttggaaatgaggccagtgtgccaggaaatgataacacgatcccaaggaatggtggggaatcccatggaaggcagagaaccagcaagcttcagatttggtttcaggcttcatggcagacagagtcatgacccatactagaattcttaatatcagaaacgaggaaacataaacctttccagtacctaattctccttttttgagacagagtcttgccctgtcacctaggcttgagtgcagtggcacaatcttggctcactgcaacccctgcctcccgggttcaagcagttctcctgcctcagcttcccaagtagctgggattacaggtgtgcaccaccaggcccagctaatttttgtattttttttttttttttagtggagatggggttttgacatgttggccaggctggtctgaaactcttgacctcaagtgatcctcctgtctcagcctcccaaagtgctgggattacaggtgtgacccactttttatttttttattttttgagggagtctcaatttgccacccaggatggagtgcagtggcatgagcttggctcactgcaacgtccgtgcctcccaggtgcaagcaattctcctgccttggcctcccaagtagctgggattacaggtgcaagccaccacacccagctaatttttgtatttttagtagagagagggctacaccatgttgatcaggctggtcttgaaatcctggtctcaagtgatccgcccacctcagcctcccaaagtgctgagattacaggtgtgagccactgcacctggccccagtacctaattctcaaaagtattttctctttgggattatatgtaggagacattgtgtaggacaacagatgatattcacaaacaatattttcctggaaaatgctattgaggatttcatgtagctgtgatctaattgagacttttgacttaaaagtcagagcttagagtgaaaaacagtttgccagtttctctacaggttaaacatagaactactttatgacccagcaattccatttctaggtatatatccaaaaaaaaatcaaaagtagggattcaaacagatatttgtacgccagtgttcatagcagcattattcacaatatccaaacaacccaagtgcccatcaacggatgaatgaattaaccaaatgtgggctacatacaatggaatatgattcagccaaaaaaaaaggaatgaaattggccaagcacggtggctcatgcctgtaatcccaacactttgggaggccaaggcaggtggatcacgaggtcaggagttcgagaccagcctggccaatatggtgaaaccctgtctctactaaaaataaacaaattagctgggtgtggtggcctgtgcctgtagtcccagctacttgggaggctgaggcaggagaattgctggaacctgggaggcagaggttgcagtgagctgagatcgcgccaatgcactccagcctgggtgacagagtgagaccatctcaagaaaaaaacgaaaaggaatgaaattttgatatatgctgtaacatagatggaccttgaaaataattatgcttagtaaaataagccagacacagaaggacaaatatcatatgattccatttatatgaggtacttagaataggcaaattcatagagataaattaaaatacaggttaccaggggctgagggacggccagaagtgggagttattgtttaatgggtactttcagtttgggatactgaaaacattttgggtatagatagtggtgatggttgtacaacattgcaattatatttaatgctattgaattgtacacttttaaatggttaaaatgataaatatgttaagtatatttgactgcagtaaagaaaacctcagggcagagtattaaaacacaattcagaaatgttgattctgaaaaaggctggagatcagacgtgaaacagggataaacttaaagtactcagaaaagtagaatgacagtatgtcttgtaaatgatcttctgtgaatatcttttctctgaaactagcttttgttaggagcttctccccgtgtttgctggtatatctgtaggtagcttctgtccccaaagggtttgaggtactctgcatttgacagagtcggggaaggcttaggttttgctgcagtaacaagctactcccaaaatctcagtagcttaatgtaataaaagtgtacttcttacccacaccaagttcactgtgggtgctggtgatgctgccgggcggttgtctctgtgttgccccagcgcttcaggcctcttctgtctcttggctcctcttcctcagcacatgcttccaggattgctctagaaggggaagaaagggctgaagagtcaagcaccaatgattaaatggccaccaccacctgcaagtagcacaggtcccctccactcccacatccttggccaaatcaagtcacagaaccaccactccctacttcaaagggtcagggaaacgttatcccatcccctttgtggcaagttgcagaagaaatgtttcttccaggctaaaaaagcacgtgttgggcccagcggggtggctcatgcctgtaatctcagcactttgggagggggaggtgggtggattgcttgaggccaggagttcgaaaccagcctggccaacatggcgaaaccccatctctacaaaaaaaatagaaaaaattagccaggtgtggtggtgcaggcctgtagtcccagctacttggcgggctgaggtaggaggatcacttgagcccaggagattgaggttgaggctgcagtgaaccatgatcatgccactgccctccagcctgggcaatagggcaagaccctgtctcaagcaaaaaaaagaaaagaaatgcagactctcaggtcaaccccagaccaacagaatcaaagtctgtgctttaataagacacccaggtgagtcctgggcacattcaagtttgagaaatctggagtctagagggccgttcatgttgtgatgtttctgactaggacaagccctcccatgctttagaacatagacaaactggtggccaggcaggtgtggtgaggaggtgagctcacctgctgtcttatgacctcctcgccaactggaagtcaagtgcgctgagggcaggttcattacacaccatccagatgcagggatgtgccgggctcaggctgagaagatgacccggctcatgaggacctgagatgctcagatggagaggctcagcctcgcctcgtatgtgactagattctcaacaacagtttttattcttttttttttttttttttttttttgagacagagtttccctttgtcactgaggctagagtgcagtggcgcgatcttggctcactgcaacctctgcctcccaggttcaagcgattctcttgcctcagcctcctgagtagctgggattacaggtgcctgccaccacacccagctaatttttgtatttttagtagagatgaggtttcaccatgttggtcaggctggtctcaaactcctgacctcgtgatctgcccacctcggcctcccaaagtgctgggattataggcatgagccactgcgcccagccctattcatttttattaaacagagataattatgcaagtgcccttttctgtcccggggtgtggcccatgattggctctgcatggctgtactctacaagacccccatgggattctggggctcagctggtaggtgtcttgttggccctggtcagtgtgtaaatccatgtggtgctgaactgaatattgctttggaaatcttttttttttttttctcagaggaacaaggctgaggaaagagcttttgaaatcaaagtatatcaagtccaaacaataaaatattgaaagtcactattttacagtataaagttataaactgacatcaaagaagatgaggcattcagaaagaataaaaaatatcccacgaatgcattaatgatatacattaatggatgttatgcatgggtcaagatttaaatcatacattgaacacttcagatgttaccaagcatttgtgcacaaaccttatgggataggcagggaagttattactaattccattttgcaagtaaggaacctgaggtgcagacagcatagatatcttgcttcagaccacacagctataaagtggcagagttagaattagaaccaagttttgttttgttcagtgtctagtgacaaaatatatattaattttggaagactgggaaagtataaaaaaaaagtagaaatcatccataattctaccaaccaacaacaaacactgtaaatagtctgggaaatcatatcatacatattgaacctaaagtgctatttttaaaatctaagctgcatcattattttatgtaccatcaagaaagaaacactgccaattaaattctgacatgttacctgttgtgggatgcatctcgatttcagagatattaaaatttgggggaaaggtgtatcttaaaatcactgaaatgtattttgtatctcattgctttctatataaccattataacatgagcagattgttgtaattaggcaaaaatgaatctccttataattaatagctctgattttctattaaagttgattgattcaaaatgttgattaaaaaatacttacagttcatcttctctgaatcaactaattcttcccccatttttctgctgggagcagggggaatgctgtgttaatcaaagtgtctgtgtgctttatagtttaaagatttcgaccctgtctaaagactgaatgtgtcatatttttcatcctttattctctgctcaatgtctataatttattatttattacttagatagagaaatgtttttcatttcaattcagtttcgtatttcagtcctttccttgtgctttcttccattgtcttcgtgcttaaatctttttccatccagattccgtaagaatgcaagcttttcttcaatatttttgcaactgctctccgtttccagttatagcagtggcttttaaagcactttaatgtgttgtttcatgcgaacaatggcaggtgcgtttggaattatagctgaggagcaatgtgtggtcgtggggaatgagaaaactggaagagtagctggtgagagcttacctccactcaggatagggtgagagggccatacctcttccagcttctaaaatttcgtggggaagctcagacagtccattctgagaatcctggatttgttcaattatttgtttcctgctgggaacatttcaatatctggaaattagagctgtgttgtaggacacagccctcactctccattgcccagcatttagtattcatatatgctcatcttagcccattgcattagaaattcttgtttatattataaaatagaatggcttccttttcttttatcgtaaattccatccagttctctctttccctctatccctttctctatgaaggagagatgggtttggtatgagtgttaacccaaataattcttgggctccttggggtcctgtccaagaagctgtcttcttttgaaagaagcatggtctgttagccacaaataatgaaaaataaatttgatttttgcttgcatcttaaaagaaccttaaagagtctccaatttataaccaaagaaacttcttccttttctcctctcccagtctctcatatctcaaaggagttctggaacctcttatccctaaactcctccccaactttctcccaaccatcagccctctgtctttctgtccctcctggtcccatctccccacatctctctgtgctccctgttatcaggattgacttcacttctgcaacatcatttagctttctctcagcatatttcctggattccccacagtaaaggacagtcctggtagttgacccagcaagcaacaatcttttccccttagaaggaaggagagaattgggaggccaaggtgggcagatcatgaggtcaggagatcaagaccattgtggccaacatggtgaaaccctgtctctactaaaaatacaaaaaattagctgggtgtggttatgcacgcctgtagtcccagctactggggaggctgaggcaggagaatcacttgaacctggaaggcggaagttgcagtgagccgagatcgcaccactgcactccagcctgggcgacagagtgagactccatctcaaaaaaaaaaaagagggaaggagagaagagtaggggaagatggtgatcattaattaaagtcattaatgactttacacctggggaacatctcagccattagaggaggacatttctgtgttcagacccagaagcacgcagtcctgccgaggacggtggggaaaatcacctcatcagaaggcacctctgtcacaacacggccctcccttcatcctccagccttttttgcctcttttggttcagctgatgtgaattgccagacattataccaggaccttcagcatacctactgcgtcttcctttggccagagagtcatccttataagcctaattaggtgctcagggtatatttttcccattctctaatcagctctcctgtgtctctcaacgaatcgcctctccttgaaagggaaacactgtaatccatgaactcaggggtcagaccgtgaatgtaaatgagtgtaacggggtgtaggacattagggagcagtagggccttgtgccctggagagagcagccccaacacaggcattcagattctcactttgaaacagcatggtgctggccagacgggtctgatgggtggagtcccccagttgaaggtttgatgatcatgagctctgggcttccttatctttgggagggaggacagggagcgcatagcatcgctcttgagtgtagcagagcttgctttttatagttcacttaaaggacgcttgttcacagagggtgaaccttgcatgcacttatttctaaaaggaactaagggcagttacactctcttaaactcttctgatttctgcgactacacatagttattgaaatctataagtatgtatggactattagctttttcacattatttcctatacactttctcaagaattccacatgtttatatgaatgcagaatggtttaactatcctcaaagagttggacttggggttatatgtgattttttttttactattgcataaaataaaagtatgaaattttggatttcaccatggttaaacacagtgcacatctttgtgtacgtttagttctaacaacaaccccataagattggtactattaatactctcatgttgcaaacaaggatcctgaggctccaagagcttctgtgccccgtctgaagccacccagctggaagcagtgtggcatctcccttcaaaccttacactctgaaccaccacttctttgccttttcttcctttagggtcctcgttgtgggaaggatcgccagttaaagtgaccacgtgtggtctcttttacagtgtggtggcccttaggtgacctaggatagtctaagaagacagaagtggtctggttagcagaatctcaggggaggctgatgatgtctgtgctactacgggtgtaaggtttgggtagcgtgctgcctaccgcccaggagtccatggaaacagagacttctgcctcccaccggcagtcctctcaaagctgcaacctctctgccatcaccatgatgaggggtacccgcccccaggactttcatctccaattcagacatatttgatcccagatgtcacttcctgactttgcctattaactcttggcatgttggcaccaaggttctctgtgtcttgggtcttctctccttttaagcagctgatgaagatcacaaggcatgggccctgaagatcagccagggctgtggttttcgaactgtgctccccagagcctgtggggttcatggtattttaagggctgcctcaagggccaagaggacccctcaagttgttgtgttttttgtttttgtttttgttttttctggagacagagtctcactctgtcacccaggctggagtgcagtggcacgatctcggctcactgcaacctctgtctcccgggttcaagcaattctcctgcctcagcctccggagtagctgggattactggcacgtgccaccacgcccagctaatttttctattattacaaaatagagatgggatttcaccatgttggccaggctggtctcaaactcctgacctcaggtgctctgcccacctcagccacccaaagtgctgggattacaggtgtgagccactgcgcccgaccaagatttttttgtttttttgatggggggacggagcccaggctggagtgcagtgacgcgatcttggctcactgcaacctccgcctgcccaggttcaagtgattcttccaccttagcctcccgagtagctgggactacaggcatgcaccaccacacctggctaatttttgtatttttgatagaaacagggtgtcaccatatcggccaggctggtctcgaactcctgacctcgtgatccacccgccttggcctcccaaggtgctgggattacaggcattgagccacgcctggcctcaagtttttatctatttgattgtttcagagcagaagaacttgatatatttatatgtctaaaatatttatcttgttcagccacttttttattggcttaaattttttggtatgtagaaaagatttttatagagccaaatacactcactttgaccagcagcatgttttctatagcttttcataaattcaggtcccctccatggttgagataaagattcttatccattctctgttaagctctttaactcatctcaaatgttattttgaatgattgcttttaaaaaggttttgtgagattgactagatagtgatgctttgacttatttctaaaattatcacatagtgatttgagaatatgcattttgcagatttctcctttttatttgttgtttctgtatatcctggtgtctgtatttatttcagttggtttttctcttatgttactgaattttggacctggaggaaacattatccacaaccaccctccaaacagaagacacacccaaaatggcatttcattgtatgtttatgggaatataaattcagtgctattgcttttatcacttgcataatttttattactatttcattataatcgtattgcctttatttacctctgaatgctttctatgctaatacctatttttaaactgagataagattaaatttctgcatcatattagcagatacttgctgacttttagaccatctctttagttgtaatctttagtaattttttttaaattaaccacttaacacatttttgtatttttattttattattttatctttgtagggaaatttgatggacttaatatttggtttcattggtattatcctccttcatcctatttttcttattttttaagtctgttttcaattctatatttttattatgatggcttagatgttctttttgtcatttaaatgtgatcagaatgaaatcatatctaaactatctgaggataaaaaccatttctaccactattttttatgtttataaataaaattgagacctcggtttattggtgatacagaatctttcagcttggggttcaacccatttcctccagcctccatgcctcccaggtccttgttgtatctttttctctggaaatgcttctttaaatgacatttttacatcttggaatctaccttgtatcatcacatcttttaactgagagcccatgacctctttaacctctccagtggtttatggacttttctttttttgaaacagagtctggctctgttgcccaggctggagtgcagtggcacaatttcggctcactgcaatctccacctcccagtttccagtgattctcctgcctcagcctcctgagtagctgggattacaggcgtgcaccaccatgctcggctaatttttgtatttttttagtagagacaaggtttccccatgttgcccaggctggtcttgaactcctgacctcaggtgatctgcccacctcgacctcccaaagtgctgggattacaggcatgagccactacaccaggtctagacttatcttttttgatcttcccatctttctctctagtttcattcttctcatgcctctggacccttaggctttggttcatcattcatttaaaccccattggatctcctcaagctttgcttgtgccttcagacagaaagtaaaggcaaaataatgaacctttgagagaatgacttttcctttgtgatctgaaaatgatgccccatttaatacttagtggagttggaggaaagaggaaataacaccacatttgttacctatttcttctgtgttttctgtctggtgcttttcttactcctaactctttagccacttttattggtacttaggtctcaaggtactagtgttcctttttgttgcctgtagtactgcttcttcaaaatgacaagcatattgactgcaggttgcattgggctgcatgtagtaggaaactccaataccaatggtttaaacacatagaaatttatttttctcatatagcaagaagttcagaggtctgtggtccagggctgatataatagtcccacaagaccaccagagtcccagaaccttctgtctttctgttctgccaggcttagatggtgtctctgtctctcttttgctcataaaacagaaattgtaagcactatcaagacaggaagagggaaggaaagaggtaaaaggtgtgtgccagctgaaaagaactttctgggacaattccaataactcattggcgtgaaccatgtcagattgtcccccaacccccatctgtacgtgagctcaatgctatctcattggcgcaaaccatgtcagattgtccctcaacccccatctgcacgtgagctcaatgctatctcaaatgcagctagagtttctttattgagacagaagggaagtcaatattgtgtagcaatgatagtgtgtagacaactaacagtgtacctcctggaaaaataaaatattgtctgagcgtctctctctctggaattgttttggaaggtactctgtgagcagttaatgtcttgctcaattgtttttctattctggagattaaaaaaaaattttttttttatttcttagagacagagtctggctctgttgccatgctggagtgcagtggcgtgatctccgctcactggaagctctgcttcccgagttcactccattctcctgcctcagcctcccgagtagctgggactacaggcatccgccaccacacctggctaattttttgtatttttagtagagacggggtttcaccgtgttagccaggatggtctcgatctcctgacctcgtgatccgcccgccttggcctcccaaagtgctgggattacaggcatgagccaccacacctggcttttttttttttttttttttttagacgaagtttctctctcattgcccaggctggagttcaatggtgtgatctcagctcactgcagcctccgcctcccgggttcaagcaattcccctgcctcagcctattgagtagctgggattacaggcacccaccaccacgccgggctaattttttgtacttttagtgtagacagggtttcgccatgttggccaggctggtctcgaactcctggcctcaggtgatccgcccgcctcggcctcccaaagtgctgggattacaggtgtgagccaccatgcccggccaatcctgggaatttttcttcaaatatttccttaatgtttgttcagagaatccctgcatttttatcttgtcatacttattattctcaagttgggtattcgtgttttaaaaagtctactaggtacttttgctttgttttcatctatttgcttactttgatattgtggatttgattctctaccagctcactaattcttttctccattgtctgatggctgtctgctgacagtgctttcagcagatactatttcagcagcctactgtgtgtcaggcactggcctggcattcctctttgctattctcctgctgccatcctttttattatcatgtgatagttattgatagtatcttattgtgatctctctcttctctcttaacatggattttcttcattaaatcttgctcgcttgtggggttgcttccctttcaatttctctgcctgtttactataagccactcccattcccaacagaatcacgaaacctttctttagggctcaaaatctaaaaactgaacttaggctacatttatcattttcctcagtaaagcctgtcttattccttctagctgctgatccttttggctccagatgttacatatctgatatttggaatagagacacgctatactatttctcaacctaccatattttgagaggacttagtttctttaacagactgtgacccagtaacagcagctgtataaagaaatgtataaaagggccaggcacagtggctcaagcttgtaatcccagcactttgggaggccgaggtgggcagatcacctaagtcaggagtttgagaccatcctggccaacatggcgaaacccggtctccactaaaaatacaaaaattagctgggcatggtggcgcacacctgtaatcccaaatactcaggaggctaaaagaggagaatagcttgaacccaggaggtggaggtttcagtgaaccaaggtcatgccattgtactccagcctgagtgacagagcaagacacagtctcaaaaaaaaaaaaagaaagaaaaaaaagaaagagaggaaggaaggaaggagggagggaaggaaggaaggaagaaaggagaaaggaaagaaagaaaaagaaagaataaaaggcatgcttggaatacacagtgatgtagttgtgcagaaagaaggaaggaagagagagagagagggagaaaagagaaagaaagagagggagggaaggcaggcaggcaggcaggcatgctttgaatacacagggatgtagttgtgctgagaactcagcaaagggtgagttgatttcatgggctaatgggtgaagaccgagctcccggagctgataaaatagcaatcatcactccttcaattaagtaagaacatttttcctggaggacatggggcctaggggctgtttgggaagagatcatgacctgctcattctttcaacaatcctatgagttagagaaagtcaggctcaaaaagagtgagtaactttcccaagtccacacagctgttaaggaagcatattgcttaggaattttgtttgccttcagtgttacaaagccctgaaaagtagcgaaagcacacagggttttactctatcccgtagaagaggtctgccctgcaggtacggcatgtaggcagttcagagttgctgtggggactgcacaaagtcaaccaggagttgggcctcttcagctcggtggtgtaaccctagtgctcaggttcaacatggctgctggtgtgctggccatcacgtcgacgtgctaggtagtaggatggaggaaagggagagcgagggggtgtcccttcccttttgaggcactgtctttgggcagtttctctaagaaacagactctgggctaaggatttgggaggaaatgatttatcaaggaagtgctcccagaaaaaactagtaggagtgtgagggaattgaggatgagaaaagggaattgaggatgagaaaagggaaaagtcaaatgaggttattttatggagcataaattacaccttagaatttggcccaccttgaggcaaaggaactgggtttttatactcccacaccagccaatcattggctgtggctggtggggtagaggggcctacaccacccaggtctcacctgtgtgcagtcacaggtgtgagccattagcagcagagcctgcaactgctgggagatggactcacaaggctcaaggggtttagaggaatctggatggggcacaaatagtgtctcctataaggggcttcccagaaattccagttacttccccttatatttcattgaccagaactttgtcacacggctgcaagaatggctaagaaatgaagtctttattccagctagtaatgtgtcagaaagcagtacccaggaactcagaaagaaaaagatcctggctcctggagcccctgagaagagctctgcaggccctgcctgggtcatgttttcatgacagacacttaatgagtgaggtcaaggtcacacgtccacctctggtgtgagcagggagtgggtgtgttgggaggcacacaactgaaagtggagaaggaaacaggtcccaaagcagaagactctttgcagatgagggagagaaggagggagggttgtccctggacacacactagtgagagtcacttggtggacaatgctattgttgtctgaggacgggataccaaagtgaggacggctggagggatccctagttgagttttgaaggtattgaatttagggagccgttgggaccttggaatggagacattcaataaacaattgaaggccaggtgtggtggctcacacctgtaaccccagcactttgagaggctgaggcgggcgcatcacctgaggtcaggagttcgagaccagcctggccaacatggtgaaactccatttctactaaaaatacaaaaaaattagccgggcctggtggcgggtgcctgtaatcccagctacttgggaggctgaggcaggagaattgcttgaacccaggaggcagaggttgcagtgagccgagatcactctattgtactccagcctgggtgacagggtgagactccatctcaaataaataaataaatacatttaaaaaattggaaaaaaagaagtatgacgctcaggaaagaggttaggactagaggttccagatgtcaaaaaaaaatgttttattgttactatcttaggaggatgggatcaggaataacaggttttcagacttgcttttatatttgcagccatcatccttttaacaacagcaacagtaataaaactcagtattgttttttctctttcttctttgtatccccagccccagggttccccgttaggatactcctcaccctagactgtctgggatcacctgttttggattccccagggctaagagaaagccctaaatagctaaccggcccatgtccattcccttaaaaaaaatctgtgaccctggagcaaggtttctccacctcaacacaactggcattttggaccagagtctcctctgttgtggggcagtcctgtgcatcctagggtgcttggcaccacccctgacagtgtgcccctagttgtgacaaccaaaactctccaaatgccccctgggagagaatgactgccctaaagggaaccaaaggatgagaatctgccagaagaaagagtctctttggttctcttctttccgcaagcctttcaggcactgcgaagggctcagtgctgagcactgggaccaaagaggaataagtccaggtttcagaaattgaaaatatgtggtgatttccattagttgggaagttctaggccaaaggcaaaatttggaaacacaagattgtgagtgcgtggtcctctctccccaaactttaacttcaattattaactgcaaggtgggttttctttttaaaaatactttttccattaaaaaattcttaatatgtatgcatttggatgcattttcaaatcatttcaaagtatttaaagtaaaaaaccagtttccctttgctcccccatcctactctccggaaataaccaactccaagagttggatgtggatctttccagaattgttttctcatccacaaacatgtaagcccaagcacacacacatgaggtccttcacacatatatgtggttctttatgtagtttttgcaaattcattttttacacctactgatggttcttctttaacagctttatcaatgtataattcacataccataaaattcatctatttaaggtatacaattctgtggtttttagcatatttacagagttttgcaaccatcatcaccatcaattttaggacattgcaagttctgaaaaaagaaacctcataccctttagcgtttgccccctgttatggtttgaatatggtttgtccccacgataactcatgttgaggcttggtcccagtgtggcagtgttgggaggtggcgccttgaaggaatgatgaggacattaagatccattaatgtctttctctccagactgggttggttctctcaggaatggattagttccagtgagagtggattgttataaagggaggttgcctctcatattttgcctgttttcctttccatttctccaccatattttgatgcagtgtgaagctcttgccagaagccactagattcagttgctcaatcttgaacttcccagcctgcaaaaccatgagctaaataaacctgttttctttttcaaaacagagtctcactttgttgcccgagctggagtgcagtggcatgatctcagctcactgcaacctctgcttcctgcgcttaagtgattctcctgcctcagcctccccagtagctgggactataggcgtatgccaccacacccagctaattttttttttttttttagtagagacagggttttgtcatgttggccaggctggtcttgaactcctgacctcagatgatctgcctatgtcggcctcccaaagtgctaggattacaggcatgagccaccgtgcctggcctcctcttttctttattaattatctggtctcaggtattgtgttacctgagcaacacataatgaactaagacactatcccctccagccttaggcaaccaataatctactttctatttctatagatctgcctattctggacatttcatataaatggaatcatacaacatgtgggcttttgtgactgacttctttcacttagcatgttttcaagtgagccaagttgtagcatgtattagtacttctctcctttttgttgccagataatattctgctacatgaatgtaccacattttatttatcagttaatcagttgatggacatttacattgtttccactttttagctactatgaataataccatacaatgtcgaataagtttataaaaatgtatgtccacagaacacaagttttctgtgtggacatatgttttcatttctcttgagcatgtaggtttggaattgctaggtcatgtagtaaccctattctttatctttggacaaacttccaaaatggctataacattgtatattcccaccgacagtgtacaagggttccaatttctccacaccctttccaacactttactatctctctttggatgtgaaatagtataatattgtggttttgatttgcatttctttaatgacaaatgatactgagcatttttgtgtgtttattggccatttgtatactatcttaaaagaaagatctgttcagattctttgcccatcttttaattgggttatttgtccttttattactgagttatgaaagtgctttatatattctaggttcaagtccattaactgatatatgatttgcaaatatttcccccttctgtgggtgtcttttcactatcttcttgatgttctttgaagcaccaaagctttaaattttgataaagtccaatttattggatagagttctatttctccttttgttgcttatgcttttagtgtcatattgtaagaaaccattacctaatctaaggtcatgaagatttatacttatgttttcttctaagagttttatagtttcactcttacattcaggttgttgatccattttgagttaatttttgtgcatggtatgaaacatgggtctgctgtggtttcagtgtttgtttcctccacaactcacatggaaatttaattgccattataacaatataaagaggtgggacctttaagaggtgattaggtgatgagggctctgcccacttggatgggattaattgtgttataaaagggcatgtttggcctccttctctctctccttgcctttccacgatgtgatgtattccctcctgtgatgacagcaagaagaccctttcaaactgtcagtgtcttgatcttggactttgaagcctcaaaattctaagaagtaaatttctgttctttgtaaattggccagtctgcggtattttgttataacaccacagaatggactaagacaggatccaacttaattcttttgcatgtggatatccagttgttccagcatcatttgttgaaaagactagtcttagccccatttaattgttttagcacacttgacaaaaatcactagtcttagccccatttaattgttttagcacacttgacaaaaatcaattaaccataaacatgaaattgatatctggactctcaattctattccattgacctatctgtctgtccttattctagtgtcttgattactgtggctttgtagtaaattttgaaatcaggaagtgtgagtcctccaatgttgttggttttttttcccccaagattgttttggctattctgggtcccttgaacttcatgtgaattttaacatcagtttatcaattactgcaaagaagacttacattgaattaatttggggaattttgccatcttaacaatattaagtgttccaatctatgaacatgggatgtctttccatttattttgatcctttaatttatttaaacaatgttttatagttttttggagcataagttttggactttaaaaaaatttcttaagtcattcattattttaatcctattgcaaatgaaatggttttcttgattttattttgaattgtttattgcaaatgtgtagaaatggaattagtttttgcatgttggtcttgtatcctgtggccttgctacgctaatgtattaactctaaaaattttcagtcagttccttaggattttctatatacatgaatatgtcacctgtgtgtccagatagttttagttctttctttcccatctggatttcttttatttcctttatttcatgcttgactagaactcccactgcaatgtcgaatagagatgataagagtgggcctctttatcttattcctgatcttgaaggaaagtttcagtctttcactattgagtatgaaattggttttgtagatggcctttaccaggttgagaaagatcccttctatttctagtgtgttgaatgtttttatcacaaagagctgttagatttttgccaaattctttttccacatctattgagatgatcatgtggttttattttttatgctatttatataatgttttgcattgatttttgttttttattattattcatttatttatttattttgagatggagtttcactctgtcccccaggctgaagtgcagtggcgtgatcttggctcactgcaacctctgcctcccaggttcaagcgattcttgtgcctcagcttctggagtagctgagattacaggcgtgtgccacgacgcccagctaattttttgtatttttagtagagatggggtttcaccatgttggccaggctggtcttgaactcctgacctcaagcaatccacccactttggcctccccaaagtgctaggattacaggtgtgagccactgtgcccagcctaattttcggatattaaatcaatcttgagataagtcctacttgattatggtgtataatttttttaatatgttgctgcatttggtttgctagtattttgtttaggatttttgcatcagtattcaaaagaaataggccgggcatagtgcttattcctgtaatactagcactttgggaggccgaggcgagtggatcacctgaggtcaggagtttgaggccaatctggccaacatggcgaaaccctgtctctactaaaaatacaaaaattagccgggcatggtggcacatgcctatactcccagctactcaggagtctgaagcaggagaatcatttgaacccgggaggcggaggttgcagtgagctgagatccatgccattgcactccagcctgggtgacagagtgagactctgtctcaaaaaaatatatatatatatattttatttatgtatataaatttatatattatatatacttatatataatatatatatacttatataattatatattatatattatataaattatatatattatatattatatacgtatattatatattatattatatattatatattatatagatattatataaatatataatatataaatttatatctatctatctacctttttcctcttcttgtgccctttttccttttcttatgccctttgtcttgttttggtatcaggataatactatagatctatagaattagttggggcatgttcattcgtagttcttgtatctttgtgaggttgcccaggatacttaactatgatatggatattcattaatttaaccattcttcctattgtaagacataggttattgctaattatttgctagcacaactgctttatacaccatattttcactgtagtatttaaattttaaatattttataggtactgccaagttttggagaatttttaaatttaaatattgtcagctaatttgcaataatcttattctcactgctaacatatactatatttttcctctcctgtggtactatacaaagagctctacatagataaactttcatcctatggggtaggactattattttcccccattctataggtgagaaaactgaagcacagaggttacatagcttgcccaaagccacacagctagtaggtggtaaaactttgtttcaaactttgttcagccatgatttaaactgggagaagtggtgggtagcctccaagatagtcaaaattctagtgaaaactgaaataaaacctatggccccggttcagtatttctttttgtcatcagtggatgtttttgtgttttatttgatgttactgatgaatatattttgcaggctattgctttgaagaaacagggctgccaggttgtatactaaggaagacgtctgggggtcccatgcttggtttgaatggtgtctttcttccctgcttatttccttagaaccacacccagcactcatcccatatcaaatgtaaacctcagtttggttcagtcagaatttattgagttcttactattggcccaacctgactgcaggagttcttaagccgggcccatgaatagaattcagagcatctataaatgtagatggtaaaataattccatctttatatttactggcatccaactaacccctgagggactaaccttgagcatatcttccaatgatgaatgatgaatgtcggtaacaaccctgacataggatgagcagggcctgtagctttggcaccagtgaaatcacagatccattccctccacctgatagtcagggcagatcccttatccttcaccctcaccactaccttaaaatcatggtggttattagccttaattttattatttcattttatatatatatacatatatatatacatatatatatatatatatattttttttttttttttattgagatggggcctcactatgttgcccaggctggtctcaaactcctgggctgaagcaatctgcctgcctcagcctttcaaagtgctgggattacaggcaagagccacttgcccaggccattatttcgtggtttaataacaaagcacatttaatgtgtcgcacatttatttcattgtttagtaactgtgttttaatacagctgcttttgtaattttatacattttatttcattcattaaaaataaattattctaagaagggaccaatacacttccccagactgccaaaggctccgggtagcagaaaacaggaattgagaaccagaccaaggttaggctagttttgaatgaagagaaaaagggaacctgccactgcctccatccccgcttctcatgatagagcattcatccacttgtagttgtttgaaaacggacttgcaacactctcgttgctcaatcactgcgcagcataatctcagctctttgtgatgattcagaagccatttcaggatgttgccaggtgctgagggtcatcattggcagcataatttaccacagtcccttagagcagtgggggaagaagcaagcatttggaaatgtcctatttatagagtaccctttgtacagtgtaggggactttgttcagagttcccgccctgctcccttgtctctgccttctcagctagtgatgatgtccttctggtgcttagcccaccacctaccctgtggtttcagcatgccatgtatacttggctgtaaatgctgattttggaatatataatattgcttcttggtgattcaatgctacttcttgcttaagtttatttatttatttatttttattttttaatttttgagacagagtctcgctctatcacccaggctggagtgcagtggtgtgatctcagctcactgcaacctccacctcctgggtttaagcggttcttacacctcagcctcccgggtaactgggattacaggtgtgtgccaccatgcctggctaatttttgtatttgtagtagagacagggtttcaccatgttgcccaggctggcttcttgcttaagtttaaattagaaattgccactggccttggaccaaaggcaacatgctttattaggtccacagatgttgatgagttggtaaatgtttaacaacaagcttaaaaagaaagaaagaaagaaagaaagaaagctctgattcatagcatttgcctatttctgtggtgtaaatattcccacaatggctggtttcaagccataaaagtgaagttcccgaaggcagaaggcagaatagagaagagatgtgcacagtcagctctcaggcgcctttcccagccagctccacctcactgctgtggacctcagagtgcttgagaaaacctgaattcactgtcaactttttaacatcagatttcccagtcgaaatatagatttctgatttctcttgggaaaatggaaaatctggcaatgtcaggcccacattcctctgtgccagccattcactgaagatgagctacagatgatccctttggggagtgatatggtttggctcttaccccacccaaatctcatcttgaattgtaactcccacaattcccatgtgtcatgggaggaacctgatgggaggttattgaattatggggttgagtctttcctgtgctattctcatgatagagaatgagtctcatgagatctgatggtttcagaaacaggagtttccctgcatgagctctctttgcttgccaccatccatgtaagacttgacttctcctccttgtcttctgccatgattgtaaggccccccagccatgtggaacgtaagtccattaaacctttttttcttcccagtctcggatatgtctttatcagcagcatgaaaacagactaatagagtaaattgataccagtagagtggggcattgctgaaaagatacttgaaaatgtggaaacaaccttggaactgggtaacaggcagagactggaacagtttggagggctcagaaaaagacaggaaaatgtgggaaagtttggaacttcctagagacttgttgaatagcttggacaaaaatgctgatagtgatatgaacgataaggttcaggctgaggtggtctcagacaaagatgaagaacttgttgggaactggagcaaagatgactctggttatgttcagcaaagagactcaaggcattttgcccctgccctagagatttgtgaaactttgaacttgagagagatgatgtagggtgtttggcaaaagaaatctctaagcagcaaggcattcaagaggtgctattgaaggtgctgttaaaggcattcagttttataagggaaatagagcataaagtttggaaaatttgcagcctgacaatatgatagaaaagaaaatcccatcttccgaggagaaattcaagctggctgcagaaatttgcataagtaacgaggagccaaatgttaatcccgaagacaatggggaaaatatctccagggcatgtcagaggttttcacagtagcccctcccatcacaggcccggaggcctaggaaaataatggctttgtgggccaggcccagggtccccgtgctgtgtgcagtctagggatttggtgtcctgtgtcccagacaatccagccatgactaaaaggggccaaggtacagctcaggctgtggcttcagagggtgcaagccccaagccttggtagcttccgtgtggtgttgagcctgcaggtgcacagaagtcaagaattgaggtttgggaacttctgcctagatttccgaggatggtggaaatgcctggatgtccaggtggaagtttgcttgaaggggcggggctctcatggagaacctctgctagggcagtgtggaagtgtggggttgtagccccaacaaagagtccctactgggggcccctactggggcaccacatagcagagctgtaagaagaaagccactatcctccagaccccagaatggtcaatccaccgaccgcttgcaccatgtgcctggaaaagccagacaataccagccatgaaagcagccgggagggaggctgtgtcctgcaaagccacaggggcagagctgcccaagaccatgggaacccacctcttgcatcagcatgacctggatgtgagacatggagtcaaaggagataattttggagctctaagattggactgccctgctggatttcagacttgcatggggcctgtagcccctttattttggccagtttctcccatttggagtgggtatacccaatgcctgaacccccattgtatttaggaagtaactaacttgcttttgattttacaggcttataggcagaagggccttgccttgtctccaatgagatgttggactgtagacttttgagttaatgctgaaatgagttaagattctgggggactgttggcaaggcatgattggttttgaaatgtgaggacatgatatttgagaggggccagggcagaatgatatggtttggctgtgtccccacccaaatctcatctcgaattgtaactctcacaattcccacgtgtcatgagaggaacccagtgggaggtaattgaatcatggaggtgggttttcccatgctattctcgtgatagtgaatgtgtctcatgagatctggtggttttaaaaacaggagtttcccttcacaagctctctttgcctgccgccatccatgtaaggcatgacttgctcctccttgccctctgccatgactgtgaggccttcccagccatgtggaactataagtccattaaacctcttttttgccagtctcgggtacctttatcagcagcatgaaaacagaataatacagggagctcagtgcttcttctggtcccacctgcctaggctgagtgtcacctgccattcatctctatgtttgacctctttcctgtcccttggctcaagtgccgaggttcctcttgtctctgagatatgtgaaccaagtgatcttatcacctagatttttaatcagaatctcaagaaagagttagagggccccacatgatattatttttttaaattgcatccagtttgatcatggagcagtcaaggttttcctgatggggtgcatggagattttattccattcttgttgatttccctctgggtgtcccaatcagtaggcgcaagagcttttccacttaggatatttaattaatgagaatcgaaccggtaaagaatgaactctatggctggctaaaggttttcctatgggaaattaagacccactaactggaaatggtgaaaagtgacaagttcagaggaaactcagtacagtcattaaaaatgtatcaagtcctatacagtagccagttgacacagcacagtcaaagaaaaatagcatctctaaggtcttgttggataccatccatgttgattttggataatgcccaaaagcctgtttctgggggaaaggctgctcttaaacctggaatgcagaacactgggcatgccaaatgcctcattatttatgagttccatgcagacagtgatgcatgaagggtaaaagacatgccaataccctcttctcggtggggtagagtgctcctgaagatgatttaggaagtgaggtttgaaacagagtctatggagagagtcctggagttaccagtgctggcaggggagaaggagaagaccatcagaaaagcagtggtagctatgttaagaattgcattattatgtacttacctaaacgttggcaagaatgctgttatttaagaataaaatcaatttcattttgggaaagagaactccttttttttttttttttgagacagagtctcactctgtcccccaggctggagtgcagcgatctcagctcactgcaggctctgcctcccaggttcacgccattctcctgcctcagcctcccgagtagctgggactacaggtgcccgccaccacacctggctaattttttttattttttagtagagatggggtttcaccatgttagccaggatggtctcgatctcctgacctcgtgatctgcccgccttggcctcccaaattgctgggattataggcgtgagccaccgcacccagccgggagctccattcttaaagacactttttgcaaacatttaccttgcaaaacatttgtagtgactcctctgtgaacaactccatgttgattgggaggtagagagaaacccactgctaaactacatccatctgtgcaggtttttctttctaataattgatattccatgaaaagaggagaggctttgtcatggggaaaatgtaggttatgaaacacagatgcagtaagggcacacttaaaaagaaagaacaacactgaggtttgcaggcaagacataaggaaacatggaggacagaggtcaaagggagcattttggaggagcaggaaagccctctagtgattaagaggatggatgggatcaaaagatacagaagaccagcttttcagaattgagtgttttcatttctctgcctttaaagaaacatcacaaggccaggcttggtggctcatgcctataatcccaacactttgggaggccaaggagggaggagtttgagaccagcctgggcaacatagcaagatcccatctctgcaaaaactaaaaaattagctgggcctgatggtgcatgcctgtaatccctctactcaggaggctgaagtgggaggtttgcttgagcccaggaggtcgaggctgcagtgagccatgaccatgccactgcactctagcctggatgacagagtgagaccctgtctccaaaaaaaaaaaaaaaaaaaaagcatcacgatactcagaaacaggcgagggagactaaacacccaccatttcttagacccttaatttgcgctgggtgctaagcttcctctgggtatggggtggacactccaaataggggccccaattccagtaattaaatgtgttgagccaggcactgcactaagtgctagtgtaagtgcatcatctcattggatcctcacaacaacactccatgcaagatgaggaaactgagacaggaaatttgctcctcactgcacagccagcagaaagagaggcagatccgcttggctccagggaccacgcttcttctagatgtctgtgtcaccctcaaagcctcagattgtattgtgaactaattaactagttgagcagaacgttccccaaacacatggtgtagaattgctattgttctcccagcattgatgaagaaaattaactcgcagtaatatcagttggagatggagtcagtcccatttccacttgattttattcttccttgatagttttctgaataacagcctgttactattgccctgatttctctttgccacctctacattttaagcaaatctagggcaagtcaggaagcaggatggatgcttttgatgctgtattccgaggcacccctggtcctccccagcgtgcccagcctaaattagatgaagtggaaatgttgcaaaagggctgaaggggcccccatggagagcagatggtggttggggttatttgaggtttcctgtggagattctctgtctcccattcacttgcagagaacattatgggctgtctcagttccatagggtggcatccctcccagccatcctcccagagcattctaaagtttccttgttcatgggtggagatttatgtcaaatcctcattcctggaactctggaatacagtctgaagtcttgatatttggattgccttgaatgtgcttattctgtaactgaataagtgcctagcatttggtaatactgatttattatataattgacttgccatattgggatttgttttaatgggatttgcagggggtgccattttccacctctggcctctttctctcatgacagcagatctcttctgcttgagctttcactccatggagaagggtgagacagacatctctgaggtcgtgctgtctgcatggaaccaggagctccttgtctgtctctatctcattcccctgtgtgtgcctgcaccttgcacaaggctggcatgccataggcctcagtaaatatttcctgagtagatgaatcaatggaaactacatcccatctgctttgactataatgtccttgcattgtctccactgaatgagaaccaggtattcacatgacctcccaaagtaattgtttcttctgacagccccaagtactatgagccagccataacacttgtctagtgtttgctcaattgaattttcaccagtgaggcaaatacgaagggcttggttttcataatgaaacagattctatttcttgtaatctatgagtcaacttcagagtatggagtacttgcttaacttgtttcctcttcctgtggctaaaccagatcaagtcctagctcacatcaactcaagtcctagctccagtcaactggaaggagacaagactcagtccacatgtcaggggcagcacagcaccactgggtttatttggcacctggaggatgatggtcttcattatcagggacttttcttttttttcttttttttttttttttttttttgagatggagcctcactgtcgcccaggctggagtgcagtggcgcgatctcggctcactgcaagctccgcctcccgggttcacgccattctccttcctcagcctcccgagtagctgggaccacaggcgcccaccaccacgcctggctaattgtttgtattattagtagagacggggtttcaccgtgtcagccaggatggtctcgatctcctgacctcgtgatcctcccggctcggcctcccaaaatgctgggattacaggcgtgagccaccatgcccagcctatcagggacttttctaagaattaaagttttgtctagaattgtgtgtttgtcccaaattgtttttatcttaaccattttggtgaaagcatttaaaataaatggattacgtgttatcccacctcttcaaaaaatgtgtgccaaatataatttaagcccttttggatgtttgaagttcatctttatgggcagagaatcacagcgtctctgtcaaaaaaggcaacaccatcaaggaaccactgcggctagctttatttgtccctacattaatctgtgatatctagagtcctttcttttctcagatgtccttttgtgctgagatcaagtggctctttctaacaggggtgcatggtacaatctcctaggaaactaaaaaaaatgtataactgccgtgaagacttgactgggcttttgattcagtagctctgagacagagccttggtagcgccatttgaaacaaacaccaaaacttcctaaagcgattctgatttttgctcttccttgagagtcagtgttatagtcaacatatcttctgctgcttctaatcagctatcttatttttttttcagatgtgtttgggtgaagaccccagaagggcctcttttttctttttccctactaagttagagcagttattctcaaacttgttcagatggtctaagagtggaaaaacttaagctgtttttttttctattctctcagtcaacaacgatcaacacagaaggcttctgtgaccagaagtgtgagggtattatcctatatatcaagcaagccagcatcctctgcagcaaacaccagctggatgtcttctaattcagttcaattctgacactatctatctggagatcgagtcagatctcacaggtcgagggctcagtccctaacctgccccccaccttcaggtgtcaactgcaggctccgtgtttgatctgtgcttctgactgactggcaataaatcgggtcccacagctccctccttgggtttgcttactttgctagagtggctcacagaactcagggaaacacttaggtttactggtttactataaaggatattacaaaggatacagatgaagagatgcataggataacacctataggaagaggtgtggagcttccagaccctctccagggtgaaccaccctccaggaacatccatgtgttcagcaatctggaagctctccaaaccttgtcctttggggtttttatagagactttattatatagacatgattgattaaaccattggccattggtgatcaactcagccttcagctcctctcccctccctggaggttgcggtgtggggctttaagtcccaactctctaatcatgccttggtctttctggtgaccagccccattctgaaactacctaggggctgccagtcaacagtcaactcattaacatacaaaaagacatcacattagagattctacagattttaagagttatacatcaggaaccagggacaaagaccaaatatgtattttacaatatcacaggtggtgagatgcctgaattcttagtcctctttgcaaaatacaataaaacataataaattattctcttgtaaaaactaggaacaattttattagcagtatatatgaccgtgttttctgtatgatcttagtcaaggcccttttgcttgcaaatattaggaactcacctgaatcagctcaagacaaattgttgattgtattgtaaggatacatacaggggtagttcatggaactgcagagcaggaagcaaatttgagactcacaacagtgctaggccagaaagtggagaatcagcaagaattggcagccattttcttgggctcttgcctttgcttctctctttcttttgcttttgacttctgctttctgcttcttctcattcttggctgctgatcaccacccctcagccctgagtttttgtcccctcagttgaaacaactaacgatgactgcctactgtttcttaatcccaagttacattcctgagagaatctgattggccaaatatgggggtcaggtgtttatcccttgtccactgaggtgcatcttgggggcttggatccagcagcacaaacatggctgccacacgaagtactcagggaaggggagtgggagatgaaactcaaaccttgttttctatattttgttctacctcttaccgtaaaccctccttcctatacacccagaaatgcctctgcccaatagaaccagctatcttagttcatcctgtgttgctataacagaactgagactgggtaatttataaagaaaagaggtttctttagtttatagttttggaggctggaagttcaagggcatgaccctggcttctggcaagggcttctgtggtgcatcttaacatggtgaaggtcaaaggggaagcagacaggcatgaaccccaggggtattctggctttataacaacccactgtcaagggaactgatccattcccatggaaactaatccagtctcaccaaagcgagaactcactcaatgccacaagaatgacatcaagccattcatgagggatctgccccctgtgacccaaacacctccctctaggccccaccttccaccaccaccacattggggatcaaatttcagcatgaattttggtggggacatattcaaaccatagccaaacaatagcaccagccatctcattgactgccacaaactgtattccccatccctgatgggagaatattcaaagtcctgttgagctgcagcacgcagaggctcacgctccccagatatgaatgctcaccagctgccatttgtggactaagcaatcagattaaaccatgcacaacacgcccagtatacaatactggaagaaaaacaagacaatggcaatgaaccattcctctttagaaaaagaaatagggtataggaacccccatgtatctctcatccagttattagccattagtaatgagtatataatgaggggcagaggaaggggaaatgggactgtttaaatccagacctgctcaaactaacataagcaaacagggagaattcatcacaaggatccaggtctctctctctctctctcagtgttccagggcagaaacttccctcctggggcggggatgactctgtctatctctaggcctgcatctcatgcatctgcctcatgtgtctgtctatatgctccatgtgccacacattcacctgtgggttcctcatagactttaaaatgtgaattcagaaaacctggatgttcccaagtaccacgggggccacacatcatttccagtaacacatggaagacagtgtattttattaatgactatttcattggcatttattatttatttccatttttgtttatttaagtggcacacaaaaatagtctgatttcttggctctcattgcttagggtgaagttaagttaaagttttgaagtgctataatttatataacaatattaagcacatgaccacctaggctgaaggtcaatgtggtcacatcacagaaagtccttctggagaccatgaaaaccccatctacggctgggcatagtggctcacgcctgtaatcccagcactttgggaggccgaggtgggcggatcacctgaggtcagcagttcgagaccgggagtcctgagaccaggagttataacccgggaggtggaggttgcagtgaggcgagatcatgccactgcactccatcctgggcgacagagtgagactcggtctccaaaaaaaaaaaaagaaaacacattgcactggggatggaattgtcccccttaattgatttctctctcattaccaaggagtactaggattctactgcgaatctttagaaaataattttatatttaccgttgaaattaaggaacaaggccaggcgcggtggctcacgcctgtaatcccggcactttgggggggccgaggcaggtggatcatgagatcaggagttcaagaccagcctggccaagatggtgaaaccccatctctactaaaaatacaaaaattagccgggcgtgatggcaggtgcctgtattcccagctgcttgggaggctaaggcagagaattgcttgaacccaggaggcagagtttgcagtgagccgagagtgcgcctgcactccagcctgggtggcagagtgagactctgtctctataaaaaaatttttaaaaattaaaaaaaaaaatcacctattcagagtgaccacttacgtttttgtgcgattcttcccaaacactgtgtgtatggttgtaacatagttgagaagagatatttttaaatatgttagtccactctgctttctcagtcagtcgaggtttctcagcgcagttgaactttcacgtgaggaatgttcaggactgtgcattgcctctgacattgttaggagtaacggccggtgtagaggctgtcagacatggaactcttcacctttattcaagataccccttggtggctttgtcaatgtcccaaataaactctgctgcatcttgtttcttgttaatgacctctttttcctacaagttgagtatatgaaaaattccaagagaaatagaatgctcatggatttggctccaggagattgaggattgatttatccctagagtgagttattagaaaggtgtttctggctcaacaattggctgtatatatagcatcaagtttcccattttggacaactagggagaaaagtgctgattgtttaggcaaatgttgaggactctagatggaagtcattgcaattgcacagctaagtaaaccctgcgtaattgaagcagcaagccaacagccgtgacaacctgaccacacagcagataaacagacagacaataggtgggtgaggtgtttacagaattcttcacgaggatctgggacctctgctcaagggggagggtcccaaagccacatcctttctcataccaaaccaacataattttttcttccaggggaggtaaaaagcagggcagactgtcccaaatttgtgcttatttggttttgacatacacacaaaactcacatctccttccctgatggagactaagaacccaactaaccacgcagctctggactcttctgaagctgctgttctgtttgcacattacctaaggctcagcttgctcctgcccttcccatcgcaagccaatattaaattaatttgtatgttctgtgttaggaagtaccgaggggccagaataaagttttttggagtcgatcccactttggagttaatagcatagataatctacacttggataattagggtttggccagagtaaaaaataactcaatgaaactaaaaatatcttcatttaagaaccttgatgtaaacacgtgagtccatgtttccacccaagaaactctataataggtgccgtggctgcattttggtgacctatttatcactggccaagtctcaaacctcagcaatgctggccctaatgacatctaaactggaagctgattctgcatgaaattacgttcaacaagctactttttggctggtactggtgacctcggggatataaggcctacttctgtttgctggagagaacattgcctacctaatagaagaggaaggcctaatcagtcccaaggatgttagggaggccgcaaagtgtgaagcagtggattgaacaaaggaaagcagtaatttcatcagattagtagtggctatttttataactttgatttgtccatgtgaaacagaggaatgacttcgaaaaatagtctgaagacctgcaacttttaaaattgcatttgcatctcagcactaggttggttggtttttcttgggacggggccttgctttgtcgcgcaggctggagtgcagcggtatgatcacatcttactgcagcctccaactcttgggctcaggtgatcctcccacctcagcctctccagcagctgggaccacaggtgtgtgcccaccatgcctggccaattgttttatttatttgtagagacagagtttcactatgttgcccaggctggtcttgaactctagggctcaagcaatcctcccacctcagcctcccaaagtgctggagttacaggtgtgagccaccgtgcctggccagcacgagatatttgagtcaagcagatgcttccacgtgctttgcaactaaggaggttgcagtatatgatggaattatgtcattcgaggtacttcaatcccctgttcagtttctcagtctgtaacatgggctgataataatcacacctcagagttgttctgaggagtagaccaggtgacgtaggcagggtgtttggaaccatgtctgcttcacagtgagcacaaaatactcactgttgcccttgttgttcagtctctctctgaaatcgcttctggcaccaaatgggcaggagatttgatttctctgaaatcttgatctgaagtcccagcacgtctccactcatatcttgtcccggaccagagtgttgtcctcgtatggcaaaaccaatacttagacgagggggcaggggcatcacattcagaaattctcccatggggtgcaacgcaggagagggatacaagactacaaattgggttcagggtatgctgctctggtgatgggtgcaccaaaatctcaccagttggccgggtgtggtggtataatcccagcactttggtaggcccaggcagatggattgcctgagctcaggagtttgaaaccaccctgcgcaacatggtgaaaccccatctctactaaaatacaaaaaaattagctaggtgtggtggcgtgctcctgtaatcccagctactcgggaggctgaggcaggagaactgcttgaacccaggaggtggaggttgcaatgagctaagatcgtaccactgcactccagcctgggcaacagagtgagactccgtctccaaaaaaaaaaaaaaaaaaaaaacctcacaagtcaccgctaaagaacttcctcatgtaaccaaataccacctgttcccccgaaaacctatggaaatattttcttttttttttaaacggagttttgctctcgttgcccaggttggagtgcaatggcgcgaacttggctcactgcaacctctgcctcccaggttcaagcgattctcctgcctcagcctcccaagtagctgggattacaggcatgtgctaccacacccggctaattttatatttttagtagagatgggatttctccatgttggccaggctggtctcgagctcccgacctcaggtgatccacctaccttggcctcccaaagtgctgggattatgggcatgagccaacgtgcccagccagaaataaaaaatttttaaaaagaaatccccccattgaaatggactccttcagatctatacgggctccaggaattccctttaaggcagaatgtacagctgtgatgtagagctggtaacaacaccagccagcatacagaaagctcactggctgcagattcagttcataactctcccatcaactatagtatcttcattaattgatgtaaaattgaagcttagaagaatcaagtaagaatcttgcctgtgctgcaatgctgggtggcaaaggcaggatttgatcccagatgattggactctagcacccatcatctcaatccctaccctatgcagccaccttcaggatgttgtcttctctcctgttgccttcctggttattgggagtcaatgacacggagagtagagtctctcccatgaccccctatgaaattcctcccattattcctcatagcctttgggaagtgcttttccgcagagcttctcagtcagtatggctgtgctgtctcagatgttaacactgactttctgtctccctgtgggttgctgtcttccagttgagttgccaagctttcatctgagatattagacattagatttgggggaattttagttctgttaacattctgggatttttttcctccaacttttattttagatacaggaggtacatgtgcaggtttgttacatgggtgtattgtactcaggtaataagcattatacccagtaggtagtttttcaacccatgcctccctccatccctgctctagtagtctgcagtatctgttattcccatgtttatgtctgtggacgctcaatgtttagctcccacttataagtgagaacatgcagtatttggctttctgttcctgtgttatacacttaggattatgactgccagctccatccacattgctgcaaaggacataattttgtccttttttaaggctgcataatattccatgttgtatatgtataataccacattgtcttaatccaatccactgttgatgggcacctaggttgattctatgtctttgttattgtgactagcaaggtgaggaacataccagtgcatttatctcttttgaaaaatgatctgttttcctttgatatatacctaggaataggatttctggatcaaacggtaactctaagttctttgagaaatctccaaactgctttccacagtggccaaaattacttacattcccaccaatagtgtacaagtgttcccgtttctctgcagcctcgccagcatctgtgggattttaagggcaatctgagttattttatctaggaccttttcccatgaaaaataatgcaggtatttttggagattcaaacacacataaaactagggcatcctgtccaccccagggagacagacaggttttcttttcttgggggacggagtttcgctcttgtcagctgtaatgcaatggcgtgatcttagctcactgcaacctccacctcccgagttcaagcgattctcctgcctcagcctcccgagtagctgggattataggctcccactaccttccccggctaatttttgtatttttagtagagacggggtttcaccatgttaaccaggctggtctcaaacccgggaccttaggtgatctgcctgccttggcctcccaaagtgctgggattacaggcgtgagtcactgcaccaggcccagacagttttttgttgttgttgtttctctctctctcctggaccagagagatctctaagtgtatctcctacctctaaagactttgccctttcagcttccattctcagcagctcagtgagacatgggccatacccagatgtataagatcagtctctaggcttcctgaagaccctgtctttcctcttcacattcctgttgggcaggagtcaacttctcttgtctctttttctctcctgatcttacccttttctgaaaactcactcatctcgctcctctactcaattttcctttgacatgaatttttctcttctcagccgagcctcctaatcttgttcttcctcaaggacaccttggaataaaagcctggcatgtccctgagtgcctcctcctcctgtgaatgccttttggcccctccctgcattcttgttgggtgtcaggaactgcgtggtttctgggccttctctccagaccccttttcccctcctaaaacagtaacatctttgaaatctatgatcatataggccattctttgatgagtttctggaaacctcactgagaacacattgtctggagaccattttctctcttggcacagcagcacccagaaggcaataagacaccttgtccctgtcacacatacattcctatctttggggactcttgggatttgcttgataatagtatcttttttatgtctttgaaggctttgtgtgatcacttgatgaatcctgccagaattgtctcacaaaggtgatgtgcattctgtttctttcctgggccacatatcctcctgggatggtcagattaagcccaagggagacgccatcctacccaggttgggcaaggaaggtggaagagtctcgggggtccctttccatatgaggtgtcactgtcttgaacttggggatcagctactttcttttcttttctttttttttttttttttgagagagtctcacactgtcacccaggctggagtgcagtggcacgatcttggctcactgcaacctctacctcccaggttcaagcaatcctcctgcctcagcatcccgagtagctgggattacaggcatgcaccaccatgcctggctaattttttgtttttcagtagagatggggtttcaccatgttggccaggctggtctcaaactcctgacctccagtgatcttcacgcctcaacctcccaaagtgctaggattacaggcatgagccaccagccaggatcagctactttccaactccattttgctacgttaggtaaatgggttacataaatagggtgaggttgggtccatccatccatccaaggcattcagcagcaccgtgtctctcattcacgctggtctcctgtctcctgattgtccaagcttgtttctgctttaggcccttttcttctctcagcccttttttctctcagctttttataaaactgggtccccatcttcagccgcacctgaagacatgagatcttctctcacccccttggtgaagtagtcctcacctcatttattccctctagagtcctcgcctgaaatcacagatgttagaggaaaaaggggtcccttgactttaatatacaggataaatcaagtgacagaacaaccaacgttggagcaacccaagtttttatacagttgatggggacattctgtgtatggaaactaagtaccaccaaccctgtggccctggattgtggtcgttgagggtactagggtactcatgggttagagtcccaagctttgagtctttaactacaaaatccattgtctccccaaatcaaggaagttgtttttttttttccttttggccatttttcttgaaggcccttgaatccaactctaaacagacaaggacaggcagcaatttgtgtccaaagagagccaggcacaagggatctgtttattttatagctgtaatttctgcatacgaaagaaaaggtcctaggttaaaaataataataacagtccgacaaaggttttgtgcttcctagtaagacggcatgatgttccaaatcattgtccaggccttggcaaaagcaggggcatagaaggaggttttctgtggagacaaggagccctccagagacttgggcaggctgagccggcagtgctggtggcaggaggccaagtcctggttgggtctgaattcatggctgtctggttcttctgaaactagttatccctgtgaccttgggcattccatctccctgggtttcaaggcctttgaaaaatgaggtgattcaatcagaatagttctgctcaactcctataatacctgctaactccctttttatgtcaaaaataatttaggagctcggtgccataaggcctcacagtaaacacagaacttctgaagagatctcattttgacatactctaccatctgaaatgttttgcacatcacatactaatatgcaaaataagaaaggtcctgggcgcagtggctcacacgtgtaataccagcactttgggaggctgaggcaggtggatcacctgaggtcaggagttcgagaccagcctggccaacatggtgaaaccctgtctctactaaaaatacaaaaattagccaggcatggtggctcatgcctgtaattccagctactcaggaggctgaggcatgagaatcatttgaactcaggaagcagagcttgcagtgagctgagatctcgccactgcattccaccctgggtgacagagtgagactatgtcttcaaaaaaaaaaatttatgatactatcatgaaattttataaatatttattatcctgaaatgaaattttatagataaaataaactatacatatattttagaaagacattatactgccctaattataaaagaataaacaacagaaaacatttatagtaaaataatataggctgggtgcagtggctcatacctgtaatcccagcactttgggaggccaaggtgcatggattgtttgaggccaggagttccagaccagcctggccaacatggcgaaaccccgtctctactaaaaatacaaaaattagctgggagtagtggtgcacgcctagtccaagctactccaggaggctgaggcaggagaatcgcttgaatccgggaggcagaggttgcagtgagctgagatcgcaccactgcaccccagcctgggagacagactgagactccatctcaaaaaaaagaaagtacataaatatataaatgctagagtctgactataatgaagcgctcgggtgtttgtacctgcgggtaggctgacacaggtgctctgtaccacacaccaccgctttactgtccatgatgagattgcctgagatggtgcacatttggttactcttaaagtacatgttggccgggcatggtggctcatgcctgtaatcccagcacttcgggaggccaaggtgggcagatcacgaggtcaggagattgagaccatcctggctaacatggtgaaaccccatctctactaaaatagaaaaaattagccaggcgtggtggcgggcgcctgtagtcccagctacttgggaggctgaggcaggagaatggcgtgaacctgggaggcagaacttacggtgagccgagatggcaccactgcccttcggcctgggcgacagtgtgagactccgtctcaaaaaaatatatatatatacatgttgagccttccctcaacttatagggcagttgcctgcctggaaatttcagtaaacattacgattgtgcaaaagtaaagagtgtgtttatttgtaaaacaagaattaggtttggctcaatactcatgcaatacctacaactgaggattcttcccagggggaccgcagcctgtcagcatggctcaagagtgtgggaactacaaaatccagcctgggaaggtggttgtgttcatcaagcccaccttcccattctgcaggaggacccaagagatcctcagtcaactgcccatcaaacaagggcttctggaatttgtcgagatcacaaccaccaaccacactaacaagattcaagattatttggaacagctcacgggagcaagaatggggccttgagtctttatcagtaaagattgtataggcagatgcagtgatctagtcactatgcaatagagtggggaactgctgacgcggctaaagcagattggagttttgcagtaaccacagagcaggccacacgctgactttcctcctcaagagctggatggcattgcatgtgatgacagcacttcctggtggatgaatttggggggcacaaacagcttttttcttcttttgcctcagtatttaaaagtggatcaacttgctcttgaccacggggccaagaaggttgatgggccatcttggttttcttcttgatgtgctctttggttttcagaagattgtgacaagttctggcctaggattcgctcactcaccctcaattgttctttctctttggcacgcgtttcttactgttctccacgtgtcggcatgcctctgcctctaagccagtgtttttcaactatgtttctacagactccttctccacaatgatgaatccttggttggttttctgctactgcccattagctgaaatcatttttcctcttgactttgtggagttggtgttatgaaatcagtgggtattttgaatgtgttctttcaaacgactgcatctctccggagacacaaccccaccccatcccatcccaccttgagaatcactgctctgaaccagtgttgtccaccttgtcctctcacagatctcataggaaatgttcaacaattctgtgaaagctctcaggactcaactggagaaatcatatgaaaagttaagcatagttggtcttgctgtcatatggatcagaggcacaagtgcagaggctgtggtcgtgtagaacactctgttatttaagatggccatccagataatcctgaacactgtgtatttatttgatttagagtaccagcaaaaattaaagcacaaaatgtaaaacattgagaaaacttacagccccctaccctaagagtgtatctctgaaagagcccccaatgctttgaaaactaagaatcccttgggccaggcgcagtggctgacgcctgtaatcccagcactttgggaggccgaggcaggcagatcacgaggtcaggagatcgagaccatcctggctaacacggtgaaaccccgtctctactaaaaatacaaaaatattagccgggcatggtggcaggcgcctgtagtcccagctactcgggaggctgaggcaggagcatggcgtgaacccgggaggcggagcttgcagtgagccgaggttgcgccactgctctccagcctgggtgacagagcaagactccgtctcaaaaaaaaaaaaaagaatcccttatgaagtttgcctccttctagacttgtaagattattaatttccttcttcagtctctagtgagaatgtttaatttcttttctaataaaaaaatacctatagatgaaaaaaaagaattaggttctaggctcagataaatgcagacatgtatacataaatatccagtgagacatttggaagttgtacaggatgcaggacttccttttctttcctttttttttttttttttgaggcggagtcttgctctgacatccaggctggagtgcagtggtgtgatctcggctcactgcaagctccacctcccaggttcacgccattctcctgcctcagcctcccgagtagctgggactacgggtgcccaccaccacgcctggctaatttttttgtattttttagtagagacgaggtttcaccatgttagccaggaaggtctcgatctcctgacctcgtgatccgcccacctcagcctcccaaagtgctgggattacaggcatgagccatggtgcctggccctttatttttttttttttgagaaaggacttgctctgtcacccaggctggagtgcaatggtgcaatcacggctcactgtagcctcagcctcccgggctcaggtgatcctcccacttcaaccttccgagcagctgagatcacaggcatgcactaccacgacaagctaatttttgtattttttgtagagacaggatttcgccattttcccaggctggtctcgaaatccaagactcaagtgatccatctgcctcagcctcccaaagtgctgggattataggcgtgaaccacctcacctggccaggatgtttatttaatgtgctggacatgtaacagccctaccccctccacactaaatgccgatccttgtgacagccaaactacctgcccaactcaaatttcctgaatgccctgtaggggcagcgttgcccctgttgagaactgtctttaaggaacccagaggtgtgctactacagctttaatgtgcgtgcagattaccagcaagaccgcataaaaatgcacctgagccggtgcggtggctcatgcctgtaatcccagcactttgggaggccaagacgggtggatgacttgaggtcagaagttcgagaccagccttgccaacatggtaaaaccccgtctctactaaaaatacaaaaattagcaagacgtggtggcaggcacctgtaatcccagctactcgggaggcagaagttgcagtgagtcgacatcatgccacagcactccagcctgggcgacggagtgagtcttcgtctcaaaaaagaaaaaaaaaaaaagcatctgattcaggagctctggaatgggacccaggattttgcattccaggtgatgccactactgctagtctggagccacactttgagtagcaaggacataaggagtctcatagtgcctcctgagctaagtgtctgtggattcagggcatgtctttctaaagtggcatgtctttgagaaccacatactattgaatcttctggggtacttaccagatatgcatatccctggccaagtgcggtggctcacacctgtaatcccagcactttgggaggccgaggcgggcagatcacctgaggtcaggagtttgagaccagcctggccaacatggtgaaaccccgtctctactaaaaatacaaaaattagctggacatggtggcaggtgcctgtaatcccagctactcaggaagctgaggcaggagaattgcttgaactcgggaggcagagtttgcagtgagctgagatggcgccattgcactccagcctggacaacaagagcaggacttttgtctcaaaaaaaaaaaaaaaatccctgaatctctgagtctcactctgaaccccctgatcaggaactccctgcattagcctattaatacttaattccctgaatgttgccttaaagccactaagttgagaactccaacttcatttctagacatctccagatcttgcggatctttgcaaaacaaagctctagttctccgtccaaatctcagattctgtgcaagtcaagaaactgctctggggtgtcagatagaggatggagagttggccacccactgaggttctggaaattttctatttcttgactgggtattagttacaaagatgctcaagccacttatacatttattcacttttttccccgaatgtgttacatttcacacatacacagagaagaggacctctccttattggctctaggagatgtggttgattagctcagggaaagaatgaggggaattgttagttgttactcaagcccaattatttcccagctgtgccctttttctgtgaatttcattgattctagtctggcagtgggagaggacagtatggaagacagtgaaatgttcgcttttgttgtcctgagaccaagcagaaagatgttgacctgcacttctttggagaaggttatttggggcatctggagaagggtctgagccctttcgtctctagatgcagaatgtccctctctgtgacaacactgccccagatggcttggccacaacaataaagccactttccctctgtgcaggcagttgcttactatagagtattacagctaaaccttctcttgtgactgttttttacctaaataaataaggtgactgatttcttcaggtgaatcaacttctctagtaatattctggccccacctcttccacgcatccctcacaggtgggtcactgggccacactccaggctcttaagagagaatccactcctcccggggagtctaaggatcctaggctagtcgttcagcagaaaatcaaccttggggctggccccaccctgaccttatatcccaattctgggagctgggacgtcttctcttagatcaaggctctgccttagcaccatgtctggtccctgtgtctttgcctggaattcagccaaacatcctgctctgctcgttctccttggcccttcttacctttttctcacattcctgcaccgtcctgcgtatctctagcgatgccatttacattgtgttccgtgggtaaggcggtgctgctgacatgcagggactcccacccaccaagggaagcttttaaaaagtttttttaaatgaagcagatcatttcactcacttgactcatcatctattcttgctctgctggttcatgtgtgaacacaaacatcaaaaagaactggatgagcaatacagttgattcatgccggccagtagagcatctctagagtgtctgagaagagccattcagttcttccgtggctcaactaaaaacaatgcaaatcatcaatcttgtagtcgtcactgcaaatattattggtagaaaaaacacaaaaggaaatataatagttaaaattgcaagtgataaaaaaattgttgcaaatgagaaactacagaaagtaaacatggtaaagttgaaaagtacaacaactgaactgcaaaaaattaaatgtgatagaaaactcaaatgaagtaaaagcaacagaaggaaaaatgcacatggtaaaattgctttttttaatcaatagaaggatcacatcttggcaaatctggatatgcagaatttgactcaggaaaattgatcttggtggaaatgtgatcatccaaggaaactcagattgtcaaaaaccatgagggacagcattcatatagacaaaaagtaattgatgaaccaaatatttttggtaaaatttattgtataaaaaaagtctgttgaaaagattttttttttttttttttgagacagggtcttgctctgtcgcccagggtggagggcagtggtgtcatcacagctcattgcagcttcatcgttttgggctcaagcaatcctttcaccccaacctcctgagtagctgggaccacagatgtgtgccaccatgccctgctaattttttatattttttgtagagacagggttttgccatattgcccaggcgaggcttgtctttaactcctgagctcaagcaatcttctctccccagcctcctaaagtgctaggattacaggcatgagccattgcacctggttgaaaagttttttttttaaatggaaaaacatggtactggtttacctgcatggaaaaattgttgaaagaattaaagtagcttgtaatggaattcactgaggaaaagacggtctcaataaaatttcttcagtggtaaaattcggacgaaaatatatattcataaagacaaaacaaaaatgtttttaagtttaaagcaccaattgaatcaaatagagtgtctgaaaatggtggggtacaaatgaaacctgatgactgaatcaatgcaccatcttcaattggatcctggagcagaaaaaggacgttgatgaaaaataggtgaaatccaaatgaaatctggagtttagtgggtagtaacgtactaatggtggtgttttgagttttgacccatgtgccatggtaatgtaagatcttaatattagaagaaactgagagaggccgggcacggtggctcatgcctgtaatcccagcactttgggaggccaagctgggaggatcatctgaggtcaggcattccagaccagcctgaacaacatggtgaaaccctgtctctactaaaagtacaaaaattagccgagcatggtggcatgtgcctgtagtcccagctacttgggaggctgaggcaggagaatctcttgaacccaggaggtggaggttgcagtgagccaagattgcgccactgaactccagcctggaggacagagtgagactctgtctcaaaagaagaagaagaaaaaaaaagaatgaaagaaaaagaaacctagagggatgtacaagaactttctgtactatctttgcaacttttctctaagtctaaaattattcccttaagtatggtggggtcaaaatgccctagaccaaagaaaaagcaaactcaaattttcgttgcagctcttccttgagtaccttggctcacttcccagtggatccccttagctgtgccaatttatttccaatttctatctagagcatcatagttgttgctgcccttcgtggacttgtgtgtacttcaagccatctgcccctccccacgtatctatactcaggctccagacagcttcctgttgtttctctctgcacccagacccccttggacttctctgggtgtagaccagggcgctcaaacttggctgcacattggaatcacctgaggagctttaacaactactgacatctcgttgacacccgcagagattctgatttaagtggtctggggcatgacctcggctttgggattttaaaacctctgcaggtgattctaaggggcagccaagtttgagaaaatggtgtcaacctaactagaaattccttcgttcctgggaaagcccggttaagcctggccttaattacagcagaccttccccattctcaggaccacggaggtcacctgcgttctaaggtagatgcttgcacatgtatattgctcccaatcttttttcatgtatgttaattacagcctctgggcagggattttgttccatgcttctttgtgtctccaccaccaggaggtgtacgctcctgattctccgggtgttcctgtgcatcatccttgagagtgagacctaggttgttggtttctctcctggaaagagatggcagtggctgtcctgaggcatttcattgctagttgagcattgccagtgctcaccaggtagcagcctcgcagtgtgggtttccccttctgctaggtggcccctctttctgcatgcaggtgcaggttcacctcactttctttgcagagcagagactttggagtgccctccaactgcggcctgggcaaaaccagctctcttgtttgcatttaaatccaaagtccgatccaaatcacttctaccaacccaatgcagattctggcaaccaggaggaattgcaccttcaaaattttgggactgggacctggtctcatttcagctcctgattgtaaatggtcccaaacacagagaggacttttggggtttcgttgttttggggttttgttggttggtttgtttataacagcagtagttggaccctaccccagagcgactgagtgtgaatctctgaagggtaattactggggatctgagtggtaaacgttcctcacatgattctggaagagccagcccgctcctgctggtcactgggctccactgggaactgcatcaccacaaagcaccaagggccctaattcagaaccgggggatccccaagaaaaatctcctgtgaaacttacaaagaagtcctgcccaagcctcatcctggagagttggagtcagaaggttccaggtggtgctgaacatcttcttgtgttttataaactccacattcaattcagatgtctgacccaggggccctttctgtaaagggccagccagcaaatatttcaggcttgccgactatatggtctctgttgcaactgctcaactttgcgactgtagcctgaaagcagccatgagtttacataaatgaacatggatgggtgggttccaataacgtgttattaaaaaaaagaaaaaaaacaggcaacaggccgatctaggttgtgggccatggtttgtccaccctgaaaaaccacctggggagctataatgtgttcttttatgcccaggcaattaaatcagaatctctgtgggtggtgcccaggcattggtatttattaaaagctcttcaggtgattttcaatcagccaggattaagaaccactgctgtaatgcatggtcattgcactactcattctaaggagcagctcttgctctgatacagtgtttaaactgctccagaaggttctgtgtttctttgtgtgtttgtttgcttgctttgttttcattaaatggaatgattccaagcatatttttctatgcctgcctgccaaaaaaaattttattgagatatgacccatatactgtcaaggatataaatcttaagtatacaacttgatgaatttttacatttttgtttgcactcttcttcacatatatcgtagccacataaccacacagatagaaacataagaacactcaaaggagtccttttttcccttcccaggcaatagtctcctgaagatgtttgaagcctgcctttaaatctgtcttctgtctgaatggatgtcactaagtcaccaagtatttggcaatttgctcataaatattctcggcattatgggggcaaaaacaagcatggctgtggttgagattttctattgcacagtttagttataaactatcgcacagttatagcaattttcagttgctatggcagactgcatccctgaaaaggaagttccgtgtgccctgttggctcatgtatatcaggggacaatgagggctgtcaagcagcaagcagcctgtaagcagcaggccccggctaggtcagctcatcaaacctccatggatgctttgggaaaggagacaagcccaagtggatttagaccgctcattacaacatagcaggcagcgtgagcttcgggtttgcaaaggttccccttgccccacaattcccaggaggtcatgcacagcaggcaaggtgaatgcagcataccccacgggtctgtgtcacaactgctcaggaaatccccagtcttacaaggggttgcaagcaaatgcgctcatcttttctcctactgggagatattacccttatttttttaattgaggtgaaatgtgcatacataaattaaccacgtcaaaatacagtaattcctcccttatatttagagaatctatttcaagaccccaggtggatggttcaagcctcagatactactgaaccctatatgatactgtgtttcctgcacatacgtatctataataacatttaatttataaggcacagtaagagattaacaacaataactaagaataaaatataacaattataacaatagccagcatcactactgtcatgcttctgagccattgttaagaaaaagaagggtgacttgatacaagcactgcagcagtggatctgatagcctagatggttactcattgactcaggggcagcagtgtatacagctggacaaagggatgaacatgtctgaagtgagacagagtgggacagtgagaggtctcatcatgctccttagaacggcactcaatttaaaacttaggaattgggctgggtgcagtggctcacacctgtaatcccagcactttgggagggtgaggaaggtggatcacctgaggtcaggagtttgagaccagcctggccaacatgatgaaaccccgtctctactcaaaatacaaaaattagccaggcgtggtggcgcgcgcctgtagtcccagctactcgggagaccgaggcaagagaatcacttgaacccaggaggtggaggctgcagtgaaccaagattgcaccattgcactccagcctgggcgagacagagcgagactctgtctcaaaaaaaaaattaggaattgtttatttctggaatttttcatttaatattttggaccatagttgaccacaggtaactgaaacctcagaaagcaaaaccttacgtaaggggggaccacttgtatacaatgaagtggtacttagtacattcacagtgttgtgcacccattacctctatctagttccaaagcatttttattgcccccagtgaaaacctcataccacttgaatggttactcctcatttactcttcccttccgcccctggcaactaccaacttgttttctgtctgtatagatttatctatcctagacagttctcattaaatggaatccttcagtatgtgacctttgtgtctggctctgtttcttacccacacaacaggtgagttcgattgcttggccagtgacagctcaatgactacaaccaaggaggacttaacaaagagattttattacttgcagcaagtaagaagaacattgggatagttcccaaagcagtgcctccccaaataatagtgaaaacagggcttttattgggctggtagctgagtcattgtacgtaaaggtagagtaaatgcagtgaaggcaccgtcacccatcatgcttctacatatgtgtataggaaatggtgaataagcaagctcttccctgggaggagagtttagtatggtaatgaggggagttgggcaaagttcatctccaacccaggcatctctggatccaacccacgtttgttttctagggctgagtttcttcctggaactttttagaaacatcaagaacttaagatgcaacagttacaagtatgttctttttcacagtgcatacccaaaattccaggattctgggttacactttcacttagcttaatgttttcaaggtttatccacattgtagcatgattcagtgctttatagtttatggacatgtgagtttccaccttttggcttttatgaatagtgctgctatggacattcgtgtacatgtatttgtttgagtacttgttttcaatatttttgaatatttaagagtagaattgctgggttatatgataatcctgtttaactttttgaggaactgccataccattttccacaacaactgcaacatcttacatccccacgggaatgcacaagagttccagtttccctgcatcctggccaacacttgttattttcatttttaaaaataaccaaaatcagacctgaactggaggaaagtagaggcatgaaaaaccattcaaaagatcaacaaatccaggagttggttttttgaaaaaattactaagatagatagtccactagctagactaataaagaagaaaagagagaagatccaaataaacacaactagaaatggcaaagaggatgttaccactgaccccacagaaataaaaataacaatcagaaactgctttgaacacctgtatgcacacaaactaggaaacctaaagaagatggatactttcctggacacatacatcctcctaagactgaaccaggaagaaactcattccctgtacagaccaataacaagctccaaaattgaatcagtaataaatagcctaccaaccaaaaaaaagcacaggaccagatggattcacagctgaattctaccagatgtacaaagaagagctggtaacattcctactgaaactattccaaaatattgaggaggaaggactcctccccaattcattctatgaggccggggtcattctgataccaaaacctggcagagatgcaacaaaaaaagaaaacttcaggttaatatccttgattaacattgatgcaaaaatcctcaataaaatacctgtaaactgaatccagcagcacatcaaaaactaatccaccacgatcaagtaggctttatttctgggatgcaaggttggttcaacatatgcaaatcaataaataatcatcacataaacagaactagttactagaaaaatgcaaattaaaaccacagagatataccagtgcatacccactaggatggctgtcattttctgtttatttatttatttagagaccaagtctcactctgttgcccaggctggagtgcagtggcatgatcttggctcactgcaagctccgcctcccaggttcaagcaattctcctgcctcagcctcccaggtagctaggattacaggcacccaacaccacgcctggctaatacttgtatttttagtagagagaaggtttcaccatgttggccaggctggtcttgaactcctgacctcaagtgatccgcccaccttggcatcgcagagtgctggaattataggtgtggagcactgcacctggccttctgtttattttttaacttaaaaaaaatttaggttcaggggtacatgtgcaggtttgttatataagtaaacttgtgtcacaggagttttttgtacaaattatttcatcacccaggtactaagactggtactcaatagttattttttctgctcctctccctcctcccactctccaccctcaagtaggcctcagtgtctgttgttcccctgtctgtgtccatgtgttctcatcatttagctcccacttataagtgacaacatgcagtatttggttttctattgctgtgttagtttgctaaggataatggcctccagctccatctatgttcccacaaaagatgtgatcttattctttttatgactgcatagtattccatacgtgatgtgtgtgtgtctgtgcactattccagtgaggatgaccaagtctccccacaagagtttactttgagttttatctactgtgttagtccattcttacactgctataaagaactgcccgagattgggtaacttataaagaaaagaggtttaattggctcacagttctaagtggctggggaggcctcaggaaacttacaatcatggtggaaggggaagcaaacacgtccttcttcacatggtggcaggacagagaagtgagtgccagcagggaaaatgtcagacgcttataaaaccatcagatcttgtgagaactcactcactatcatgtgaacggcatgggggcaactgccccgcatgattcatttacctcccactgggtccctcccacgatctatgggattatgggattaaaatttacgatgagatttgggtggggacacaaagccaaatcacatcattctgcccccggcccctcccaaatctcatgtcctcacatttcaaaacacaatcatgccctttcaacaggccctcaaagtcttaactcattccagcattagcccaaaagtccaagtccaaagtttcatccgagacaaggcaagtcccttccgcctatgagcccatgaaatcaaaagcaagttagttacttcctagatacaaggggggtacagaattggataaatacacccattgcagtctgtagcttgggaggttattgcagttgttgagggagagatggtggtagcattggccataggagaaatggactgactggaggatgatttggagtccattgtcactaggacttgaaggactgaacatgacaatgagggtgagggaggcaaccagctaacgtctaggtttctggctcactactgaggtaggaactgctatggagagcatgctgcaaagaataagaataatatttgtgccttatcagaattgcccgtttatgtaaatattgactttcatcgacaggtttctgttaaattaattaagaagaatgttttgtaacagggatagaagagaagttgctgaagcagcacttggcagcctctgtcctttgcctccctgtaagcaccgtggcttccttaggatgtgttttacacccacatcaggaaaaccttctggggagggatgttgttacgccgtggcaatgtcattagctaaatggtgtttgatcattcccaagcattgtaatgggatagctgaatccttaagcaaaataggtctcctgggtcctgtttctgttctttattgttggctgttttatattaactctattttctcccatgataaatgtagtatatgctcattatagaaaaaagtcaggagcccagagcagcaaaggtcaggagggaaatcactcatcgcccactgttaaggcacccactttattagtaccttgttggattgcctttcagccttacctttgtgctttttattttattttattttttttgagacagtctcgctctgtcgccaaggctggagtacagtggcacaatctcagctcactgcaacctctgcctcccaggttcaagtgattctcctgcctcagcctcccgagtagctggaattacaggcgtgcaacaccacgcctggctaatttttgtatttttattagagatggagtttcaccatgttggctaggctgatctcgaaccgctgacctcaagtgatctgcccgcctctgcctcccaaagtgctgagattacaggtgtgagccaccatgcccagcagatgcatttttagcctgtatattttatatctttttcttaagaaactgccatcatgtaaacgttttccacaattttaatagctccatcatagtctatgatgggcatgtactatattttatttgtacccccttactggacatttagattttcactatttttttcagttatatataatgctataagtaatctacttatggataaaactatttctgtatttagcagcttttcctcagaagtgagtaacagaagtgaattttctggataacagggcatgaatattttaaagacttttcacccataatttttttttttttttagacagagtcttactctgtcacccaggctggagtgtagtggcacaatctcagctcactgccacctccacctcctgggttcaagcgattctcctgcctcagcctcagcctcaggctgagaattcctggcctgtagctgggaatacaggtgcctgccaccacacccggctaaattttttttttgtatttttagtagacagggtttcaccatgttggccagggtagcctcaaactcctgacctcagttcacccataatttgacattgctttgcaaaagggttgtactcacttactgtttaaggatggagtgtgaaattgttgagttttgtttgcgacacgatattcacaaactggcccgaggcactcaatgaacatgaaaaaaaagggagaaactaacttggaggagaccaaaggtattataaaactaatttttaaaatatagctgagctgatagaagaaaaggtttgcatggtttgctctgtgacattgttcattcattcaatacgcacctaataagccttcatatccaaatcaaaatcaggcaggctgtggaaagatctgggtagatttcccagcacggttccgtcacacactatctcagcactctcatggagtggcatttttcagatgaagactccgaagcttgttaacttagccgagatcacatggccagttagtggcagagctgggacataagcccagggtcacagctgctttaattgtatttattgaactatagctatattcaaacagcctgataagcatcagggaaatgaaggtgagaaagcaagtcccacccccaggaacttgcactcactgaggaagctcaaaggcacctggtacttccttcaaatctgtatcagttggctagggcagccataaccaagccactgggtggcttaaacagcagaagtttgttttcctacagttctgaaggctggaagtttgagatcaaggtatcagcaggattggtctcatctgagacctctctccttggcttgcaggtgactgccttctgcctgtgtctccatgtggtcttccctccgtgtgtgtctgggtcctgatctccttttcttataaggacaccagccagattggattagggcccacactaaggatcttgttttcatttaagtacctccttaaagaccctgtctccaaatacagtcacattctgaggtactgtcaggttaggactttgacacagaaatttggggtggacacaatttagtccataacagaaggcaatagaatgagaaaagttgccagtcctcgtttgtgagatatggctattagtagtagtagtagtatttttgagacagagtctcattctgttgctcagactggagtgcagtggcatgaccatggctcactgcagcctcaaactcctgagctcaaatgttcctcctgactcagcctcccatgtagctgggacgatagccatgcaccaccacacctggctaattaaaagaaaaatttctgtagagatgcggtctcactgtgttgcccaggctgagacagggctaattctaagccagtgactcaaccccagcttccctttcaaatcacctgggcggtttttaacagatagcaatgcctccagagattctgacttaattggtctctgaggggccttggcatagatattttgtaaaagctccttgctgattctaatatgtacccaggaccaagaaccttgtttcactgaaatgccaaagagaaatctgagctgctttcattatcctacactgtcatgctttctgcccagcaaacaattagtttttcatggataggatactttctaatcagcaaaatatcagcaccgcagcagaactgtgcgtctccggttaatgtgcactcagctcgcagtgttctttagctctttcattcattaaagtcattagtcttttgttgaatgcctgtgatatgtagacactgtgctgatggaataggccaaataatggcccctgccccaagacaggttccattccctggaacctgtgaatagggagattatcctgcattctccaggtacactcaacttaatcacatgaggtcttaaaagcagagaatctttcctagcagaggtcggagaaatataataaaggcagaagagattcaaagcatgaaatggatcacacccaccattgctgccttttagatagagaaagaggatccccagctagggaatgtgggcagcctcaataagccaggaactggagctggcaacagccttcagctgatagcccacaaggaaacggggacctcggtcctgcaaccacaaggaattgaattctgtgggcaacctgaatgagcaaggaagttattctcgcctaagatctctgggaagaagcagccctgcggacagcttggttttagcttgctgagacccaggtcagacttctgacctgtaggagtgtgagattataagtgtatgttgttttaagccactaaagttgtggtcatttgttgcagcagcaatagaaaatgaatacagctaaactctgaaaaatacaataagaagacaatctctctgttgtcatggagcttagcaactcaaatttgcaaaatttgtaaaagtagaaacaagtgaagtttgtagtaactcaagtgttaggctgaagaagttattgaatggagggtccctgggtgttaggtgctatgtgagacccaagctccacgctttttgatggaagttccagctaaaaggagaatgaagaattttttactgtagatggaaggaaaagggacgtttttgtaataaaaatatagaaagaaatgatcatttaggaaggataggcttttgtcaaaataatagtaatgatagctcctcagacttcaaaggagttcttatccttccccatccccaacccccagatctacttaattttttttttttttctttttgagatggagtctcactctgtcgccgaggctggagtgcagtggcgtgatctcggctcactgcaagctctgcctcctgggttcacaccattctcctgcctcagcctcccaagtagctgggactacaggcgcccgccaccacaccccactcattttttgtatttttagtagagacggggtttcaccatgttagccaggatggtctcaatcttctgacctcgtgaattgcctgcctcggcctcccaaagttctgggattacaggtgtgagccaccttgcccagccgatctacttaattttaatatgaaagctcatggtaaaatcatatgtaccaaataaggaagtgcgtaaacacacacacgcacacacacacacacacacacacacgcacacacacacaatgatggagtatgtcaaagagacacaggactcaattgaaagcactctcagtggccaaagctggaatgatttgaacaacagaataagtaaattaaagttgggtcaggcacaggagttcacacctgtaatcccagcattttgggaggccgaggcaagtggatggcttgagcccaggagttcaaaaccatcctaggcaacatggtgaaacctcatctctacagaaaaatacaaaaattagctgggcgtggtggaatgcacctatagtcccagctactcaggatgctgagatgggaggatcacctgagcctggggaggttgaggttgcagtgagccatgatcatgccactgcactccagcctgggcaacatagtgagacgctatttaaaaaaaaaaaaaagtggaattggagttggaaaataactccaattattggaaaatacttaattggaaagttggaaaatacttaaatataaagtaaatatccctaagtccacactgatttaagtaaatgattcaataaataaatggaatagaaacaaatctcctctgaagaagaatttagtataatttttataaattatttcaccctcaaggaagtgggccatgaactccccactcctaagtgtgggctgtgcatagtgacttccttccaaaaagcacaatatggaaacagcacgggccgaggaatgtctaactttgcagtggaaaaacctgcccaacgctgcctcacctaggagctcaaggttttagcctcatcggtgataacttatgttgatagtgtatccccttgatgtgacgtgatgtgacgtgacgtgacgtgacgtgacgtgacgtgatgagaatagcacttcccctctctggccttctttcccaaaacccatgactctattcttgttgttgttgttgttgttgttattttctgagatggagtctcgctctgtcacccaggctagagtgcagtggtgcaatctcggttcactgcaacctccgcctcctgggttcaagcgattctcctgcctcagcctctgaagtagctaggactacaggcacacgccaccatccctggctaatttttatatttttagtagagactgggtttcgccattttaccaggctggtctcgaactcctgacctcaagtgatctgcccaccttagcctcccaaagtgctaggattacaggtgtaagccacggtgccccgcctccagtctaatcatgagaaaatatcaggcaaattccaattgagggacattctacaaaatacctaaccagtacatcaagattgtcaaggttatcaaaaccaaggaaagtctaagaaagtgtcagaccagcagagtctaaggagacatgactagtaaatgtaatgcagtatcccggatcctagaagagagaaaagacattagggaaaaataaaggaagtctgaataaagtatggaatttaattaataatatatcaatgttaattagttgcaacgaatgtaccatattcatggaagatgttaataacagggcaaactgagtgcagggtatgatatgggaactctgtattatcgtcacaacgtttctatgaatctgaaactattctaaaaatagaagtttatttttaaaaaatgaaaaaaaagtgtatgcaccttaaaatgttttctccatgcctggcaccctatatgttttgtagcgtgaaaacagcctttctgtattttctgcagggaatgaaacctgtgtgtatggatctgagccggcccccagagcagtcctgttttggggacaggacatttgttctttgggtaatttaaaggtaaaagtgctcaccatactttttttttttttttttgtacattggtttctctgcctcacatacaattcattcatcatagtatattaaaggtatttatggccagacgtgatggctcatgcctgtaatacccacactttgggaggctgaggcaggaggattgcttgaatccaggagtttgagaccagcctgggcaacatctcaagacccccaactctaaaaaaaaaaaaaagaaaaaatgagtgaggggcagtaatgtgctcctgtagtcccaactactcataaggctgaggcgggaggatcccttgagtccaggagttcgaggctgcagtgagccatgattgcaccactgcagtccagcctggtagacaaagcaagatgctatctaaaaaaaaaaaaaaaaaaaaaggctatttaatgtttcaagagtatgtttcatctaacagagtacattctgtgaccattctgagtgtacttttgggaaataaggaagaatatatattgtagaaaacagatggagctttggtagttgcccaggttgaaggcaaacctggcttgaccccagacctatgggaatccaattcttgtcccctgtgttaaataagaccatttagaatagctttccacaataggattggaggcaattttaaatcagtctgcccatggaaataaaaaatatggaccctctggcctatggaggaagaacaggaattgtgtatctcgtctttaacactggatcaatggtgcaaacatttaagtactttgtgtagcagttatgtactccatcttcagttgaaatgtattctttcattccgggaaagatttacaattttctaagcggcaatttacttccagtcccagggaggattcacttggtgtttaaaacaaacaaacaaacaaacaaaacaaaatttttaagtagtaaaaacacctgtatgtatttaggcatttttcaggggcctctttatccttttaccccttggccagccgctccctttcattcctgtcctcacttcccttcagctcattcactgcactgacttctcactgtgtggcacgtgtgggctctcaagtgatgggtgaatgcatatcccaaacaagcatagcggcagaaataaagggccagccctcagcaccttaccatcctggagacagaggtacagacggaggtaaaataaggaatcctctgtgcgtttcagcctccttcatggctcacctgttcctctgaggccacaaacccttccaagctggctccactcgagaattttctcaaacatcctatctctcaccgaatacttttcctgagcatcattctccgaattgagcaagagatagtgtgatacttggcagaattcatccccattccccttttttaaaaatctgatatttgatacatacagaagaatacgtgtaacataaatgtaaggcatgcatcctgctaataaaatggacaccttgagccgtccccaccgccaacctgaggacggaggcattatcagtactatcctatcctgcgtcttcctccccgccccctaagagggaccactaccctgaactgggtaattatcattcttttgttttttcaaaatttatacttttatcacataagtaggtaactctaagcaatgtattgcttcacttttgactttgagattacaaaagaagcagcatgccacatgtggtcaactgcaaccttctttttagtctcaatcttaggtttccaagattcatctacattgtgtctaaactagaacctatttatttttgcttctatataatatgctatcatatgaatattccacagtttacttattccttctcctggtttgggggcactggggcttttttccaggtttttgccattgtgatcaatggcatagtgaacactcttggcagatgtctcctagaggcacatgtgtgagcgttccctggtgcaattgttcacaagtgtgaggtggcatcagaattgctcgggaagaacacatatggctgcgccccatccccagaacttctgattcactgggtctagggtggagccagagatgttgcatttttcataagcttccaggtgaggctgaagctgctgctccagactccactttgggaaccacggtctaaggtctaggagtgggatggctgtgctgtagggtgtgtgtgcctgcttcacattataaaataatgcccaatcgttttactatgttgctgtgacactttattttcctatgacagtatgaaaagttccactgaaccacattttcaccagctcttagtattattcatcccccttctctgcattcagtgtgactgaaacttagataactgagactggtgtgtttgctgttttatttaaagaacataggggactttatgtcatttgggtgtgtttttccttgggcttaacaagcagaagaatgggctctaacaggttttccaaggaaagtaaacagtgaacaattcaaataactttaacagattgtctttagcagagtcagggagagcccgatggtgtagtcatttaggtccattttaagtagccattacaaaagcggagatggttcctaacatgttagccgagaccatcaacggacatgttttgtctgttctttcaatggaatataatgttgtttaatcaaaaggcacttcattttgaaaagactcagaggagatgtgactgaaattgcttgtgacagataagatgatcatggattaatttatcacatgctagaactggaagaagatggagaaggacatttatttatttatttatttatttatttatttatttttcagacagggtttcactctctcgcccagactggagtgcaatggtgcaatctcggctcactgcagcctccgcctcccaggctcaagcgattctcctgcctcagcctcctgagtagctgggattacaggcacgcaccaccacgcccggctaatttttgtatttttagtagagatggggtttcgccatgttggccaggctggtcttgaactccttatctcaaataatctgcccgcctcggcctcccaaagtgttgggattacaggcatgaaccaccacacccagctagagaaggacatttaaataaataggagtgttggccgggcacagtcgcccatgcctgtaatctcagcactttgggaggccgaggtgggcagatcacctgaggtcaggagtttcagacaagcctggccaaagtggcaaaaccccatctctactaacaatacaaaaaatcagccaggtgtggtggcgggcatctgtaagcccagctacttgggaggctgaggcaggagaatcacttgaacccgggaaacagaggttgtggtgagccgagatcgcaccactgcactccagcctgggcaacaagagcgaaactccatctcaaaaattaaataaatatataggaatgcagatttctttgtgcagtaaatggtacaattacttggctcatgaggtagcaaagtcgagtatggtgggaaccgtatcagctttcgtcagcgagacccaagtttgattccagctcctctagagaagcccgagtgtgagagagggcacaaggtgcttggtctctccttagcttcagcttcctcatctatgaatttggatcactcctgtgtgcctcgcagggctgctgagtttccatgagaacttatggaaagcacctggcacatagtaaggcactcagtaagtgtcatgtctcctctttttccattcaaacacattttataagaacagtaactattcctcttcacacccattaggatggctgttattgttattatttatttatttatttattcattattattatgttttttgagacagagtctcactctgtcacccaggctggagtgtagtggcgtgatctcagctcactgcaacctctgcctcccgggttcaagtgattctcctgcctcagcctcccgagtaactgggactacaggcacgtgccaccacacccagctaatttttgtatttttattagagacggggtttcaccatgttggccaagatggtctcagtctcttgacctcgtgatctgcctgcctcagcctcccaaagtgctgggattacaggtgtgagccaccatgcccggccatattatttattttttcagaaagagtgtcactctgtcatccaggcaggaatacagtggcatgatcgtagttcactgcagccttgacctcctaggctcagatgatcctcccacctcagcctcccaagcagctaggactataggcgtaagccatcacacccagcgaatgttttgtagattttgtagaggcagggtattgcccaggctgaggatagctattattgaaaacaacagcaaccacaaaaaggaaaatagcaaatgtcagtgaggagacagagaaattggaacccttgtgcattgcttgtgggaatgtaaaatggtgcaacggctacagaaaacagtatggtgggtgcccccaaaatgaaacagagttaccataggatccagcaatcccacttctgggtataccccaaagaatcgaaagtaggatcttgaagagatatttatacatccatgttcacagcagcattgttcagaatagccaagaggtggaagcaacccaactgtccgttgataggcaattggaaaaacaaaatgtggtctatacatacaatggaatatcatttagccttaaaaagaagggaaactcaggcacatgccatcaacattgaatgaactttgaggacattatgctaagtgaaataagccagtcacgaaaggacaaagagtgtgtaattccattgatacgatgtaacaagaggagtcaaatccatagagacagaaagtagaatggaggctgggtgcagtggctcaagcctgtaatcccagcactttgggaggccaaggcgagaggatcacctgatgtcaggagtttgagaccagcctggccaacatggcgaaaccccgtctctactaaaaatacaaaaaattagccggtgtggtgacatatgcctgtaatcccagctactcaggaggctgaggcagaataatcacttgaacctaggaggcagaggttgcagtgagccaagatcttgtcactgcactccagcctgggcaacaaagtgagactctgtctcaaaaaaaaaaaaaaaagaaagaaagaaagtagaatggagtttacctgggttgggaggaggagggaatagggaattatttagtgggcctatagttttcattttgcaagatggaggaaatgaggtctgcagatggtggtggtggttgtacaatgtgaatgtacttaatgccactgaactgtgcacctaaaagtagataagatggtaagtttcatgttatgtatattttaccacaattaaaacaaaaagaatagtaactatcgccatttgtacctcagttcactgtttacaaagccctgtcccatatctaattctcataacaccctgagagacactatttccatgatcctcatttcctgccacttcacctttcctgccttgcctcgctggtatttgtactgatactctgcctttcccactgtacaccattttcacgttggaacagctgtgtgcatgagtcacggcttcatagcttatctaacgtttggacgacaggatcattgtagacaggagacatttgacctgtcctcttccttggctccgcaaagagatgtcagcaggaagagatctcacattaatgagaacttactatgggccagatgtttgacaagcttgatctcatttaaacttcaccaaacaaatctacctctgaggtagattcaattactagtctcattttgtacgtgacaaatcaggcacagacctcaaaaacattatgctgagtgaaagaaaccagttgcaaaagaccatatactgtgtgatcccatctatatgaaatgtccacaacggataaatctctagagacagaaggtagattagtggttgcctatgggatgggagtttaagaggaaacggggagtgactgctggtgagtatgaggtttcttttaggggtgatgcaaacgttcacggtggagactgtagagatggttgcacaactctgaatatctgaaaagacattgaattgtgcactttaaatacataaactgtacagtgtgtgaattatatctcaataaagctgggttttcaaatcttatttagaacaaaaacaaaacaggcaaaaaaaaaaaaaaaacagttaagaaattgcccaatgttacagagctagcaagtaacagagctgggatttgaaccaggcaagttgagttcagagcccacacttctggctttcactcttccctttgtctgcctgagaaactcttcctgctcctttgagacacagctcaactctaatcttctgtaagacttccctgctttccaggcagcctccatgatccctctcctggggcctcgctatccaaaaaacagctcctctagagagcttttcacagtgcactgtgaggcagtctacccatttgctttctcagtataactccatgggtgcttctagagaagagaaaatggattcttcccatccatattcccagggcctacctcgggtcgggcaccaattatgtgtatcaagtcccaacaatgtggctgaaaccctgggacataggccagatacttctaccaagcatcctttggcactagaatcaaataagactcctgcttgtggtcccagttactcgggaggctgaaataggaggatctcttgagcccaggagttcgaggctacagtgagctgtgcgtgcctctgcactccagcctgagcaacagagtgagaccccatctctattttgtgtagcctgtgcagttggtaagatgggagactaggtcagaatgtatagaatttggggaaatgcattgttgcctctagaaaaacatctgcaagttcatgtccaagtggtagaaataaacactatttccttgtacgcagaggtaacacttctcaacttttcttattgtttgactgtctttcttcctgttgtagtttatggaacatagccttagaagattagtcagaactgagctgaaattggacataggtaggaattttaagaaaaattaactctccataagaaagatccaatgtttatgaaatgttgatgtttgtagacacacacacacacaaagactgaatggaaacacgtcaaggtgttcacaataatagcagctcacgttatttaactcttatgtgctaagtgctttacattagtataggataatcgtatgatagattacattataatctcatttaatcctcatactattcttcatctcccactttactaacagagaaactgaactgcagagagacgtgtgtgatcccttttctgaacggtgagattatgaatggtgttttgcattttctgaatttcctacaatgaagatatattatggtgaataataaatatgaaatgttactataatcaaacgttgttagaaacaaaccataagaaacaggaactactgagaagaaaacactttcctagatgataagcctcccctgaattgggaattgtggagctcacagtagcctgctcatcgtagacatgactgatttgagagtttttaccccgcttccaaggtttactcaattcatcttactttcagaatcatcaatagatactttacattgcacgttgttaaatcgcagagaactgggcctagtggcccacttggggaactcacacctccacactgctgacccaggtcttctaataaaaacacacacatctctactgaatcctgcaattgggactcattcgaaaagaaaacaaagataaggttgaagtgggtttcatgaaagaaaactctttatgtgcttgatgactttttggcaaaggaaagaggggaagtgtgctgccgtcaagcgtctccttgggccgcctcagggtccagccagcccgacatggcatgaggtcaacatttgtctcactgaggaccaagggaagggaggtgctgaggttcaccgacatctcaaactgtttcaaggctgataaaggatgctgcataaatgatttttcagatttctaaaacataaaaatgttgaggttccattgttttctgtttgatggccactacccgatgtggggtctcgagaggaccttttctgccttcctcgccatatggcagatgattttcacaggcccgtggacagacgttagagagaagatggcctgtaatgtcattggcaggatgtggctcccacatcagggttgggcatgagaagtgtctggccttgttggagagaggttggagggtcttcggcttgctttcaagctttaagccatgctggtgccctcttcaagaaaaggactcttttttgttctgtgtttaagttttcatttctggttgagtgtagggatctggcattgtttgtagagtattaaagaagtttcccaaaggcttgacctatcagaagagttcaccttcatggtgacagccaggatgttgataagctgcttttttcccttcaacagatgagaacatgcattcagctgtcatcacttctcgggcataaagaaaactcacttcacaggtgctgggagcaccagggcacacccagcatcacaacacaatgtctgcaagacacacacacacctggcccgggcagcagtatggtggacaagaccaggggatggcatccagaaatagagatgtgccaccaagaaggagattgggctgggagtcatgaaaagtggccagaatgtggatgacagcagatgggacaagcagaaggctgaacgtcaaggaagttcatgcacattgagctcacatttcatgcctctggcctgctgtttctgcatttcctgcagatgaaatggatggagtagatggtccctggtctattttacaggtcttccatgtccatcatggtcccttctaagtggggacaggtagatggaagcaggtggctgctgactgaggtccggtgcctggggatgaggaatctggagactcttggcaaataaatcctgagtccaagtgagaagagagactcctttaataaggaccccaaggaaggcagagcagaagtctctgcctcagagcagggacacaagtgaattgatttaaggaggagggaattaaaaaaaaaaaaatcttagcaaaacctgaactgcctaaggttttattgaaagcaaaataatcaatacccatgatagttattattacaagacagcacacagcattgtgtagtaaaatagttatttactggctttcttgccaactgagttttgagctatttgagagcaaggagtccttcatctctgtcctgttgtctggctggaatagacattgaatgaagctccaggacccagggaatggagaaagcctggcgagagaaggaaagtgctccattcctcccgcccctcattccaggttgaaccgagagggtcaaatacagacccagtatttgaaatagcactttggatggcaaaaggttacccccacgaaggtctttaaagtctcaaggtgatgttcattagcgtcgtcatgtgtatttctctggccaagacagataatgaaagaaatgaaaggaagaacaaagcaagggtcactcaatcgcaaaacaggcagtgagagtgtagtttctagaaggaattacccacaggtcatggagcagttcaccaagtccttctgattcatgtttcttcatgtttgtgctcatttaaaaacagccaaagtcaacacagaaaagtagtaaaccttctgccttcgtggcctttgatttcctttcttttaaggggccactgcctactgcaccccactgcatttcctgctagtaacaaggtacctagtgaatttggcagcctttttcttttttcaacttttctgcctttggccagtgtttctactcttgatttattttattttattatttatttatttatttatttttatttatttttttgagatggaatcttgctctgtcgcccaggctggagagcagtggcatgatctcggctcacttcaacttctgcctcccaggttcaagcgattctcccacttcagcctcccgagtagctgggattacaggcgcccgccaacacggcagcctaatttttgtatttttcatagagaaggggtttcaccatgttggccagactggtctcaaactcctgacttcaggtgatccacccacctcggcctcccaaagtgctaggattataggtgtgagccaccgtacccggccccagtcttgttttaaaatgacacgttgagaacaaatgaaagaaggctattagttgtaaagttatttctaaaaatggaggaaataaatgagatgtaaaattgtgaacaatgtaattgactcccagctgtgtgttcatcacattagaactgcaaatgtcagaatttattttcctactcagtggtttgataaaatggtaataagttgcttacacacacgattgtgtgtttaaaaaggctgtagcttcttataattagagattgattccactgttagcctggcaagtggtccagcttttagcgtgaagacaggatcggttctcaatgaggagttgctgttatctatggtggagtagggagatattctagggctgattattcacccgttggcatcctctgacttgagtcattttggtcatttccctgcttatcagtacccataacagagaaaaaaatgtagggtcaagaacctgaaagtcaaagcaattaatttgactttttacttacagctttttatttccatgctatttttttcaaaatgtaaatagctttattattattttctgtttgtagaagtaatatgtgctcattgtaaaaatatatatatgtaaacaattcagaaatatatcaagtataaagtcctattgcaaattttactcccccaaaataactactattaggagttttatctctatccatacaggtctttctgtccatgactgaaacatgtactaccattttggtttcctaatgggatcatattacttacagaattctgtaacttttctttctcccaatgtgctgatgtcatatggttgataaaatgtgacagtgtgcttaaagtgtttagcccagcacctgtcacacagttaggactcagtaagtagtgacatttattcaagggagatttggaggttgtctttggctttcatatcagcattccctatttaccatggataattgagaatttatataaaatgtcagagaagggagacttacagaaaggaatctaaaaatccattcaatggggcttgacataggatctctgagatctcaaaaatgccatgtacggctgtgtgatgtgtgcactgcacaaaggcccccagctgaggggtaagcccaccctgcctgcactccatagctgcacccatggggcctttttcttctcagaggggagtttctttccaatttgcacagattggtgctatacccactagtgacatctctttgactgctggtaagaggttgcttctggggttaattttctgttatatggcccagaagaaatggccaggggaagagtatggccagaaaaaaacacatcgaggcaggcagtgtctagaaggcaacagtggggctctggggaagtcagcaaggtcagcaaggcacaaagtgttttgttccgttaatcaggcacagtggggctcagaaggctctagaaggatagaatcacatgggaccagtgtggttcagacatccagttagcactggagatgctaactggtgaggtccgtcctctcacagagctttaactttatcataaattgcataaatacatgagaggttatttgagatggggcaagtgatgttgaaagcaaacaaacacagactgtgatgattgaatgcagctggggagcggggcaggctactcttcaggtggccaagggtctggggaagtgatattgaagctgagacctgcatccagcagtgtgaatgaggaatcggggaagagcattccaggcagagagaatagcagatgcaaaggccctgtggtgggccagcatagctaaggcacagtgagcaagggggagagtgtgatgaaatggggctgggggtgaggcaagacttcgagcatgcggggccctgtaaggcagtgaggaggtggagtgccgttgaaggattctaagcaagggagtgatgagatccaatttatatttttaaatgatcactctcataatgaaacattaacaatttactctgacactgggaggaaacagtgttgtacgtgagcaagaaaagaagcagaaacatccgataggggctgggtgcggtgtctcatacctgtaatcccagcactttgggaggccgaggcaggtggatcgcttgagcccaggagttcaagaccagcttgggcaacatggcaaaatcccatctccactaaaaatacaaaaattagccgggcgtcatggcacacgcctgtagtcccacctactcgggaggctgaaccatgagaatcgcttgaacctgggagctggaggttgcagtgacccgagatcacaccactgccctccagcctgggtgacagagcgagagtacgtctcaaaaacaaacaaaaaaaaattctgctaggaacgtgcacagtggtccagaccagcagtgaggtcttcgactgtggggtgactgtgcagatggcaggtagtcagatttgagattttgggatgcaggacccaccatttcaggggaaccaggcaaattatcatgaaagagactggagacgtaagggttaaaacaggccccttggctttggggttcgatgttggagtgtggttataagaacagggagaaaaaccatacctcagagcctctgagccatcatgcaaggctccttaaattcaagaggtggattctcccagtgcctgttctcacctataaaagatgtaagagacttgttcatttcttctggttcttgaagtcctaccacgcatcaaaaacattctggttcttgaagacccattgagaagcaatgaacatgaacattttaacgtaccgtactacaaggcagtaatttgatactgggggaagagggaacaaaggaatggtgctattaactgttcaacattggtgcagggctggggactgtgagtcatcatcccttccagacgagtcccctctctctaaagagagaaatctggtactaaaactggacaagcacggaaataaattgaaacccatttcattttaatgttgcgcccttgaaaatcccacaggattccctgtaagatcctgctgtaccctccgaattatctgaggaagattagtcatgccccgtagagtttgcgggttaaggatttggatgggaactgcggataaatgtgcctgtgacttctgtaagttttaagttccttgatgagaaataaatcagcaaaggtcattgtctccccggggcgcagtggatgttttaatgatcattcctctggctacttttggcagaattcagattaaggaagtaaatgatggcaacttaaaggcaacatgtggcagaggggacctgagccccccacagctctcagccacccactctcacattaggggaagttacgttatttctcagctgaccaatttaagctcctacccatagcgaatgagaaggaagggcgtcactccgccacctgccaccccatcccctggaaatgggggttctcctggacactgtagcttccccaggtcaaaaccaagagagctggaccctgctagcagcccttcctcctccattacttgcctgtccctcaggaagtgactcaaaggttgactgcattcccaggagggtttgccttcaatgcaaacacacacaagaaagtggcgtcacagtttgaggcttgatagtataaccagagctatttgttttaaaccatagctcttatttcttgcagctttcttgaactataattgacatacaatagtctgcacatacttgacaatttaatgagtacacaaatgcatacaaatacatgcattcctgaaaccatctaagcgatttaggtaaggaacagatgcatcatgcccaagcatccttatgccctcttgggtttttttgttttgctttgttttgtttctgagatagagtttcgctctcgttgcccaggctggagggaaatggcacgatcttggctcactgcaacctctgcctccagggttcaagcaattctcctgcctcagcctcccgagtagctgggattataggtgtgcaccaccacacctggctaattttggtatttttagtagagacgagatttcaccatgttggtcaggctggtctcgaactcctgacctcaagtgatctgccgggctcggcctcccaaagcgctgggattacaggtgtgagccaccacgcccagccttatgccctcttgggtttttgttttgttttgttttttgggggggggggacggagccttgctctgtcacccaggtggagtgcagtggcgcaattttggctcactgcaagctccgcctcctgggttcacaccattctcctgcctcagcctcccaagtagctgggactacaggtgcctgccaccatgcctggctaatttttttttgtatttttttagtagagatggggtttcactgtgttagccaggatggttttgatctgctgacctcatgatccgtccgcctcagcctcctaaagtgctgggattacaggcatgagccaccgtgcccagccttatgccctcttgtagctcacccctcccttccctgtccccaggtaactagcgatctgctctctgtcactacaaattactttgcattttctagaattgtacggaattggaattgcacaatatatgttcttttttgattggctcctttcactcagcataatcattttgagatttatttatattgttacatgcatcaataatgtgttttcttgttttggctgtccaattctttttttttttttttttttttttgagacggagtctcggtctgtcacccagactggagtgcagtggcatgatctcggctcactgcaagctccgcctcccaggttcatgccattctcgtgcctcagcctcccaagtagctgggactacaggtgcccgccaccatgcccagctaattttttttatttttagtagagatggggtttcatcgtgttagccaggatagtctcgatctcctgacctcgtgatccacccgcctcggcctcccaaagtgctgggattacaggcatgagccattctgctcagccttggctgtccaattctttaagcatcatttgttaaaaacatgtttcatttccaagtgaattgccttggcactgtaagggaggaaaaatatgttttccctgtatcctcctaggttcttaagttggtcctgtaaattaagctgacaaaagacggattaaacaaacaggtttattaacatgtgcttatgtatgggagcattcactggtaacaaggttggttaggacttgggcttacatagcaccttaacgaaagatcaatatatttttaaagaagtgacaagacacaggaaaaggactatacgtttctaggggagcaaattgtgggaaggtaaatgtatgggggaactagtggaagataagggctaaagggctagttaataaggtttgttacgtagattcctctggtgccaattgctgggctgatgaacatctagagttatctcctgtgagtaaagtttgtccttcctggtaaggaaaaaaggtagggacacctttacaaatttatgtccctgttttaggagaagagcagaaactttctttctttctttctttctttctttctttctttctttctttcttttctttctttcttttctttcttttctttttttttttttgagacagggtcttgctctgtctccagagctgaaatgcggtagcgtgatctcggctggctgcaacctctgcctcctgggctcatgccatcctccctcctcagcctcccaaagtgctgggatttgcagcttttcatacatctgcttcttctcagttgccttcaactcagaataatccttatgccaaagcagcacatttgggagtggcatattctgctacccttcagcatctttgtaaagaatcagttgaccacgtatgtgtgggtttatttctaggctctctattgcgttccactgatgtacatgtctgtctttatgccctcacattatctagattattgcagctgtataataagtcttgaaatcaagtagtgtaagtcttgtgaaaagaaaaactttaggcaaattaaatttagtagagtttaattgcacaaagaacgattcatgaatcaagcagatcctagaactaggacaaattcaatgagactctggggctgctatgtgcatggataatatttctaacagaaaaagggaagagatgtgcagaaaacagaagcgaggcagagaaaaagagcccagttggctccagcatggtgtttgccttattgaacataattttgacagttggccgcctgcaactgactgacactagactgagactcagctatttgtcacaaaggcaaattcctatttgcttttcaatttgtttatgtactaagttaggttgcagtttgctatgtaggacttggacggaggcttctaaagcccaaatttagtttaacagtctctaacattgttctttttcaaagttgctttggcattccaggttctttgtatttccatgtgcattttataattgtcatttgctacaaaaatgctgctggaattttgattagaattgcattgaatcaatctggggagaactgacatcctaacaaaatattgtcttccgagccataaacatggcatatctctctacttatttaggtctttttaagtttctctcagtaatgttttgtagttttcagtgtactggtcttgtacatcttttgtcaaatttccctaagtatttcatatttttgatgctattgtacatgatatcttagttccattttttattgtccatcgctaatagatagaaatagaattattatattttgtgtcctgcaactttaacaaacttagttattagtcttgcttctctgctagattccattgaattgtttacatagacaatcatgtctactgagaatgaaggctgttttactttctctttttttttttttttttttgtgagatagagtctcactctgtcacccaggctggagtgtagtgggacaatctcagctcattgcaacctctgcctcccaggttcaagcctcccaagtagctgggattacaggagcccaccaccatgtcctagagatggggtttctccatgtttgcctggctggtctcaaactcctgacctcaagtaatctacccgcctcagcctcacaaagtgctgggattataggcttgaaccaccatgcctggcctctgttttactttctttacaatgctttttatctctttttcttgcctgattgcactaaaacctccagcagaatgtcgaatagaaatggtgagagtggatatcctacacttgttcctgattatagggggaaagcattgtctctcatcattaaatataatgttaatattagcggtagggtttttgtatttaccttttatgacactgatgaagttcctatccattcctagtttgctaagagttatcaccatgaatggatgttggattttgtcaatgattgttctgcatctactgagtgattacatggggtttttttttagtctattgatatggtaaattacattgattttcaaatattaaacaaatagaaaggtggggcacagtggctcatgcctgtaatcccagcactttgggacgctgaggctgaaagatcttttgagttcaggagcttgagaccagcctgggcaatatggcaaaaaatacaaaaaattagccaggtgtggtggtgcgcgcctgtagtcccagctacttgggaggctgaggtgggaggatcacctgagcccaggaaattgaggctgcagtgagctgagatcactccactgtaccccagcctgggcgacagagcaagaccctgtctcaaaaaatttaaaaagaaaacaaaacccagaatagtcctgggataaattctccttaattatgatgtattatcatttttatacattgttggattcaaacatgctgaaattatgtaagaattattgtgtctgtgttcatgagagatactagtatgtacttttgtctttttcttctttatgttggagtaatgctgaactcatagaatgaattggaaagcacttcctcctcttctattttctttaagtttggatagaattggtattattgattccttattgatccttactgattttctttctatttgttatgtcatttattaagagatggttggccaggtgtggtggctcacacttgtaatcccagcactttgggaggccaaagctggaggactgcttgagccaaagatccaagaccagccttggcaacatgacgaaaccccatctctacaaaaaatttaaaaattagccaggtgtggtggtgcatactagtagtcccaaatactgggggggtggggaggtgccgaggtaggaggatcacttgagctcagaaggccaaggctgcagtgagccatgatcacgcctgggtaacagaaaaagaccctgtctcaaaacaaaacaaaacaaaaacaaatacgaaagtgagagagagagatagttgttgaaatcttaagccctaattttcagttataattgcaaatttgtctatttctacatacagttctagcaatttttgcttcaagtatgttgaatctctgttattaggtgcataaacatttagaatttttatgttctctggatgattttgtctctttatccattatagaagatcttcttagaattgatcctctttaccatggtaatattctttgccctaacctatatttttcttttgtgactaccactccagttttattttgggttaatgtggaatatcttttttagtgggggggcaatctcgctctgtcacccaggctggagtgcagtggtacaatcttggctcactgcaacttttgcctcctgggttcaagcgtttctcctgtctcagcctcccaagtagctgggattacaggtgtgcatcaccatgcctggctaatttttgtatttttagtagagatggggtttcaccaagttggccagtctggtctcgaactcctgaccccaggtgatccacccacctcagcctcccaaagtactaggattacaggcatgagccaccttgcccatcctggaatatctttttttcttccttttgtatctaaccctttgtgtctttatacttaaaaatgggttgcttgtaggcagcatatagttgaatttgattttttttttccaatctgacaatcagtgccttcaaatttggtgttcaaaggtttacacttaatatgtttattggtatgattgtgtttaaatataccattttttattttatctttttctatctattatttgttctctttttcctcattttctgcctttttaaataattgagtatttttataattccattttgtcgtctttgttggcttattagttaaaattcttcagtgtgttattttaatggttattcagtaaccattaaaggtttataaggttataaccattaaaggcttaaggtttataatatacatgttaacctatcacaatctaccttcaagtattattatgccacttcacatataatacaagtatcttaagataatgtgtttgcatttctatgtgctgcctgctgtctgtgtctgcaaactcttatttcatatgtttgtacattgttttagttgtttaagaaaggagggtatatctagttcctgttattctatcatagtcagatgtggaagtcctaagagattttcaggcatatttttctaattttttctttttctagagacagggtctcactctgtcacccaggctggaatgcagtggcacaatcatagctcattgcaaccctaaactcctgggctcaagcgatcccccctcagcctcctgagtagctaggactacagacatgctaccacacctggcttgtttttttggttgggataggatctccttctttctttccctcctggtttgtgatgtttttatcagtttgtgtacacttaatatttgaaaaatattaacattttaattatggcagacatcttttcttagatttcttagattgtcacttgccttttttaatgtataagatattttgaaattgatatatagtcaaagttattacaatattttcctttgagatttcttctgttgtgttggggcttatatctctcatctctgtccatgagatatttatgtttaattatcctagtatttttagaggtcaatattcttacatttaatgattttatatacctgtgatttaattaattatatgctgtgaggttaggttatactttttaaaaatattgaatgttcctggcctcactgactgcataggtctttctttctctcctgttttgtgatgctgcttttaccactcataagtcttatgtttataggagccgggcatggtggctcaggcctgtaatcccagcactttgggaggctgagatgggcagatcacctgaggtcaggaggtcaagaccagcctggtgaaaccctgtctactaaaaatacaaaaagtattagccgagcgtggtggtgcatgcctgtagtacaagctattcgggaggctgaggcatgaggatggcttgagctcaggaggtgcaggttgcaataagctgagagcacagcactgcactatggcttgggtgacagagtgtgactccatctcaaaatataataataataataacaagtcttaggtttacaggggtcccttttggagcttttattctcttttataatgtgcctgcccattcttgccgtagcaccacactattaatcctataaaacataaatcttataaagcacaattattcagtcagaagtcctttctagggcacctcccatgttatacatgccacgatgagatcctctccctgccttcaagggccttactggcccatcatggcccagaaggggagaataacctgcaaacagatcatttcatatggataataaatgctgccacagataagaaaggagcattaactctgccaggagaagctgagcaaggttccacagagaaagtggccattgaactaggccttgaatgggaagaagaggggcagggtaggcaaacgatgtacaggggcagtactccagaggtgcagagtgacaaggtgcctttggaatagcagaagctctgctgcgcagtgggagggatcagaaggtggcggggaaagttcagattctggcagtcccttgggaccctgctaaggaacgcatattttatcgtatgagcagaagggtgctaatagagaactttaggaaagaatgtaataaatcatattcgctctgctaatcatcactcaacttgtgagatgctggacagacacaaatgagtaacaacacactgttcttgctatccagcagctcccagtcaaatacaggaggtcaatattttgcactgaattacaaatacactgtaaaagtgctattgtgatggtaacatccagttgtgcctccctgaaagatgaatgaggtcaggaaaggtttatatattgcatggtgtattagtccgttttcatactgctatgaagaaatacctaagactgggtaatttataaagaaaaagacgtttgcccaggcacggtggctcacacctataatcccagcactttgggaagctgaggcggggtggatcacggggtcaggggttcaagaccagcctgaccgatatggtgaaaccccatctctactcaaaatacaaaaattagccaggcatggtggtgcatgcctgtagtcctagctactcgggaggctgaggcaggagaatcccttgaacctgggaggcagaggttgcagtaagctgagatcacaccactgcacttgaacctgggctacagagcaagactctgtctcaaaaaaagaaagaaagaaaaagaggtttaatggactcacagttccccatagcttgggaggcctcacaatcatggtagaaggcaaaggaggtgcaaaggcacatcttacatggtggcaggcaagagggcacatgcaggggaactgccctttattaaaccatcagatctcgtgagattcactatcacaagaatagcacaggagaagtatgcccccgtgattcaattacctcccaccaagtccctcccacaacatgtggggattatggtagttacaattcaagatgaaatttgggtggggacacagccaaaccgtttgcctgttgctgtggctggggacaagccatgaggtcatcacagcaggcatggtgagttgtgaagaaggtttaaaccaaggtgctagggtcatggtgatggaaagaagaattcagaaggcatttttaagaagcaacttgagtacacactgaattcagagacatgggagagggcaaaagatgattgaggtttcttacttaattccacaaatgcaaatagagcacttactatgtccaggcattgtgctaggcactggagacataacagcgatcaagtaatccacagccctccaactgtttagcatctagtaggtgagacagtaaagtgaaccagcaattacagtacagagctatggctaccagaggggtgtgtacatgttgctcacataaagatacataagcgctcagaagagggacccataacctagtcttcagagatttcgtggaattgtaatgtttaaactgacttgaagtacgctgtagaaatttcccagccaaagaagggagtggaaaactgaaagagcatctcaggccgaggtacagaagctggagaggatgtggcttgtttggggatgatagttaagtactgctggttttgaacctgggaagtctggttatacagcccatgtgcttaactactatgctctcctgttaaaggtaatatctgggccaggtgtactggctcacacctgtaatccagcgtttggggaggctaaggcgaaggactgttagcggccaggagttcaagacaagcctgggcaacatagcgagaccctgtccagacaaaaagtaaaaataataaatgaaataaaggtaaaattctcaatctgtctctcaaaggtcttcatgagtgagacactccaacctgcaaaatccagagacatatttgatgaggcaaaaaccagccacatcagagaaggtctgtctgatgcacaggaaggcaggtttccagtttcaggtgtacatgctaacaggaacttcttcaaggaagcccatggttagcagagtgatatggtttgaatttgtgtctctgcccaaatcgcaagtcaaattataatccccagtgttggaggtggggccttggtgggaggtgattggatcatgggggctttagtgctattcttgtgatagagatgagatctggttgcttaaaagtgtgtggcatgagccagatgtggtggtgcattcctgtagtcccagctactggggaggctgatgtgggaggatcacttgagcccaggaggcagaggttgcagtgagccaagattgcgccactatactccagcctgggtgatagagcaagaccttgtctcaaaaagaaaaaaaaagtgtgtggcacctcctcccttcttcctcctgttcacactttatgatgtgcctgcttccccttcacctccctgattgtaagtttcctgaggcctccccagaagccaagcaaatgcctgtatacttcctgtacagctgtggaacaatgaaccaattaaatgtcttttctttataaattacccagtctcaggtatttctttctagcaatgcaagaatagcctaatacacagagcctcaaaagtaacctattttattttttcacattcccaccaacagtgtacaagagttgtcttttaccacatcaacgacacttaccttttggcaggaatagccatcctaacagttgtgaggtaatatctcactgttgttttaatttgcatttccctgatgattagtgatgttgagcattttttcatgtaactcttggtgatttctatgtctgcttttgagaaatgtctgttcaggtcctttgcccattattaaattatctgttttcttgctattgagttgtttgagttccttatgtattttggatattggccccatatcagatgtatggaatagaaatattttctctcattgtacaggtcatctttttactctgattattttctttgctgtgcaaaaacttttagtttgatgcaatcccatttgtctatttttgctttttgtcgcctgtgtttttggagtcatatccaaaaaatcattgccaaaaccaatgtcaagaaactcttctgtgttttcttctagtagttttatagtttcaggtcttaatgtttaagtcttcaacccattttgagttgatttttatgtatggtataagggtccagtttcattcttctgaatatcaatatccagttttcctaacatcatttattgaagagactgtccttttcccattgtgcattcttggcactttcgtcaaagatcaattgactgtaaatgtgtggatttatttctgagatctctattctattccattggcctatatatctgtttttatgtcgatactgtattgttttggttacagtagctgatatggtttggctttgtctccacccaaatttcatgttgaattgtaacacccataatcctcacatgttgtgggagggaccagatgggaggtaattgaatcatgggggcgggtttttcccatgctgttctcatggtagtgaatgagtctcacgagatctgatggttttataaagggcagtttccctgcacacattctcttgcccgctaccatgtaagacatgcctttgcggccggtgcagtggctcacgcctgtaatcccagcactttgggaggctgaggcaggcggatcacctgaggtcgggagttccagaccagcctgaccaacatggtaaaaccccatctctactaaaaatacaaaattagttgggcgtggtggcgcacacctgtaatcccagctactcagaaggctgaggcaggagaatcgcttgaacccgggaggtggaggttgtggtgacccgagatcgcgccattgcactgcagcctgggcaataagagcaaaactccatctcaaaaaaaaaagaagggcatgcctttgctcctcctttgccttccaccatgattgtgaggcctctccagccatgtggaactgtgagttcattaaacctctttttctttataaattatccagtctcaggtatgttattagcagtgtgagaatggtctaatacagtagcctcatagtctattttaaaatcagatagtgtgatacctccaggtttattctttttgctcaagattgctttgactatttggagtctttaatggtcccatatgaattttaggattgttttataagtaacctattttaattgacatagagtctcccccttcaaggaggtttcattctatgggtttctgaggcctaggagatctgtagcacaggatcatgctggactgcattgtagtaagggcctggtctgggccttgacatttccctagctttgcccctctgacactcaactctgcccatccccattgccaccctgctgacacttgcctgagcacaccatgctcttcctatgcactagaagttccctgagcctgcattgtttctcctgcaaccctacctagaccacatgtactgattcttctggcctcagctcagacatcccctgcctcccaggggaagccttctctgacctccctgactctccttcccctggccttcccagaccctagtcagaattaggtattcctcccactgtactccctaaagccccaagaataagtagggcttagtgattaaggcacattctttggagtgagaaagactgtagttctcatactggctctgcttcttcctagctgtgtgaccatgagcaatttcttttacctctataagtctctgtaaaatagaaacttaataccagtactatctatctcacagtttcctgaataaaatgatccatgtaaaagtttatagcacagagcctggaacccggtacatgctggataaatactaactgttgctgttattatcatcaccatagtttacttatccttatttatgagtctattttcactattgcacttgcaggcaggaactgtgtttacttttttgtcatgatctaagcatatagcacataatctggcatgcagtgaatatgcagtaaatattgtggtatggatgaagtttccatttatggaaagcccttgatctaatgtcatcaggagtactgaaaagggatcatgagaagaaacatgggctgcagtctgaaggcctctgagctgtgaagatcagcttagatctctctcgacttagaggcagggagctgtcttcaggcatggcagccacagctctatgtcctgtgtgcccagcctttctcccaagagcggtgacacctggcagcccccatctgcccaccaaagaatgtgcttagagcaggccacctagcctctgtcctggcgtcaccaggtggtggtgggtgggtcttggcatggatcttgccccctgatgtggttagttccagttggactcagcctcttatctggtctgcatctctgattggccctatgctctgacttcagtcaggattttatcctttgcttctgcctgaccctaattaggcagcatgtgttctatttggtttgctctgaaactatgagaatgttctgcccttgccaacagtcctgaatgatctctaccaacactgaatgtgggctttcctacaacagcaccacttctactacccacaatgctgtgctctcctacccataatgcctgctcttctacccacaatgcctgctctcctacccacaatgctgtgctctcctacccacaatacctgctctcctacccacaatgccatgctctcccacccataatgcctgctctcttaacacacaatacctgctctcctacccataatgcctgctcttctacctacagtgccatggtcttccacccataatgcctgcttctctacccacaatgcctgctctactacccacaatgcttgctctcttacccacaatgctatgctctttactaagcatgtgctctactagcctagcccatcctgcagtctgtttcctggtcagcctgtccagctgccattgcgtgattggttacaatgacaggagaggataaacaggaccattcagacatactcagaactatcagaggtatcaataagaatggcttataaaaaaccaatcagtttgtttacataaatggttacttgtaggttaaggacatttgtaaatcacttattctctagataatttcaaaattttcccttggacacttgcttaccctattaattttattaatttaattagctagcccttcccctgtgagatattgcattggcaaatttaggtgggaataattgcaaaagctgtacaggaagaggtgaagttaatctgactatgtactgtatgtacaaatgaaaataatatttgttgagcccttactatgtttcaggcatcatcctaggctctgaggatacagcagtgaacaagacagacaaaaatctctgtcctagtggaacatacattctaataggagagacaataaataaatatataaaatatatggtatatcatactggtgatatgtgctgtagaaaaattacagtaaagcaggaaagagggatgggagttttgagttttctttagggtggttggggaaggcttcactgagaaggtggcatttgagcaaacacatgaagaggtgaaaggatgaggcttgcagctatctgggggaaatgcagaggaagcaagaggtgcagcgggggcctgggatggaggaggagcagcaaggaggccatggagccaaagagactgagtgaacagtggaggggctggagaagaagttagaggtaggattggggaggggaagattggggcagctttgtgggctcttggaaagactttggttttcacaccaggtgaatgggggccaatggagagtttggggctacggggtgtgtgatctgacttgtttctgaaggatggctctggctgctgcaggctagggaaggatagctgcagagggaccattcaggagactcctacaagaattcagggaaaacagaatattttggactggagaggtagcaggaaaggtgatgagaaatggttgagttctgaatatattttggtaggtagaacaaacgggatctcttgatggatcggatgtgtcagagaaagagtacaagatgactattttattttagtcctcaacaactggaaggggaaagttgctattttttgaaaaaagaaaaactgtgggtggatcagattggaggggaaataaaggaattccattttggacctgttaatttgagaatcagtattacatagccaagtggaaaagtaaaacaggcagctggatacacgagtatggagttcggcagaatgagttcaaactagagataaaatctggaagacaggccaggcgtggtggctcacacctgtaatctcagcactttgggaggccgaggcaggcagatcacttgaggtcaggagttcgagacgagcctgggcaacatggctaaaccccatctctacaaaaaatatgaaaattacccaggcatggtagcgcacacttgtagtcacagctacttggggggcttgaggtgggaggatcacttgagcccggtaggtcgaggctgcagtgagccacgttcgtgccactgccctccagcctaggtgacagagtgagagtctggccaaaaaaaaaaaaacctaaaagacgtcagcatagagatggtatttaaaatcatgacaccaaatgatatcatcaagggaacgaacagagagagtggagaagaggccccaggactgagggatggggtgccccaatacttaaaagacagaaatatgaagaagagctagcaaaggagactgagaacgagaagacagtgacttaggaagaaaaccagaggagacttgtgtcttggaaaccaaatgaaaaaaataatttagtatgccaaaggagaaggttcgagaattgagatgccaggccagggttttgcaagggagcaattgattctctgtgaatactaaagccacatagaattgtggcaggaatagtgttgaagagaaggacaactgtgagccagggactgaaatattcaaggaacgggggccaaaacaaggaggagcagcaggcacattatatactccatttcactgaatctgacccccagtcctgtggggtattacgatcatcccattccacagatgaggcataggggaggttaaataccatatccaaggtcctcgtgtgcatgagtggcaaaagcaagatgtgagtccctgcttttccccatggtgctcttctgcctcacatgcaggaggccacctgctctccttctgcaagctggagccttctagccctgacaatatatgtctcaagggtatctttccagttggctgtactggggtccagtccagtggttatactttctcgtgttgcataaatgcataggtttggattctgaataaaccagagtttattctaggtacaagtaaacatagaaagtgcacttactggaattcaagcagcaaggaatttcatataatcagacactcccatcaatgctatttcaaaataatttgtgcttattttgataattttgatgtactgcaagaatctgaaatgccatctggaccatcaaagatagttttaaatataatctggtaaatttgtgtgatgggcacattttgacatactttgataattgcacatttgtatctactatctattgtaatcctcagttaaccagaatattaattgaaccaaaattcattctggataaaaatctgctgtactcgtgcaggcccttttcatcccgttagagtcatcctgtcttagtagtcaagcacgttgtaaccacgaaaaaaaagtgtcggcatttatttagtttttaatcttttagagatggagtctcactgtgtcacccaggctggagtgcagtggtgcagtcatagctcactgcagccttaaactcctgggctcaagaaatcctctcgctccggcctcccgagtagctgagactgcaggcatgtggcaccacacccagctaagtttttaaattttttgtagagacagggtcttgctatattgtccaggctggtctcgaactcctggactcaagtgatcctgccttggcctcctaaagtgctgggattacaggcatgggccaccatacctggcttggctttccttttttttttttttttcagacagtcttgctctgtcacccaggctggagtgcgatggcctgatctcggctcactgcaacctctgcctcccagttcaagcaattctcctgcctcagcctcccgagtagctgggactacaggcatgtgccaccacgcccggctaatttttgtatttttagtagagatggggttttgccatgttggccaggctggtctcgagctcctgatctcaagtgatccatccacctcagcctcccagagtgctgggattacaggtgtgagccactgtgcctggctagcatttattttttcgaaggatcagatggcaatggcaatgaacccccgaccttgggaactcctgctggtggtgcttggtcccatgccctggactgagctgaacaaaccttcaggctgattgcaggttagaagggaggcgaccacagcaggagcagacctgtcaatggcccagagccatggttgcccagagctccagggcctcctgtgagaagctggtgaagataccagggctggcctggtgttccatctaccctgacaagacatggccccagggaccacagatagactgtgggaaatgtccccgcacccatgccctcccagctggtgtccatcagggaaagaggtggaagaacaaagattattcgtttattatctgtctctgataggagagagaaaaaaatatgggctaagtcaaaattcctaaaaggaagcattcatgacctggcccaggccttgacctgtaaccgtggccacctcttggccaagcactggggaccagaagggaaggggggaaaacaccaggatgggcacagtcctacttttgaatggtttacagccttgttttcatgtttctttttcttggctcccaaaaactggagaaaaaatacatttcaaagaaggcttcctggggtgcagtgtttgagaagtgagtaggtggggtagaggagggagaaggttcccttcctcccttcctgcctgcctgccttccttctttccaaatatttgacaaacattgtcctcgagtcaaggtctctgtcctcatgctgcgtatgtcctactgggggagacatgcaaatgtaacaagacctaacaagcaacgtaaccacagcctgggacaggccgtaagaggaaggcctccttagaacttgacagtagtgttgattagccaggcttgtgggagtctgtgggtccccagttggaagagggcacacttgggagctccagaacccctcaaccatcatactgtcttagtccgtttgtgttgctataacaggataccctagactgggaagtttataatgaacagaaatggattggcttgcagttctggggctggaaagtccaaggttgagtggctggcatcaggcaaaggccttcttgttgcattatcccttggtggaagagcaaagagagggtgagagagagcaagagatcaaactcacaacctcaggcccttttatagtcggcattaatccactgagagtggagtgctgatgacctaaacacttcccattcggccccacctcccaacactgttgctttggagactaagtttccaacacatgtttttccagaggtctatgcaaaccatgacaatagctaagacctttctgccctgattagaaatcagaaacggagccaggactcagggcctgcctgtcctctctttccaggagtctgctgccctcagggccataaacacaatcaatcaggcagatggcctgggtctgtctgttcttgataactggttcttgtcaaatacaaatggaaatgctattccagctgcaggagggcaaaggtgtgattagatgagaaatctcccaaggtgtacaatggaagacccaattaacagaaagtgttactcagcaaacacgggggcttggcactgtagatgtcaatcacagcctccccttagaagggcaaactcttagaactctaaggcacatatctagtgttttatctatattaggttatttagttctcacaaaagtcctacgagggtggtactgttagtatcctgttttatagataaagaaactgagacacataagaggttaaataatttgcttaaggttagaataatgaccccacattgctggggtttaaattccccctgtatccctttctagatgggtgtccttgggtgagtagtgacagggctgagatctgaacccagatagcctgactccagacttggtattcttaataatcgtgtgtgtgtaggggtgtgtgtgtgtgtgtgtgtgtgtgtgcacatgcatgcatacagagggggttgcaggacaagcctctgctcttgaggagcttaaaacttaacagaaaatacaaagttgtattgattaggccttcaggctgcggcaaaaaagaatatacacaatttagaaagagaaattacttttcttgtgaggaaagtgaaagagagatatattcaagtgtgttactggcctacagtaaatacctagacattgacaaaacaacctggcactttcgagaaattcacctgctttcgttgcctcaaaaccacttctgcaaagttaatggagtcttcctgttgcacctgccctaactcccttttgcctttgtgaataaactcgtctagaagactcaaaagcacaaagagagaaccgagttttcatgaacaattacatgtaatagtttagggtatctggtgtgtgctgagctcatggctaagagttcatgaatgactgtccctgtgaggtcagggcctgtacaaacagaaagggcatttagcaagggccttgaaagatgagtacttatattttgggtgattttttatttttgtgtttgggtagatggaaatgttaattttttttctaattagaaatgtaatactcatgcctgtaatcccagcactttgagaggccaaggcgggtggatcacctgaggtcaggagttcaagaccagcctggtcaacatggtgaaaccccatctctactaaaaatacaaaaattagccgggcatggtggcaggcacctgtaatcccagatgctctggaggctgagacaggggaatcgcttgaacctgggaggtggaggttgcagtgagccaagatcgcgccattggacaccagcctgggtgacaagagcaagactccagttcagaaaaaaaaaaaaaagaaaaagaaagaaagaaatgtaatacctttcccctgctatctgccactaataatcagttgtgaaaaaatattaaatattcttttttaatatgtacccaaaagaattaaaagcagagactcaaacagatattttcacacccctgttcctaacagcattattcacagccaaaaggaggaaacaacccaagtgtccatggatggataaatggataaacaaaatgtggtctatacatacaataaaatgttatgcagccataagaaggaatgaaattctgatccatgctataacatggatcagccttgacaacatcatgctaaatggaagaagtcagacacagaaggacaaaatattacacgagcccacttatcacttatatgaggtacacagaataagcaagtttatagatagactgtagaatagaggctgccgcagtggggcgagggaacagggagttactgtttataagcacagagactctgggataatgaaaaagttctggagatggctagtggtgattgtacacatcatgcatgtacttactgctactgaactatacattttaaaatggtgaaaatggcaaattttatatgtattttaccactataaaaatcaataataagaaaacaaccaaaaatatgtatggtgggagaaaagattccatctgcaatatctacaaaagctatgaaatgggaatcagtgtgacaagatttgtgcagaattcatatgaagtaattacaacattctactaaagctcatttttaaaaggtttctataaatggagagacactgtgttcctagtggaaaaactcggtttggtaaggatgtcatttctccacaaatgaatctctaaatgtaaggcaaccctaatcacaatccaaatatcttttctggaacttaaccaaatgattctaaagctcatcaggaaaattgaacatgaaataagcaagggcatctttgaaaacaaaaagggaaaaggaggaggaagagaagagaggtgagggaagagccctcacaagcattaagaaaaggagaacagggctggacgtggtggctcacacctggaatctcaacacttcaggaggcccaggaaggaggattgtgtgagcccaggagtttgagaccagcctgggcaatgtaacaagaccccgtctctacaatacatcaaaaaacttacccagacgtggcagtgcgcacctgtggtcccaggtacttgggaggccaaggtgggagaatcacttgagcctgggagggcgaggctgcagtgagctgtaattgaccactgcactccaccctgggcaacagagtcagaccctctctcagaaaaaacaaaacaaaacaaaaacaaaaaggagaactgtctacatttttggtaccagccccagcataggcaatggatcaattaaacaaaatataaaatccagaaacagatataagaattttgtctctgataagtgacatttcgggagagtggagaaagaatagactattcagagatggtgctgaagagcctacacatgagaactaaagacacactagcacaagtccaacaggggaaaaggaaaaagatcattggattgtatcaatgtcaatatcctggtagtgatattatgctgtagttttgcgaaatgttgccattgaggaaaactgggtaaagtataaacagaatctttctgtattatttcttacaactgctgtcagtctgcaattatctcaatagaaatttcaatttaaaatagtgataagaaaaataaactttttaaaatgttatgtgcctgcaattaacaaggaattaaatattacattgtttttgaaaagcacagccataagtgaatactggaatattcctagggtaaggaaggaaagactttactctctgtgaccccaaaagccaagagccacaataaaagaaattgatttacctaaacaaaaattaaactttagtgtagcagcaaaacatttatgcacaaataaaagacaaacacaaatggggaaaatatttgcaacatatatagaagacaaagggttaacgttcttaaaaatatgtaaagagctcttaccaaccaataagaaaaaccataaataccctaataggaaagtgggctaaaaacataagcaggcaagtcacagaagaagaaatacaaaaggccagtaaacacatgaaaaatgtaggcaatgaagcagaaactgctggagaaacaacatgcaaattctggaagaaatacagtttaaggaagctgagaggtaatgtcttatttactgataacaatgaactccacatctggcatgtagtagatgctttactaatgtttgttgaatgaataagtggaaatgatgaacacaaatggcttgtcaaggagaaggaacattccagatgcaggtaggagagaaaagtagagtcacagaacaatccttaaggaagagaaacgcaagttaggtgaattcattttagagcctatttttgccagtaaaactagaaattatgtcatcagaagaaaatccctttgtctcaactcccagaagcctgcagtgaagacactcagataggagagcctctgagatatggttcaggatttaaatcattctcttcagtgccttctgtctgcctctgtagctgctcattcctctttctgttgcccaatggataacaatgacttcaccctttcttagccacatgcttgagccaccaagtcggaccccactgagcataacagtgtgactgacacaaagcacatcaggtgcaggatgaacttgaactgtggtttgcactgggtgcttcacacttgctagctgagttggcagttccatctaacttcacgtttcttatttatttatttatttatttatttagagacggagtcttgctctgtagcccaggctcaaatgcagtggtgcaatctcggctcactgcagcctccgcctcctgggttcaagcgattctcctccctctgcctcccgagtagctgggagtacaggcatgtgccaccacccccagctaatttttgtgttcttttagtagagatggggtttcaccatgttggccaggctggtctcaaactgctgacctcaagtgatcctcttgcctcagcctcccaaagtgctgggattacaggcatgagccactgtgctcagcccacatttctatgtttaaaagtcacttaccaaagactctggcatttggggtagcagcctggagttcatgggaggtgtctgtcttcagtctctgttccctttgtggaaaaataaatcctaatgaatcagcccatcctttccccatgactagctaaaatgccattgcgttacaatatttttgaacttttcctctgccagctcaattattatacccatcccatgtgtgccacaaatgtcacaatgcttttaaagaatggatctatactggctttggccaaaggaaagttacaacttctttctgacactaataatactaaaattaacatttttaaggaaaggccccaaaagaaccccctcaaagaaccatttcttgcagaacagtgattcatttagctatgcctagaaggcgcctctaaaaagaatgaggtttcagttgtatctctttaaagactcttttaaagaaatggaaggaagggggaagggaagaaagagactagaaaagaaggagagaatggagaagagagaagaaaaacttaatcttctactagggttgttccctagagttactgtcatagcaaatgtgaggtgtgtgtcaaacatttcttggagtttgtaggttaatgcagtatacctagtggttcagtagtaccataggaaatttcatgattttgtaggaaagagctacagactgaaagaacacatactgtaaataacacatttatttcaagtctttttgattctgtcattttgtatccctgggccatgctttattcttgacacttaagtaaaaccataaaaggtgagagaaccactaatcctttgtaggtctttgactttcaaatgggatttctggaagcatgagggtcccacaaatgggcctgtattagtttgtttttatactgctcgttcatttctcactgtattcgttcatttcacactgttcatttcgcataccccttacccatgggtaatttatacatgcaaaaggatttaatggacttacagttccgcgtggctgaggaggcctcgcagtcatggtggaaggcaaaggggaagcaagacatgtcttacatggtggctggcaagagagcttgtgcagggaaactcccgtttttaaaaccatcagatctcgtgagacttattcactatcacaataacaacccaggaaagacccactcccatgattcagttacctcccactgggtccctcccacagcacatgggaattcaagatgagatttgggcggggacacggccaaaccatatcagggccaaagaggctgccatggggagagggagagtgctgatcagggtggggctgggacccaccctaggccaagaagtacagctcatcttcttctgctttttacaccaacggccacctctccagaggggccttgtgtacctgtcctctgcagcaagaaattcaaaaaggcaggcagattcaggtatacttggcccagaggtccatcaaaataaagacatagtcatcattcttcaaaatgtctcagagccagattttctcactcacgttgaagaaaaggcacaaaggcacctttcatcggttacatgcctgtgttggtaacattctacttaattgaaccatttcttctcagtctgagggagggcaatttagttcaagagagaacataattatatctgcttgcttttaaggaatagtttcacaattttagaagttaagaagcactggaattgggacacctccttgagataagtaaatcacattgtttttcaccttaaatgagggtaaaatcagaaataatgacagcatttattgcttctagcattcattccaaccatcatcctggctgaccgtgaggagggaaagcttgtgaaagcagaaaacacagcactaaatgcccccaagatgcagtgactctcagggaaatgaaacgttttgaattcctcttcgcaagctgatgcactctgattcccatgcagccgatttttgttatttctgagtgcaagaactactgtgatttgtagtaatgcagatgatttaaagagtctctatttatcataccctcgttttcagcttatacagttagaatagctgtaatttatttttcacttataaactacttgttgctgaagagtctagaaacatccccatagttcagaagttacctggaaaacagtttaatctgtgctacattcataatcttttgtcagagatgctttactgttatggaaatgagagaggagtcataaccctaaaaatatcaaattccaagaatatctgtaactttgggaagaactgtattgatagcggtaaccgctgcaaaatgatagctcaagcacagagtggaaatacgttccctttggcttacctggcaaattttaatatgctttaaatcagcctgtaacatattttttagttgagaagtgttacagatagaaattttctttgggttgccgggcgcagtggctcacgcctataatcccagcactttggggtgctaaggcgggcagaccacctgtggtcaggagttcaagaccagcctggccaacatggagaaaccccatctctactaaaaatacaaaaattagccagacgtggtggcaggcacctataatcccagctacttgggaggctgaggcaggagaatcacttgaacctgggaggtggaggttccagtgagccaagatcacaccactgcaccctagtctgggcgacagagcaagactctgtctcaaaaaaaaaaaaaaagaaattttcttatttatttgggtagactgtgggtctacctgcctggcctgtggaaggagagctgcagaggcagggtgagtcctccccagaatcctgggatgatggcatgagcagaatgagctctgattggtgccctgcacacacacacccaaatcacagaatattgacattggaaggtccttagacctcatctggaacaccctatcctcattttaccaaagggacaaccagaataagttgtgggcatgacacagtgaggttattaactgggtctgcactagcacccaggccctaactagctagctacatgactttgagcaagttacttaacctctgtgtacttcagatttctcaagtgtaaaagggggatgaagggttcccacctctcaaggttggcatgaggattatgggaagcaccaaactcagtgcctggctctgaaaatcgggcacagactgtcatcatgactgtcctcattatggcacaattctgacagtcaaacagctttgtgcttagggacctagagaggtttaaccctcgtatcgcagtcatgaaccaaaagcccaggagcgaaggaagaacttcccaaaggcgatctattttcattgcttttctcaccaccaggtaacacagatataaagagtacagttatcctggaagcataccatttattgagttacttaattgccagtcctcctttggtctattaaatcatggagcaacgctgtcttgaatggaaaactccagaacagtgattctcctgctgtagggtaatcattgttctaaatgcagggaactggattcaatcccagacatgctgatttgtaggtaaggctcaggaatctgcatttaaacaagttcctcagatggttttgataccaatggttaaggtgccacactagaaaacactgcctagaacactggggacccaggcctgctcattcgctgaggcagtccaccaagctagcaaacacccctgccgaaagctggttcggaagtgactgcctcaatcctctatcacattgctgcatctccctcttcctctgctacccccaccccctgccaataatcccaaacctcattttacaaaaataaactgggactagcacctgcctggctcacatgacaggaggtgtattggctgggaagaaacactttcctctcttcacttcctttatcaacatgtaggaagtagaaggtccttgaatactttggaagtcagttccatccaaaggaagagtaaggagcaactattttcctgtcggccacaaggccccacggttaacccagaacttctgaagacagctcattttacgtactgtaccatctgaaatgttttctgcatcacatactaacatacaaaacaagtgaggggcggggtgtggtggctcactactgtaatcccagcactttgggaggctgaggcaggcagattgcttgaagccaggaagtcgaagccagcctggacaacatggcaagaccccatctctataaaagatacaaaaattagtcaggcatggtggtgtgtgcctgtagtcccagctactgaggctgaggtggaaggattgcttgtgcccaggaggttgaggctgcagtgagctgaggtcacaccactgcacttcagcctgggcgacagagtaagacctgtctcaaaaaaaaaaaagtgagggttgcttttgcttccaggaccccagagatattgttatcctttgctgggttttgttggggaatagggacaccattctttagactcttccccaggcacacttgacttttgttgccttccacaaaccaacactgtctaccccagtgccatgactctagctcgtaggtatttccctgagtgaggtctgtggccattgcatcagatcactattaggcactggtttaaaatgcatgttttctggtcctactcaacctcctgaatcagactatctggtgataaggcctagaaatcccagtttttaacaagctcctcaggggatttcttggcatactaaagtttaggacctttgtcccaggtgatctaagtttccttctaccttattcactgacatggtttgtctgtgtcaccacccaaatctcaccttgaattgtaataatccccacgtgttaagggtggggccaggtggagataattgaatcatggagggggccatttcccccatactgttctcacagtagtgagtaagtctcatgagatctgatggttttataacctctggcctgccaccatgtaagacatgactttgctcctcattcaccttccaccatgattgtgaagcctccccaaccgtgtggagctgtgagtcaattaaatttctttcctttataaattacccagtctcaggtatgtgtttattagcagcgtgagaacagactaataatacattcaccttttatatgcagtataaaagttaatttttataaactaaaaagttaatttttaaatactgcaaataaagatgtgatcagatcttccatcctctctgaagcttggcagaagtttttatgaagttttaagaagttttattttgggcatatatctttggtgtcatctgcaggtgactcagaagaggtgttgacttgattttgtacactgccttgtgcaggtcgccttcttgtgtgttatttctagtactttatttcctggatcaggtttgaaactcctggagggcagaaactatcgtctcactactacctcctctccttgctgtcaacacagtgtttgaaacctacggaatactcaatgctgccttatttgattgtcacagcagcactttccttgcatgcctctctcaacatgagaaacgaggatttcccagaggaagtcagctttgatggggaacccctgcccctcatatggtaaacgtttatctctaagcattttctttaggatattcatagaactttatctgcagacgggctctcagtagcctgtgaagtacagatgccccctggacctctccatgggcctcctccctctccacataactcctagcatacatatcccgaggtacttacttgtcccggtctctccttaccttaagtttctttaagggactctcatcaccactctggcactcccaaaagttaggttttttaaaatttctaacattctgtactttcttcttctgccgggggcagagatgattttaaggaacagcctccaactgagggcaggggtaggaggaagagagcattctactgttgataaatatttggctgcttcccaaattgggctataagaatagtgtttccacaaacttttttgtacatgtctttttgagatgaagcagggatccctcttaggagcctgctggcccactcccaaacccacaagcatggaaataaaagaaaataattgagttccttcaggggaaattccaggtacctaggtacccctgagaagtaaatcatccaagcatttaactaagagaagattttacccatatgattgtcaatcaaaaaaaaaaattacaagcctcaatcattttattatttatttattttgagacagagtctcactctgttgcccaggccagagtgcggtggtgcaatcccagctcactgcaacctccacctcccaggttcaggtgattctcctgcctcagcctcccaagtaactgggattacaggtgcccaccaccacacccagctaatttttgtatttttagtaaagacacggtttctctgtgttggccaggctggtctccaactcctgacctcaggtgatccacccgtctcagcctcccgacgtgctgggattacaggcgtgagccaccgcacctggcctcaatcattttaagagatttatttgccaaagttaagcatgcgtgccagggagacaggtctatgcctttctctgaagatgattttgagggcttcaaatctaaaggggaagggcgggatattgagaagtatacaattttcctgtaagagtaggatagggaaaaaatagacattcatgcctttgtctggctcaatgaatctgtgtgttttacataagatgacgtaaacaaatggggcagaggaaaaatgcagggaatctgcattttctgtcagatagcatagacaaaatggggcaggggaacaatcagatatgcatttgtgtctgttggacagggctgactgcacctgtaaagataagctatcaatttgcattgctgtggtgaaattttaacagctcactaggaatttccttgtgggcaaaatatgggggaggatgtagcttttcatcttgtagccatcttatttaggaaccaaaaggcagaggcaggtttgccggacccagttcccagcttgacttttccctttggctaaatgagtttggggtcccaaaatttaatttcctttcacataatctcctggtaaataccagttcacttgcctaatcgtgtcaccaatccctacagctcatttccagctaggtgagaaaggagacagacctgctgagcccctccttggggaggctcttctctgtagggctgagactgctaagcaacagatttattctgtacacaggagccccaaggcacatgggtagactatgaaggaaaactcatagaggccagagaaggccagtttcacatcccattattccttcttggtaattttccagtggtgtttgtgaagaaggaacgatgtcaaaggagagatatccttaccttgattttcataattcataaagactgcttttttgatttgtataaagcagattatgattgtggaccctgaacatgtgagacatgtctaagttaatttagaaagtttattttgccaaggttgaagacacgtgcctgtgatgcagcctcaggaagtcctgacggcatgtgcctaaggtggctggggcacagcttggttttataaattttagggagacatgagacgtcaattaatatatgtctggaaaagtgggacaacttaagcaaaggcaggaagaatggaagtggggagggagcttccaagtcataggtaggtgagagacaaatggttacattcttttgagtttccgattagcctttccaaagggaagcaatcagatatgcatctatctcagtgagcagaggggtgactttgaatagaatgagaggcaggtttgacctgagcagttcccaacttgacttttccctttagcttagtgatttgggggccccaagatttattttcctttcacatgatgaacacaaacatggagcaatgtgaaatttcacagagacaaaactaagttctgtctactggcatcattctgtcttgcagaactcagtgggcagtgttcttgatgggaaaaaattgactttataaagttatagaaggggccaggcgtggtggctcacacatgtaatcccaccgctttgggaggattaggtgggcagatcacctgaggtcaggagttccagaccagcctggtcaatatggtggaaccccgtctctactaaaaatacaaaaattagctggctgtggtggcaggtgcctgtaatcccagctacatgggaggttgaggcaggagaattgcttgaacctgggaggtggaggttgcagtgagccgagatagtacctctgcactctatcccgggtgatggagccagagtctatatcaaaaaaaaaaaaaaaaagtgatagaagggcttggaaaaggattttgagtcaccagcttgtacccttgccttagatttataggtgtacaggagttcctcgagggcgaggtgaccgaaattgttaatttcctacggaacatgtaagcctttggtgcacaactatagctttcgattataggatccaaaccctggcttgtcaaatttgaatcctgatacagtgttaacatgagcatgttctggtgttattgtattgtctgagtggtaacttaaccataaaacacttcagtgtaaagtgttacactgatgtgattgtattgttctggtgttatatgagtggtcacttaccataaaacacttcagcatagagtgttataagtgtgtgggtttgcataagttcacttcaatttatacctgagaggcaattggccatgcaagtgtctattttggaatccattctaaagaggttactattaagcacgatcaacattgtcatcagaatctgcaccacagagtgaattggctagggtaaaaaaaaagctagaaataattttcaatcagagaaatgagtgttgtgaaagataaaaggctggccaagcagattgtgtgaaacccactgcccttgcatgaatgaggcagtaaattcacccagcaaacctgcccccttccaagcctcactcaaggcctagagcttcaatatttctatgtcacctagaaatcaataataaacaagagaaatggccaaaataagtgagcaggtgctaaagagaatattcaaattaccgtgaaacctatgaaaagatgttcaacttgattagacatgaaggagatgcgaatgaaaaccactatgtatccaccaaaatagttacaatgaatatcagcgagaatatgaagaatatactaggtgtggtggctcatgcctgtagtcccagctacttgggaggctgaggcagtaggatcacctgagcccaggagtttgaggctgcagtgagctatgattgcaccactgcactccagcctgcgtgacggagtgagaccccacctctaaaaattcaaaaagaatatgaagaatatgaactgaagctcaaactttgatgaggggagggtaaatttgtacatccactttgctgaacatattcatattatgtgagtcatcaattgcattcataagtgtatgtatccaagagaaatatgtacatatggtcaccaaaatgttatcgaactgaactggggtccacttgccaggtgcagtaaggccagatatccacaccagggtttgaaatggggagaaaggagggtgtttgtttgcagggcactaaacaaggagaatcaggcagctcaggcttaagacccaaacttcccaatggcttgcaagcaagggaaaatttcaggaaagtagaggttacaagcagaattgtaagtcaatacatgaagattatacattggtttggcctaaaagggcaggatatcttgaagcaggggcttacagatcataggtagtgtattagtccgttttcacactgctataaagaaacacctgagactggatagtttataaagaaaagaggtttaattgactcacagttctgcatggctgagaaggcctcaggaaacttaaaatcatggcagaaggggaagcaggcacatcttacatggcagcaggcaagagaaagtgcaaagagggaagagtcccttataaaactgtcagatctcggccaggcgcagtggctcatgcctgtaatcccagcactttgggaggccgaggcgggcggatcatgaggtcaggagatgcagaccatcctggctaacatggtgaaaccctgtctctactaaaaaaatacaaaaaaaattagccgggtgtggtggtgggcacctgtagtcccagctactcatgaggctgaggcaggagaatggcgtgaacctgggaggtggagcttgcagtgagccgagattgtgccactgcaccccagcctgggcaacaagagcgagactctgtctgaaagacaataaaaaataaataaataaataaaaccatcagatctcatgagaactccctcactatcatgagaacagcatggaggaaactgcccccatgatccaatcacctcccaccaggtccctcctttgacacgtggggattataatatgaggtgacatttgggtggggactcagagccaaaccatatcacgtagattcaaagattttccaatttgcaattacttaaggaaaagaagctttatttaaaaactggaggtcaggccgggcatggtggctcacacctgtaatcccaacagtttgggatgccaaggctggcagatagtgcttgagcccagaagtttgagaccagtctgggcaacatagtgagacttcatctctacaaaaaatccaaaaattggttttgtttggtattgtaaaccaatagtcccagctacgtaggaggctgaggcaagaggattgtttgagcctaggaggttgaggctgcagtgagccgtgatcacaccattgcactccagcctgggtgacagagcaagaccctgtttcaaaaaaattaaataaataaataaataataaataaaataaaataaaaatttagggtcagcagagaagaatgttagctctggctaatgggcataacctcctccaggatgctcaggaagaactttagaacaaaggatagcactcagagttcagtcctcagctcccccttatctgagatgtacatgacagtggatccatttggtgggggaccaggtttctgaaaaacaactcggagacatatattaagatgttatctttagtttctatagggaaccaaaaaccttgtgacttcagcttccttagctattgttttaagctactactcccttcttggtcatcaagttgctcatttacttctcaggggtacctaggtacctggaatttcccctgaaggaactcaagattttcctttatttccatgcttgtgggtttgggagtggaccagcaggctcctaagaggggtccctacttcatctcaaaaagacatgtacaaaaaagtttgtggaaacattattcttatagcccaatttgggaagcagccaaatatttatcaacagtagaatgctctcttcctcctacccctgccctcaattggaggctgttccttaaaaatcaaacaggttcaacagcctgcttgatttacaagttgaacctccattaaattccacataccttgcaaggcctcctcttgaagcccctttaagtccctcacacctaattttcaatggaaaatggagcagggagctgaagaagaggaggaagatagagggaaacaggtgcctgttgaaaacactgaaagtcccagacagaagatatttcattatccatcgctgtgtggcaaacctccccaagtgagtggtttgaccaaccatgggtgtttctcacaatgctgtgaatttcctgggctcagctggcagttctttggctcaactcagtgtcaactgctgactcttgtgactgcatccagctgtagccttggcttgggctttactcagtacctggcactaggaatccagtcatctaggaatggctgggcctgtctctccagctgagtggtcacccttcttacgtggtgtctaggggatccagagagaggaagctgaagttcctaagcttctgacagcctaagcctggaactagtacagcatcgctcccaccatattctgctggtcagagcaagtctcagggtcatccaagattcaaggagagaggaaataggcttcatctcttaatgggaaaaacagcaagtgcttacaaggatgggagcaatttgtttgaaatcatctttggaacctatgtaccacaagcaacaggaggagaggagagaagtctgcattgcagacatgggatctgaatttagccaagcctccacaacctgtgaagattgcctggcttattgaagcttcagtttccccaccgataacttgaaaagcttggactagaatgtcatgaagtctgtccagctttgagagttgtggtttcataatccacataaatacaatgggcccagtgaggacccagggcctcctgctgatcttctaagtcttccatcattgaacccacttcccatcccccacctcacccctcaagaataatccacaggagtctgttcttgcctcctttcttcatcccagttgacattggaggggctttttaccaaaaaaaaaaagtctgccaattcttttgtagtttcatcccacatgagaaggcttaaactgttagcatcaaaaagattgtgggaaagtatatgcaagtcaagctttggttcctcggagtattgagaagaatgaatcaagaggtatgctgcaggtatctgtgcaggtgtttgactgcaacttgagaaaacctgctgagaaacatatttttctcagtttaaaaataatgaaagaggcctggctcagtggctcatgcctgtagtcccagcactttgggaggccgaggcaggtggatcacgaggtcaagagatcaagaccatcctggccaacgtggtgaaaccctgtccctactaaaaatacaaaaattagctcggcatggtggcatgcgcctgtagtcccagctactcgggaggatgaggcagaagaagcacttgaacccaggaggcggaggttgcagtgagccaagatcacaccactgcactccagccttgcgacagagcgggactccatctcaaaaaataaaataaaataaatacaagaattaaccaggtgtggtgatgcaacctgtaatcccagctacttgggaggctgaggcaggagaatcgcctgaacctgggaggtggaggttgccatgagctgagatcacgcaactgcactccagcctgagtagcacagtgagatcctatctcaaaaaaaagaaaagcagtaatgaaagaggctggtctgaaggtagtgagttatttcaattgattgttcacagttacagatagcactctttgttctactccttcccccattctcactactgcacttggctagtctttaaaaaaaaagtaatgaaagataaaacattagaaaataattaaatcatttgtgttatcatcacctcgaaataacctgattgaaaatttcgtgtatttttccccccttttctatgtatgtccgtggcagacattgtcatttctgaggtccatctcttcccccaagggaatctgatgaatcctgaccagaggaatctttcctcttatagataattggttttcggagtatgcatgtaacttgggctggtcagtggtatataatggcaattttgccaaaggatttctggaaaggatacacaaagtaggaaaccatttttctgactctggacactggtgtgtgaaggagtggttcctgtaactcttggtatgaagggagccagctgacatggtgatggggccagagctgggaaggagtcggtcttgattcatgcatcatattctaaagtcaccatattaaccatccctggagctgccctctctctcaatttcatgttctaggagctagcccctgcatgtttaagccacctctatttatgatttgctgttcctggcagccaaaagcattttaattgctgcagtatatagctacataaatatattttacaaagtttattccttcatccaacaaatatttaatgaggatgccccatatgtcaggcgtgactcatgctgcagacacactgcagacacacaaagttgctctgcttttttccacttaacattttcaccagtcattgagaactctttagatacacaattttaatggctacttgatttagtcatttccccattatctgatatttaggttgctgaggattttcatcattaaaagtaaagacatggtgaacatccatgtgcataattggtcacattagtcataatttgggagacatattcctaaaagcaaaaaaaaaaaaaaaaaaaaaaaaaggataccctgatgtgattattattatttttattttttatttttattttttttgagatggagtctcgctcttgttgcccaggctagagtgcaatggcgcaatctcatttcactgcaaactccacctcccgggttcaagtgattctcctgcctcagcctccggagtagctgggattacaggcatgtgccaccaccccggctaattttgtatttttagtagaggaggggtttcttcatgttggtcaggctggtcttgaactcccgacctcaggtgatccgcccgcctcagcctcccaaagtgctgggattacaggcatgagccaccacaccgggcctgatgtgattattatgcattgtatgcctgtctcaaaatatctcatgatacacctactctgtacccataaaaatgaaaaataaaaataaatatataaataaaaacagaaaaaaagtgtctgacacatattcccaaattgctttccagacagtttataccaatttttatgtcctcgtgtagcatttgagagttgcctctgcatataagaacactcttgaaatacacaatgcttttttctaccctcaagtatttctagaaaaaaaaaacctgattaaagtctacaggacacaacaaatcaagggcataccaaatgagaggggagattgttaatgaatgaaagaggctgaagagctctgctaaatgtgggtgcagcctgttggatcttgattcatacaaatcatccgtaaaaagataattttgagaaacctgaatatggactgggtattatttgatattaaggaattagtattaatgtcattaggtatggtaatggcacagtggttatgtttgaaaaataaaggccttggcagttaaagatgtgtctttattaatcaaagaaatggtatgttatctgggattaactttacaatacaccagcaaataaaggggatgggttggggtgggatgggagaagcatggttgacagaatgttgataatttggaaaataggagtttattatactttctgctctgcctttgtgcctgtttgaaaaatatcataatacaaagcttttactttttttttttaccttaattgaattttgaaaaaaaatacgtagttgacagcatatacataaaaggctgggagactatgggcctgctcttcatgggctgagtgaagtgttctgtgggggtggactgggaccttggcagtccctagtagctttattcctagccccaaggacagcagagagcctgggattggtcccagaatctgccccagaaattacaagcacattaacagaggtctgaaatgatttaaaggaactagaccaaatcagctgtgagtttcactggcctccaagccaatctcattcgccgttggttctcgatccactcatcagctcccagactcgggctgaacaccgatcagataacttcaggcttgaagcacagggaatatattacgtattgaaaggtaccacctgtgactgtcagtttcatttgtatacctacaaaatatggggagactgaaatgcatggggcataacagcttttaaactgatgtaattatatcatttgttggaagagacatatatacattcagaaatatgttttatatgttttggtacatgaaaattttaaggttttagcttgtgatgccagccaaaccctgccccccctctccggttttggtaccaggtttggcagccactgcggtctgggtgtctgtataaagcattgaactatggacacttggctaatttccttccctccgttctgctcatggcttgtaccttgacagtgatgacaatgagctacactcagcctagtcaggtggaaaaaagcacaggcctgggagacaagatgatctaggttctgattctggttttatgactttaggcaaaccactcagcttctgtagtttttttctcatttgtcaaatgtaactagtagactaataatacccagctccccagtgtgggtgtgaggagttgctgacaagcacacaggctggcagaggaaaggcctttgataataatccctgagcccttttcctctaccaaaaaaggaccctgagggttattattcaccatctgagccatcttcaactctcagcattatggggctcaaaaaaggggagggtttctatggaaaagcctgcattattagcttacttacacacttttcagcgctgagagtagtaaaaccacctctcacacctccaactgcagacatgaggaagctgtctccctttgcttccataaataccaccatttgtaccattttctgttatttttgctgataggagagatggcagtcatccatcaaacagtagataaccaaaagtcatgattatccctcctttaacaaaattgaatatgttaaaaccaaaaaaataagatagaatctagaaatgttaaatctctggaacatgtcactagaaacctcattcactggaaaaatcagctcatcaagtgtatctgctggcatcagcacttcactgtctgtgcctatgtcactcatcccaaagtgaggctgcatttgggcccctaaacccagataactccatggtgcttctgtgttggcctttgactcactgtggcttgattttttctttttttttcagacagggtctcactctgtcaccaggctggagtgcggtggcgcaatcttggctcactacaacctccacctcccgggttcaagtgattctcctgccacagcctcccaagtagctgggactacaggcacatgccaccacgcccagctaatttttgtatttttagtggagacagggtttcaccaggttggccaggatagtcttgatctcctgacctcatgatccgcccacctcggcctcccaaactgctgggattacaggcatgagccaccatgcccagcccactgtggcttgttttgtagatagttagtctcagccttggatgctggggtcaaggactatgtctgtgtcatcttctttggccatcttagtccacatgggctgctataagaaaatactgaagactgggaggtttatccacaatagaggtttatttttcatgattctggagactgggaagtccaagatcaaggcatcagcaggttgagtatcttgcgagagccctgcttcctcatacatggcaccttcttgtgtcctcccagggaggaaggaatggatgaatcacctcttttataagagcactaatcccattcatgagagcaccacactcacctctcgcaaagacaccacctcctaataccatcactttatgggtgatggatctcaacatatgaatttggggggcacataaacactcagaccacggcagtggcccagacatgtagtgagggccttgaacttaacaggtgctcagtaaattattgctatcactttggctgggagcaaatccctagcaactcctgtagctcagctttctgagagtagaatgactaaatcacctctaaaacaggtaaggactacctgagaatgttcttttctaattgtctgaaaggaccctcccccagcccacacatctctcttcatgtttctgaaccttccctattttcattgacttcatccggcttctagaataaatggccccagacaaatgtttccccctttttctgcctgtttgctgcattcagttccctgtgtttagtaactacagaagcaatactctctggtcttgcagctttggggtctacattgagcctccactgccaagaattgctgagggactttgattttgaagagttcccagagaagagatgatggtctgattttctgtctagcatgaagggccctaagtaattctcaatggaactattccctgtccctcgatcctcccttcccaaatcatcctggcaattcctttccatcccatctagctcaaaagctatacttggtatcttcctctagtttcctgactacatgctgttaatttcttacccaaatgcagctccttgtgtgctgagaaaggaaaattgtatttagttctgaatggtaatacagtatgcacacctggatgtttgggaaaggtggccccttggcttgacttgagcagaccagcaggtcataaccccaaaagcccacacatttcaaggtctggtctgaacacttccagggtgcactgggaggcagccgttgaccgagctgtagcaacaaggaactatatcagcttggtgacaagtggggtattatcaggagggaggatcatgagagagctcttgtgatccaaacgatgggacccaagttagaaatttgaacttgaaaataaggaaaaactgggttgggtatggtggcttatgcccgtaatcccagtgctttgggaggctgaggtgggtggatcacttaagaccaggagttcgaggccagcccaggcaacaagacaagaccctcatctctacaaaaatttgaaaattagccaggcatagtgtgcacagctgcagtcccagctacttggaaggctgaggcaggaggatcacctgaacctggtagttttaggctgcagtgaggtgtgattgcaccacagtactccagcctgtgggacagagagcaagatcccatctctttaaaaaaaaaaaaaaagagagaggtttgatggtttgattttaataagaaactgactcagggaggcatgctcagtattctttttattttttaatggtgtttgtagtcagagtgactctgatgccaacccctccacccatcagccttctcatgtttactgaatcatttgcttggaaagaaccctcatccctctgatgagagtgggctgaccctcattgccctttcatgagaaatcctgaatgtatcattgctctcttttctatttctgtttttcttagtaacatccattgttctacaatatgcattcttaacggtatgcctgtgtgcacaggtagaaaggtcaggagggtggaaatgtgaacagttagaggcaaaggcaaaatgaacgttttatagtttatcaatgtatagcatccaatacttctgttattattccaaaagcatgaagtgtgtgtttgaagaattttgtttaaaagatgggtagatcttgagcaaatttctcatttctatgtatgctagaaatgcccataatcccagtgctttgggaggctgctgtttctctgcctggaacatcccgacttctccatcccaccaccaccacacacatacacccttcttgcctgcctaactcctctttagcttttgggtctccctgcttcatcttttctaagccccacttcttagatgggttcccctcttaggagttcccatagaatcctgtactccctctagcaccacacttaccacacaatatcatcatcatcttactggactagggctccatgagggcagggaccagaactgtcttttccacagttctatccccaggtcaataagtgtttgcagaataaatgaattctgatgagtctgtataagcctcttctttgtatgagcctttgcttctctctctaaacatgatctgttgagtatggttgttcaggttgtggactgtacaaggatatctagcagagaagggaaaggaggctgaaatccagcccacattcttgtcaccaagccattttttgctggctgtgtccaccatgaggatgaggtgctattctcctgatttgcacaatagcaccacacaggctttcagcagcctagctctgaacaacacttagtgtcttcaaaagcaggtgagaattctcctgctcattcctagaaagactaaggctgagtgattttatgaaactctctttaggtcctttgccagccatcaaagccaagacctagaccccattcacagcaaagatttctcttactcttctctcatttttctctcctgcagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaagattccatgagtgctcattgtggccagtggaggacaagcacctaattaaacaggcatttattggactcagagaaaaaggaaatgggaaattgaccttcacggatatgagcgtcattttggtgtcttgactggagaaacattctaggccagataatgaaatccggctttttttcctttgtgccttctgagactgtaacgattctagttttataacctccctactagattaatcatccacactaggaacaaaggctgttgaccttcatatacacaggagaatgcatttggggggatgacagcagtgttcaaaaatgatagctgttgtttttctaaggtaagagtggtgcaaacacagccctttcagaattgatgaggaaaggccgggcgcagtggttcacacctttaatcccagcacttcgggaggccaaggcaggcagatcacctgaggtcaggagttcgagaccagcctggccaacatggggaaacccccgtctctactaaaaatacagaaattagccaggcatggtggcatgtgcctgtaatcccagctactcaggaggctgaggcaagagaatcacttgaacctggaaggtggaggctgcagtgagctaagatcacgccactgcactccagtctgggcaacagagcgagactcctctcaagaaatgatgaggaaagatggccaccgtaaagaagacaaagctgaaaacctatgcctcgtgaaactgaaatgttgagcagagaacattagagctggtggaggaccccttagaaaccatctcatccagcctccttgtttttgacaccaagaaacaggcacagggtttgtcccttgtctgaggccttaggggtggatagtgtacagctggggaaggaacctagggctcctgatggtgaagtccaggctgttgtcccctactccacacaaccttgccccgttcctcaacaggtccctcttcaggctcagttgcctttccttccagctcgcaaacccagatattttctttacagtaccagaagtgcctgatagaagttcgacaagcagcaacactgggctttgaatttagtgctgcacggctccaaagtcagagatcttaaagtattctctatatcactcttaaagggaaagcatcctggagctactgcaaaatgcttgttaggaacctgtgaccccaaacagagcttctcatgggctctgtaccgtaccaggtgctgtggggatggaaagaggagcacctatgggattccttgatctccatatttctagtacatgggttggagtaaagcaagtggttgcatctccaacacaggttcctggaggccctgatggtgtgctggaggccaaggaacatcagcatacccaaggctcatcttcctagagggtcagttgtactaagcaatttttgcagagagatgttatatcaaaacacatgactttctttaaataagatccaaaatgggcataaacttttttttttttttttgtggggggacagggtctcgctctattgcccaggctggaatgcagtggagcaatcttggctcactgtaaccttcgcctcctgggctccagcagtcctcccacctcagcctcccaggtagtataagcaagttgtttagtaaaaggaggtgttaaagacatgctagcatcaagcagagactttctctgtgatgtaaccaaaaggactggaagagtcttgcaaaggcaataaatttctcactgtgtgattaattaattccacacttgagggcccctaaaatcatctcatgttctacccaaatcattggtacacatcccacatgtggggcaacaacattcaaatcacaaaataccccagagaaagcacagtttctgaggtctggccaaccacatagtgaagaacagttcttggcgtcaacatacttggtttgaacaccagtcctgatagttccaatgtgggagaggttgggcaagtgtgtcaacctcattgtgccccatgtggaaatggtaacaacactggctacctcgcaaagctgtggagagggtcaaatgagatgagcctcaggggaggctttgtgaacccccaggaaaggcacagactgtgggcactgatgggccacatgccggggcgacggggggatgctgcatccagcagtgaaagtcttcgttttgttcttgcacctggtatctaacactagccacatggtttcaaggatggctcttgattattaaatggtgccactcctggtgatacagttataccaaaccacaaactgcgaagtatttctttctcttccactgggtctttttatttcaatatcagctgaggctattgaaccatttgacatagtaaaatgttttggaaaggctgtagtaatatcctgtatcttactagcatttttacggtttttaagtcttacctgttcataattataatattttgaccttcataaccacattgtagatttctagcctagaagtaggcagggcacttatcttcaaactgcccttgatcttttccagaataagagggataaataattattttatgtatgagttgactgggattcagattgacagtggttctagaataagctttgaaattatttactgtggtgttttactggtaattttctatttccctgatttcttctgcatttattaattggaattcttctgtgtggaagagatttttccttctctattgttttaaaacgttaaagaactttcttcaacatttctcatagagtacgttttctggcagtgagttccctcagtttttgtttgtctgagaaggcctttgtttcttctctatttttgaaaggtgtttttgatggatatagaattttgtattgacaggcattttgtaaaaataagcactttaatgatgtcacaccagtgtcttctgacttgtatggtttcatatgagaggtcggctgtaactcctttcttgttcctgtgaatgtaatattccttttttctctggctgccttcaagattttgtcttttgttttctgcagtttgaatatagtatgtctagatgggtgtgtgtgtgtgtgtgtgtgtgcatattgtaaaaccaaagtaataattgccacaagcaagatccactgatggatgctaaaattaagggtgtagaagtttaagccaaaagggatatttgcagtctcaaaggatctcgaccaaaatagttggtaattacaaagagaaaaatagtaactttacagtggagaattctggcagatatcaaattaatcaagtgaccagagttaacctcgccattagcacctacccatcatgcaccacctgatttgatgcattgagaaggcccagcatctctgtggagtccttcacaagaacttcaatctaatcacggaaaaacacctgacaaaccccgaatcgaggggcattctacaaagcaatcaatactctcttcaaaaatctcaacataggagatataagtaaagcctgatgaactgctatagattggaggagactgaggaggcccgataaatgaggcgggggcaccacaggccttaatcatcagcatattccatctggattttttaaatggaatccgacagctcattgactcattttcttaacatggtgtctgggattcagtcccaatacagacaacttgcatgttgcaaagaaaatccacttgatgactgtaattacccaaacttctgactcacctttttcactaccttaaaacatggcttttgccactaaccaaacacaattctgtccctgagctaaagagccagctccagagggtgaaccaagctggggttggggaggaggtcaggcctctttccacacagttctgggtttattttccatgaagccttcttcttcattcaagaagaaagtggccttcatccaaggccattcctatcccaatgactgcaatcacaccctgagagaggcaagcccttctgagactatctgatacgcttgctgtccacagaaattgcttggaggatttcaggagcagctcctttgctgccatcacaggagtttggggacatagaggacatctactacctggagagggtgaggaagcagaaatcttgtgagtggccacatctcagcctgcccaaagggtgtgtaatcccagcaggttaattttctagaacccaagaagcaggatgcattacaggccctctgttttcctctgggagcttttacaaggccaaaacatctgactgaaacgattacaggctcagcagctccctgattacactctatcctggagctcagaacccatttctataggacccatgactggatagtctagcaaacactcccccagaaatgtacccccaacccatcaactgatgatgggatacatgagaagggcattacttagcatttgctggcacacgaatataccacgggtagggaggtggtgagaaggagaatggagatagttattttaactctccctttctttttggggaaagaaatgattttttttaagtcaagttactggagaaaagtaacacctgcctccaagtctaagttaaaggtcacagaacatctgaatcacatttccttttcttctccttttccttcaccaccatgagggccttctggaaggttctcctccattctggggctattcgatactccctttcccaaatctcctgcatgcccatttctggctatggggccccttgtgtccttgattgggaggcatttgaggtcagtgcttagggggtttcttgatgcaaagtcttcagagcctggggcgccatctaattccctctgaatgagaagctctataggtaggcctggaactctgcatttctagagaacttcagaggtgttctgagagggagctgctggcccgcctcattcagcatcatcagtctggatccgggccctgcttttggctctggcctgttcttgccactggcaaaggtttcagtctgggtccttttgaatgagttgcctgagttgtgttgagagatccggtcaccatctccatgcacttgccccacccctacaggctgcctagtttggggcctgctcatcctcgtatggcctctgtgttacaaattccaacacctttggcctaactctcctccatttagggtctgtgcaggagcctgtcccactagtgcccaattctcaaacactgtcccctcccctgtgaacccaagcatcatctaattttgctcaggctggaagctgctcatgttgtcaatgctaaacaagaaagggtccctggagctggccagagccaagagtatatggatgggctgagctgaaaaaagcagactgaactctgacggaagcatgacatcaatggactgacacagctaatctgcagaaagaggagaggatggaggcgagtgggggcagtgtgaagtcaagggctcatggtagaggaggaaggggcagactcagggaaagtttgggcccccgtgacttccagtgctggcctatggctggcagccccgacacacagggcaagtaggaccaaccacatgagccacaccaggtggaacgatgccaacttatcgggccactgggcacaccctgcttctattgtctgtcaacctaacaaaacaccctttgccactttcttaagtccctggctcctggacaatcacctgggcctgccctatgctctctgggtaaacactttgccagcctcccagcatcagagatcatgccactgtctccaagaacctgccccacctctaagggctgcctagtctggggcccacgcctcctgttctagtctgctgtgttacaaattccaacaccttcagcgtagctgtccctccttgcaggagcaaggagaggggtccggagccaacagacagcctcagtcagtcgtttgtcattcttagggcctctctgtgccaggcactggaaaagtggtgaataaaacagacccaggagcaatcctgtcctcaggcagcctggagtgtcgtgagagggcagcaacggaccatgtaaatgaatatggaacttctgcccctaaccagtgctgggaacaaaaacgacgtgggagccaggtcaggcatctggcatcagggaagaggaatggtttctgctgagctggtcagaagcccaagggacaaacataatctgggggacttaatctaggcccatcacttagattaaaggagtgatgggcctcactggggtcttcatgggctggactggattcccagctgggccacctgagaaccctggccttgaaacctacccaactaaggcactgggtgtatttgtccattttgcgttgcttataaatcacctgagactgggtgatatataagaaaaaaggttgatatggctcactgttctgcagactgtacaagaagcatggtgccagcatctgcttctggtgaggcttcaggaagctttcattcatgatggaagagaaaggggagcatgcgtgtcacatggtgagagaggcagcaagccagcgggagtggggggcaggaggtcccagactccttaacaaccagatctcatgtgaactaacagagtgagatctcattcattactgtgaggatgaggatggcatcaagacattcatgatggaaccacccccatgacccagacaccccccattaggctccacctgcaacactggagatcagctttcatctggagatttggaagtgacaaatattcacactatatcacgggacaaaaggctcaggtcatcctgaaaaaaatccttcaagcagaggacaggggcaggacaggctttggacaggtaggacgggcagatccaaattagactcctggttcccactgggagggcttggaaaagtggcccctgctctctgagcttcagtttcaccatctatgaaaatagaactgcacaaggatgacacaccaattcatgaggcgttccataagaaaagaaagacccaaggaagatgcacccattctaaccagaaagatgcactccagccgggcaagatgtctcacgcctggaatcccaacagtttgggaggccgaggtgggcaaatcgcttgagcccaggagttcaagaccagcctaggcaacatagcacaaccccatctctacaaaaaaaatacaaaaattagtcaagtgtggtggtggcaactgtagtctcagctgcccaggaggctgaggtgggaggctcacctgaggccgggaggtcgaggctgcggtgagctgtgatcatgccactgcactccagcctgggcaacacagtgagactttgtctcaaacaaaacaaaacaaaaaaagacacattccttaggaagcctgctgggaaccccttatgcatggactgactctccaccccacgtgtcctaatggttgcaaggggtggcacatgactctccaaatcagggcaacttgtccaccaggcactgctagcactatgccctgggcccacaaaaccagtaggggcctgcaaaaatgctttaacctttttcaaatcagaagagcagcctggatgtggtggctcatacctataattccagcactttgggaggcccaggcaggcaaatcgcttgagctcacaagtttgagaccagcctgggcaacatggtgaaactccatctctacaaaaaatacacaaattagctggacgtggtagtgcatacctgtagtcccagctactcaaaaggctgaggtgggagaatggtttgagcctgggaggcagcggtttcagtgagccgagatggcaccaccgcattccagcctgggagatagagccagaacctgtctcaaaaatttaaaaatttaaaaataaataaatcagaagaccacaagaatatgatctgcccttgataatatttctctttctaccaatacaatcagaaaatataattgtaatatgttttatagagaaaagagaccacaaaaatcataccacggctctgctcaaagcgcaggtaattgaaacttcacttttagtgatttctgcattaaatgcaggtccctgagggtctggggcttccatgctccctcggggtaaatgtctgtcagccagtgttcctaataacagtggaaacagccagagagggcagggcacggtggctcacacctgtaatcccagcactttgggaggctgaggctggcagatcacataagatcaggagtttgagaccagcctggccaacatgaaacccatctctactaaaaatacaaaaatgagcggggcatggtggcgcatgcctgtcccagctattcgggaagctgaggcgggagaatcccttgaacccaggaggcggaggttgtggtgagccgagatcgctccactgcactccagcctgggtgacctctagggggcagtgttaaaggaggtaaggagtggctgaaggtagagtccacgatgttgctaagggttggacttgaccttaagcacacttgttctattagctccactggaactgccctcagtccatgctaattggattaatagtaaatagcataaatacgtgggcaaacaggttagtttgaaatcataaatgaaattaaatgcacagagccctaatctctggagaaagaggcaagattgtaatcagtggagtacggccaggcatcccccaccttcagggggctcactgcctagagagagagatgcagaaggaaacaaataatcacaaactaatattacactaaagggacagtgagaatacagaagaggaaaaagttatgcctcaaagagtcagggatgatttcatgaagaggctacatttacaatgggtcttgatagatgtgtagaaatttgccagatgaagaatcaatgtgagaaaatgaaagaacatgacatttggagtcaagcagaccaatgctccaatcccagccttgttcttttctattgatgtaaccagagacaagttatctcgcctctctgagattcagtttacttatccataagatacctaccctttggagttccttagaggattaaaggcaataatatacatacaatacctggcacctgataggctttttgtaaatagtagctactaaaaggagaagatgtgttcgaagctgagggtttgtacaaaggtgtgttgcaagcatgagtcacacaaagattggggagagggtgggccggaagcgtgggagtccagagaacctggatctgaatctcttgcagtccttgatgtatcagctgtgtggccctaggtgagttatttagcttctctgcaactgtaaaatggggtaatgacggcacagccttggagagctattatgttgggacaatgagttagtgcaagtaaaatgcccagcgcagagtgagccatcagcaaatgtcagctattactgctgtttcatcatcaccattgcttttttgtcatcattggaaacaggaagtgagggaatgggctgagaatgaacagatcgtatctggccctccactgatcttaatatgatatattgattggtttatcatcccttcattgtctctccctattagaatataaccatctccaatgagatgggctcgttgtcttgttcactgctctatgcccagtatctagcagagcacctgatgcataggacagttggccctccatatccatgggttctgcatccacagattcaaccatcctctcattgaaaatatccaggttccggtgcgatggctcacagcactttgggaggccaaggcaggcggctaacttgagtccaggagctcaagaccagcctgggcaacacggtaaaactctgtctctacaaaaatatgcaaaacaataattagccaggcatggtggtgcgtgcatgtagtcccagccactggagaggctgaggtgggaagatcacccaagcccaggaagtcaaggctgcagtgagctgagctgtgatcacaccactgcactccagcatggctgacagagtgagaccctgtctcaaaagaaaatattcagaaaaacaattctacgaagttccaaaaagcaaaatttggatttgctatgcactgagtgcattgaatctatgtaaatgaagtgatgtgtaagcattgtattaggtattaaaagtaatctagagatgatttaa

SEQ ID NO: 131 - DNA, 2523 bp, Homo sapiens
gcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 132 - protein, 406 aa, Homo sapiens
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 133 - DNA, 89756 bp, Mus musculus
  misc_feature (1)...(89756): n = A,T,C or G
ccacacatgcacgtgaacatggacatgcaaactaaaggtaaaacaaaattttaattaaagataaattattcttcacaaacgtcaaactaaagactgaacttccacaaacctgtactcaggattaaacattcgatttaattttttccccactaattgttggtaggcttttgaagtcattccttattctccagctttcatgttttctgacagcatcgaaggtcttccttttacacagaggcaagttcaggtcaggatccacatgctgtgtttctgtggctgccccctctgccttggcttttagttcagttcactgtcgcgccccctccttgctctcccagggtcccacagacattccttctcagactccctggccaactgagtctcacttcaatctccgttcctgtgggtggtctggctcctgggttctgtggcactgtctacagccgtccctctagaccctgggcagtggctgcctggtgtggcctgactgttggctttagcattcattccatttggctttctagctctttcaacgcttgaactagctcccagcctgcagtgcccccaaatgctggttgttttcttcctggatagtttagatggttgcaggctcacccccacctccgtatttttcatgtcttcacttttcctcccacctgttttggttttagggtactgacttttttttttttttgtaatatatttttttacatagtcttaaaatttttaaggtctgactgggctatagagacagagtcttgttatgtaactcaggctagcttttaattcaccctgtagcccaggctggccctgaatgcattatctccctatctggtctctggagccctgggtggtgtgtgcattatacctgacttgaggtttcattttgtttgtgacttttgtccttttttaaaaaacaaactaaccaaccaaccaaccaaccaaccaaccaaccaaccagggtctcattatgtagagttggctcccccggaacttgttatatggaccagactagtcttgagctcagaagtcagcttgcctctatctcatcaacaccagactgaaggtgtgcaccaccacatcttttgggattgaggtggaggctccatttttctatgggagaacgctctttatctgactctctcttgctcttgtgtgtgtcaggggtggggtggggatggagttagggctgagagtctctctctacgttagtttttgagacagagtagctagatcactgagcctagagctcattggttcagagatttccaggaaagcgtccatccccagcacccagcacgaaggctccagatgtgggccgactcaccaggccttagtgtgggtcctggaggttcaaactcaggtcctcgtgctggtgaggcaaggaatttatttatagcactttccctggcccacaagtaacttaaaaataaatatgccttttgagccaggcagagctcactctgtagcccaggatggcatggaaatccccatgtaagcccaggctggccatgagctccatggaggcagcatacagcctcagcctcttgaaggatggaattgcacatctgagctgtcatccctggattatcacgggtactttcaattgttttctttgtgttatttctagcatagcaaattgatcatcaggtgaaggctaaagccatgctgagagtcaggaaagctaccagccacatatggctattaaacgaaaacttaaattagtttgagtgaaatccaaatttcagaacatttaaaaacaaacaaaaaacaaacaaacatgtagttgctgagaaattaggacgacctggactatcagttaaaatggagattccttggttacacccctgcaaccacaggataatcacagtatggttaaggcttggaggacataaagacagcgggtgtgtcataagactgttgcttatgagtgaggagagccatggtaaacaccttcacaaatgtgctgtaattgccaggacggagccagggctcgtgagggaggctgtctggaccagccggaggtgcctgtgactaatggggagatggtgcccactagaagagaactcagtttatgacctaaaacttgctgattgggacaaggcatgcaaatctgggatggtcttcagcccactgagaatgagaaaaataaattaaagagcctgtgcttcccacctgtggtgctgaaagccctcccctgcggaacatggggatgccatatataatcgttggcatacagttttaattatttgtcaaaaataagaaataatattgtccatatgagtattcatacctgcgtgttattgtgtgcatgcacatgcaggtgagtatatatatatgtgtatgtggttgtgcaatgcatgtacaggtgtgtgtgtgtgtgtgtgtgtgtgtggttgtgttatgcacatgcatgtgaatgtgcacatgcacacatgtatgtttgggggcagagtttaactctgggtatcctctctagtgctgtttcctttcggaggcagggtctcttaccgaacctggagctcactagactggatggctagcaagccccaacattctcctgtttctgacttggcagttggggttgcagtgctcactgccgtgcccggatttttacctgggtgctggtgattgaactcagctactcatgtatgaccgacgaacggaaccatctcctcatgccccacctcagttgttgctgttggtttgtttggtacagggtctgtctgtggccctggctgcccagaaacttgatacgtagaccaggctggctttgaactcacagagttccacctgcctctcccccaccagtgttaggatcaaaggtgtgcactaccatgcttggcccagttttttaggttttccttttaataagaagctgatcttactgggctgctaaagaagctaggagctactcatatggttcatttcatgtgaattataggtaggcagtgaggtcatttgaacatcacaccatttaaaagttaaatgtgtcaaactcccaaacttgaattcatattctatcagaagacaaataaacaagaatgaaataggcacaatggcaaatggaaacatgaccgtagctaatcctgagcctgagtctggagctccatgaaggcttctttatttgttttacagaactatatgttaaaaccacagtctgtgaaacaaggcagggaaagcccagacatttctatggtttgctgaattaccccgaaattccaggcatgtgcagaacatcccagcatcctgctcatgtttaccatgctggagcttctagatacaataaatagattcaacacacacatgtcacacacacacacacacacacacacacacacacacacacacacacacacacatacatttacacacacgatcacacatacacatacatacacatatatacatacatacattcatacagacagacagacagacagacagacccccccacatacacacacgttgtctcacacacacatccacatttgcacacacattcacaagacacatatacacatatatgcacacatatacatacatacatacacacacacacatacatttacacacacgttcacacatacacatacatacacatatatacatacatacattcatacagacagacagacagacagaaccccccacacatacacacacgttctgtctcacacacacatccacatttgcacacacattcacaagacacatatacacatatatgcacacatatacatacatacacacacacacacacacgcaaagcccacaagcactgataagagaaggaaccctggagcagaaggtaggagaacctgtctctgactgcgttgtctttgtggtttgggatagcttatctcctctgaagcagtttctacatttcttttggtgctggtctcttgtgtaaaatatcctctcaaaagcctgagacctggacatctctacctgaactttcaaccaaccagtgcccatgctttaaaaaaaaaatgcagggactggagatgtggctcagtggttaaggacctttgcttgggcagagtttgggtctaagcacccatatcaggctcttcaccagtgtctgtaactccggctccaggggatctgaccccctcttctggtctctgaggacaccaggcacacatggtgcacagatatacatgcaggcaaagcactcacacacattaaataaataaataaataaataaataaataaatagggagaaagagagagctgtgtgtattggtgcctgataggcactatctttgaatactgttaactttttgccccattttactgcagaaagctgaagtttgatgaacttaaaagaactgccttggagtctcacagagaataactgatgaacaagacaaagcagttggtctgacttggagagcctgtgcactcatatgtgctcctaggaagcactgggatgaatgaatggatggatgagagtgagtgagtgagtgagtgagtgagtgagtgagtgagttagtgggtcgacagctccatgagggaatccatgaagcttctcatggagggtgttgaaaaagtcttagtaaatggataaccgtatcacattcctggttaggaggcctctgtgtgcagcaactgacaattcaccccaaaagactaaaaggtttttaaaaggtttaacagaactctaacattgaatagggtgttttggaaagaggactaaatacctgtagacaacttgctgtgttctcctaaacagggcagtgctcaggagcaaagagtaatcagaaaacagtgtctcattaagacggtttttttaaggatttatttcatgtgtatgagcatttgcctgaatgtatgtctgtacatccctgccatgcctggttgtgtggaggccagaagagggcactttatctcctgaagctggagacggttataagctacctgtagatgctgggaactgaacctgggtcttctgcaagagcaacaagtcgcttctcatttggaagaggcagtaaataaagctggcacactgactggtccggtggccaggctgtacctctttaccaggttccgagagaatgcctgttagggcacggtaaggataactgattgacagcactgcttccacggagatgccattcctatgttgaataccattaagttccaggagagctggggattacaggcaacgtgaagctatggggtggagaaatagctcagcagttcagaggccacattgctttcacagacctgagtgtgattcctaaccacctccatcgccacacatccagcccttctgacctccacaggcactccctcatgtgcacacacatagaggcacacaattgctggctcaggttcacttctgctcttggggtgtcctggcacctgttgcacactgagcagaatggaagaaatggagtgttgccgggtgggtgggttccatagaaccttggttggagttgagtgtggtgagaaacagctttctctgagacaggtttcagtgaaaagctacccccaccccacccctgcctcagtattggtgaacaagagctatataaaccttgggcagtggcaggggttttctagatgcgtgtacatcattggctaaggatgaggcgttggggaatgttaaaaggaatcccaggtgttccctggacatgtccttataggatagaggaagtttaacctgtaattaggccaccaggctctgtgacaacctcaagggtgatggaggagggggacgcgaggctacctgggctggggcatgcagacttggagcaaggagaacagtccaactcctgctggtctccagacaaggttttcagggtttggacatgtctcaaacccacttttgctctggactagctccccttgtcacatggctttctggcctcacacataattaaaaatatatagatagagaaataaaaatggaactatgtgtgttgtgtaaggccaccctgctaatttggcctagccacaggctttggcacggatatcttgagttataactaggaataggtaccctactcagtagcccgttattccactaagtagctaagctagcgtttggaagagatgaaatctttccctacatacagcttgcttttccaagaaatacctttgggacaaagggctattacagatctatttttatacacttctttccttaattaactcagtaatttgcgtgcatatatgtgggcaaacccatgccaggacgtgcttggagcttggagaagtgtcctatctctcttcctaccacatgagtctgggaatcaaattttggtcatcaggcttggtagcttttgctggctgagctatctcagacaaatagctgaacttctcgaagaaagccgactttggttaaccctaggccttgagcagctagaccagcattttaccattgcttttcatcctttcccagagcttcgtttcttcatctgcaagatggaagctcacttcaagctggtgttgtggattagagaaagggagcaggcactagggagacaagcgacagatattcagtaagctccctttttggtggaattcatttttactgggggaggggaaacaacgatttaatactaacagtaatctatatcatcaaatgtataactccgagtttccccaaacttgccatgccacttgacagaaagaacgttactcatttgtcttgtagcctcaccatggcaaacaaattgggcttgggtgaaactaggaagggccccttctgtagacggcaggcaacgtcttctgtttaggccacagcttatgtttggtgaagtcattttatatttaggatggtatttgactctggcggtgggagggggaacagtgtgggggtccctactttgcaagtgaaaaagaaaaacacctagttaagggagtgatctgagaggccagcaagggtcacactaaaggacctaatttccttgtctgtctgtctgtctgtctccctctagtatttgaaagaagaacaagctttccctctgtagcccatgatggcctgaaattcgaggtatagcccaggcaccaactctcagcggtcctcttgctcagccttctaaattctgggattttgggtgtgagccactgcacccacatcctctttttatttttaaaaatagcttttggtgaccaggaaatgctggcgctaatgccttttgatgttatcagatgtttgacagaatctctcacaggctgtgcaccagatgactagatttggaagggcaaagcttgtaaggtagaagggtgtggcctgtcagggactgctggggagtcggggatacaaggaagctgagataagaaggtggtggtattcagagtcctgcactggcagcagccccaagctgtggagaaagagaaggggtggggcaataagacagagcactgccctcgactctggatctcgacctttgacaggtcacaaggagctgatcatggcaaataagttgcctcaggcagatgtagggttcacatctgggggccacacttggtgctcttttgataacagaatttgtaaaggaagtgtttgaataacatatgaaaatgtaataaggacacatgtaaaactctggatagttaaaaatagcaggtggaggagcgctgtcaggcagctgggtggcacactttggtaggaaggaagcaggaggtggatgcagcctgaggagaagatagacaaggctgcctccgggtcatgtgatgatcagctgaaagaactcaggctgcgggctggggatgtagctcagtggtagagctcttccctagcatgttcaagcaatcacttacacactgaggataaagtggaggctggacaccaaagtcagtagcgggcccgttcttatacacccacgacactgttaacttataaactgtgtgcagggagagattaacaacactaatgcactaacagcatgcttcacagatagctccataacccatttctctttattactgattaatcattccattcgcttacatctcaaatgatatcccacttcccggctacccctccacaagtcccccatccctcaacctccctcttctccctccctttgcctctatgagggtgctcccccccatcctctccctcctcacccctccagcatccccctacactggggcatcaaacatccacaggacaaggacctcccttcccattgatgccagataggacaatcctccgctacctatgtatctggagccacggatccctctctgtacactccttggttggtggtttagtccctgagagcactgggtggtccagccagctgatgttgttcttcctatggggttgcaatcccccttagctcctccagtccttcccacctgggtacctgatgtacaacacacttaaggtttgattgatgttcaacccacttaacgtcttgtacttttacaaagttctagacatttatttatttatttctatttttaaaggttttttttgaagttttaattttatgtatatgggtattttgcctgcatgtatgtcagaagagggaatcaggtcccctagaactgaagtcatcagcaggtttgagccaccttgtgggtgctgggaatttgaacccaggtcctcagcaagagcagccaatgctcttagccatctctccagcccctacaatcatagtttttatattaatctaataaaattggtctatgtgactaccaagattctattagaactataaagtatattagaaagcctgcaatatcagtgtgtgaggagcctcttcagcattttaaaacatgttatagcacaacatcatgaaactcaagtctatgttccttactgtacgaagtgccttggccagaaattacatcaggtacttgagaggttcttttgtactccctcccagtcactgccgactttgagctttagacagagcagcaggccagggtgcacacttagaggtctagctattttgatgggttactctcatttatttcccaatctgaaattctctttatttcgcccctttagtgcagaactggtggacttgaagggtttttataatcctagctactagaacaatggacgggaggtactatctcatgaaggagatgaacctaaatgtagtttattcttagccatttcatacgcccatagtaaataaatcaggtcagttgacctctgagcttcagcggaatcaacagcagtctggctgctctagttcagtctaacgagattttagagtaagagtccgtttccttaaaacagtgttagaaaagaataggatgtaggcttcagagactcgctggcatctctgagagccatgaggcagtggggaagtcactcgaccccttttattcccacctccaaggaaactgaaccagtttctactgtacagaggcatatgggggggggggggactctgcccctttgctttctgaactgtaggtcgggcagttgagggtccgagagaaggttcaggcaaggaaggtcttgcggtgtagcagtctggtcgtcgtgtcttttggagagcagtgtctttggcacttttgcacttgatagagggttccaaagctatgaaacgaaagggagtggggcggggcttccagggcccaagtgtagcccaccattctttaggcttttcgctgttgacttttacaaatcacctttctactttgaaggccagaaacagcaacagcagcagcaacaacaacaacaagctaaggataacgaggtgagggcggccaaggagagttctcagccattgcttgctcttcctggtccgcccttacccccacatcccagcttaggggtaccacgcttgttccagcccgtgatttaagcctcgggttcccaattgctcacgcgtctttcgtccgtgaagccgccttggtgtgagttcaagttcgtgctgccacagagcctgatgacacgccccctcgcacgcgccccgctccgccctggggaggccgggcgccccccagccccgcgctctgacgggctcccctcccagcgccgagcacttggccctggcagacgccccaagattgttgtgaggagtctagccagttggtgagcgctgtaatctgaaccagctgtgtccagaccgaggccccatttgcattgtttaacatacttagaaaatgaagtgttcatttttaacattcctcctccaattggcttaatgctgaattactgaagggggttaagcgaaaccaggtgccggcggcgagggctctgcagtggctcccagcacccggcactgtcccggccctccgcgctgcccgctcggcccctccggaaccaagccgccccagtcccaccgcagagcctgccttcctcgcgtcgcttctcctcccgcgcatcttggatatgccaggattaaaaaggtaggttggaaggcgccaggaactgtctccaggcttgagaaacctaactccagacctgatgggtggaaaatagctatggctgagattccgcctgtgtcagggcactggaaaagacttttagctagtgatgcaatgaccctgttaattacaaaaagctgcgcccatctcaaagtcttcgtttgggagtggggatttttctaacagcgtcaggagtcagcatctcgagagaggcagcagacaacctctctaggtcatttctctttctttttggaaagggcagcaacgttgtgcgcagtttataaactatcacactacatgttttttaaatttgggagactgctgactacggcaccagcaattgctttgctgcaacggctgtgagacaagcagaagtctccgaacacttctgtctgcgtttgctctatgtgtgtgatttacagagggaatgggacctagaagtttcgagccaatgcacagtggactctgcagacagagacgcatgtaagcaaatgttttgctgttctttgcggaaattgcaattccagtcaagtaatccttgagccttgaggaagtttaaggatgacatctgttctccctttctccagtgtctcttgaaaatatagctgccctgcatagatctacacactttctctgtgtgtgtttgcatgtgggaggggtgcatgcatgcgaatacaaaccgagcctcattatggtaagccatagttaatattaccatcccacatctctgaccagcaatgtctgtcactgacagacagttggagggtctgtcctcctcctcctcctcttttggatggtggacccagattcaaaagaaaagggttgagacagttttctcctccccagtattaattatacttcaattttggtacgatttctttctggaaagcttctctgttagcctagagattatttggcccccaggacccagccatagctcttccaggaggctgggcttggagctggccagccctggtctggctttcgccaaaaggaatggggagtggggtagggggagaagccggtagggttagcatgccttttccagtctctctcaaactgtactgcatacagtcaagctgctctgtctccaacataaacgagacgggattttataaccacctgaaaggaaacttcatgagaagaaacaggaaaacattgaaattcataatctacagactggaaaataaatttgttattgttctcttattccttccagatataaagtctggctcttgcaaatataaaaaaaagcccagggatttggctctgcactttataaggtcagagctgtctccagtgttggagaacctggctcacataggcagttagatgaaatggaaacctgtctactcaggattggatctgggactccgtgaaggaagtgggtttgcatcttccagtaccacatcgggctcagttttgcctgggtgcctgggtgctaccttccctctgtgtcctctacatacctactgctatttctcctgcgctgtgggtcagggatgtgaatgagcttggaatctcttgagcactcattctgaaaaggccctggggactacagagtcatggtgctaggtgggtaatgataagcctcaggctccaaccaggtccccaggctcatagccatgctgagaaacagtcaagatcgcccccttcaggaagctttctctgttgactcttgacattcttatcaaagcgaatctacactcccggcccatgccacaaagcagccagctcaggtggctggcagctgggtcacagctctgtggctctcctgcccagtatctaggctgcaagctgtagttgcttggatagatgctagtgacctggagagtgtggttacagactggatcatcagcacaggcttcacgttgtcttccatctttcctgctctaggtgcccaggtcagtagtgttgcatctgctcatttggctatatacctaggctccatgactctttaacctgcaaaacagctcttgtaccatactccatgttgtatggtgcacacctgtaaccccagcatttgaggggtagaggcaggagaatcaagagttctgagctaagtttgctagtttgaggctagcctggactacatgaggccccgtcttaaataaaacaacaaaacaaaacaaagcaaaaaggttggctaaaatgtctgtcttggaatcccagtactcaggaagccgaggtacaattgccacaagtctgaggacaacctgggccatattgtaagttgcaggttagcctgggctacagaatgagaccttgtttcgaaaaagaaaaactaaaaaaccaaaaaaccaaaaaatacacccaagccaccaaaaaaaaaaaaaaattacagaaattctgtacctgttaaacaccccctccctgcccagaagctcacaactcccagaaccaccatttttctttctgagtctgaaaactgtggggtacctgatctaagttgaaatctatgtgtttgtgtgtgtgtgactcatctcactatgacaccccgtggatcaccagtgctattgctcttattttgttttgttttgttatattttaattacatttatttactgacgtgggagagcatgcggtgctgtccactaatggcggccagaggacaactttgaaaagctggttctctctttctgctttattaccaggctgactttgaactcctgagttccagtgacctttgcactttaacctttgggagcagctaggattacaagcacatagcaatgtgtctagctttccacattgtatcgtgtccaacttttgagtttaagtctgaataatattgttggtgtgtgtgtgtgtgtgtgtgtgtgtgtgtgtgtgatgtgtgtgagagaggagggggacacattttgtttagctattcatacacgaacatttggattgtacccaccttttggttatcgtaaaaaaaaaaatgcggctatgagcatgcctgtgcatatatacttatgtctggtctttgactcagttccccggggagtgcactctggagtgggtctgctggatcgcaggtgaggacaccacacagctgcatcagttttacctccagtagtgcaccggagctgtggtctctctacattcttcctagacctgctgttttctgtcttgcatttttctaagatgaagaatttatttaatgtgtatgagtgtttgcttgctctgggtacaagtgagtgaccctgcttcgatgtataaggtaaagaatgactgaggagcatacttgctgccaacctctggcccccataggaatacacagacatgtaaatatgcacttacacacatgctccaacatgttcaacacacaggtccatgcatgctgcacaaatagccatcttaatggatgtgagtggtatagacttcgcagttttaaagcatactggtgaccacagtttcaccagacaaaacgttggccacagcaaagaaccaaatcacccacaggcaaagatatttacttgcttgtgggtggccacgttggctgggccagggtgttaaggcatttcctgctgttacccactgcctttctcacactggctcctcagacttccatcccctgggatggcagttctcacgagccacgtgctagggtggaccctgggttcttggaccattcaagcccaggttctcacatgtgtggactgagggctccacgttctggttaagtgacttcctgcaaacacagagcctctcacattcttgctttcatggattgaagacacagaggctcttggctctgcagtcaggtcagaataatgtttgactcaggtggtctctgtgcagaatgataaaagaccaagacaactggttgatgccacagactgtgggtctttggatttttgtccctaagcagcaaaacatgtgacctaactcactatcccaacacatgaagcaagtgtgaggaggctgcctcttgtggggttagagtagagggctggaagcgctcttgggctctgctgagtgtgccctattcgcttgcaagcatatggtaaaaccaccaactaaatgccaggtagcaggaggtccaggtttcctggccatgagcatcccttggcactcactctgattttcactgcccacaggatactcactgttaccatcttggcactctggcttccacatcctgggaatgcacaggtaaggcttcaagttgtccaggagcatgtcacaaagctaggggagagtgtccagccatgcattttagggtcccagggttatgggaatgggaggtactctgcagttcacttactaccctccatacaaacatatcatagtgaaggctctaagagatggaggttggcccagggtgatataggtttcaagtggcaaggttggaattggatctcagcatcctggctccaaaccttggtgtccctcagggaaactcactaacttaaatggtagttcaatgtggtgcttctggtcagggagttctccacccaggatgcttacaaaaggcccccacggctaggtcagtgtgtgtttacagccatacaatgcccagtgaaagagataggaaggagaaggttggttatctggagctgggggggggggcgtggggggtatccattcacctgggaggagtgtgcaaggggcaatatctcatttttaaagttatagggagggttgtgctaggtgtgtcagccccaagtaatatggtagggttcctctagattggtggttctcaacctgtggattgcaaccagttctcaatccctttgtgggtggggtcgaacaaccctttcacaggggtcacctaagactatcagaaagcacagatttttacatcacaatacacaccagtggcaaaatgatagttatgaagtagcaatgaagtaattttatggttgggggtcactacaacatgaggaactttattaaagggtcgcagcgttacaaaggctgagaaacactgttctagatggctcagagaggcccttctgtgtggcccttctcatggagagaaaataaagacagcctcatttctgagtaaggccgagggctgcaggtgagaaagggtaggcgcctgcccatcatgcataaggctataagtttcatacctagcactgagaaaactatgctggggtggaacagggggaagagctgtgaagtacgtccaaaggccattagacacactcagaccattggagacaggaaggatttgagaggaatgtataagaattttagatctcagagggaccttggcatcctgtaatctagtcccaagagttatagacaaagacatctagtcctgaagcagatagtggtcatagataaaggtaattagtataggcatttatagtaacatagttcctctttgtaactacttaaaactaagtaacagtaccccattttatagatagagaaactgaggcaaagggaaggatgaggagaagtaaggactctagtgagaattagaaaccaggtaaacaagtggcttgagcccattctgtcccagcactgaggtcgagaacaggactgaaacctgatctcctggggtctgtggtatagactcctgcttcttctgggtcctttgtcctgaggctctaaggcttggaactctcagcagtagcacaggccaggctcacaaatcaccccatggctcagggaagcctggccttgaggctggaggaggggcctggtgacaggtgtaccacaatcctagacactgaactcattcctgtgtcagcctccaggcaccgcaaggggctctcaaacacccagatcaggtgtttaaaagttcacagtcaaggctggagagatggctcagcccacggcccaaaacacaaaagttcacagcacttaggaaacgggcgggaagactagttccaggccagcctggactacacaatgagatttttgtcttgatgtcaaaacaaaatttaaccagattaaacaaaaaacaaccctgcatgtacagttatagctcaggttacatgtaaaatcacaactgtcaccaatggccaaaatgtgtcactgccttgctgacattgaaacgaaggaaaaaaacccatctcctttgcttagaaaatgggccacatctgccgtgtagcttttgctttatgatataactgagagcagggggggggcatatcgtagtgattgaagcatttgtttgggggtctgtgaaggggagatggatagagctgggggagtctccttccttggaagtggggctgttgcactgtggcttttattgctcctcatcacgtgggcatggcaaaacccatacgtcctgacactgtgggtcatgaggcactggtgtagggtgttacaaaaaaaaaaaaaacaaaaaaccactaagtgtgcaatgattgtaagaaaacatttccaaatagaaacctatcccacatgtgggtgttacatccctccatcccccacccctcctttactccaaaatgctctgtgatgcttttatagtgacaaagaatgctaggcaagtgacctgacttatttcttctctctcctctacagcagcagtgcacaaacggctttgacctggaccgccagtcaggacagtgtctaggtatgtgatgctgacggtccttttttaggtgtggtcatttggcggtagctcaattgctaggatgtttctgccatagctgtggctcagtgtcgtcgaagcttcatttaccttctccatggaagaacacagaggtgggatgaccaagccaatgagacccttgttgcttatgttctttgtgctaagagctgatcagggtcaaagaatcacctctctcctcaacaagcatttctgttggatctgttccctagcactgcctccacaaggtttcataagaatagtagcttaaatgttgcttattttgcaccccatagctctctgggtcagaggcccaacacctgtctaccaggctaatagcagagtgttggccgggctgtgtttctctggggttcagagagagagagagagagagagagagagagagagcatcttttcttctcacgggagaagtttttgggatccaccctcctgaagttataggttgtaggtcctccatccttgctggttgtttggcgaggccctcccagcttctagaaactgtgttcaccccttggttggtagcctgtgacattcacaattatcggtcccttcttacattgtaattcctctacgtctctcctaccttttctattttcaaccactcacccaactacactgggtgtcccatagcgtaacctaggatggatgctcccatcttaaagccagctgattggtaacctgaatggaatcagccctgagacctaagggcttcccaggttccagggatgaggaagtcctttctcacagcacgccatctagtggagaaaaacttagacacagtgaatgctgtgaagttggtggaataaggtcgagtggagataacttcagtgggccccgaaaaggcagagaagagagggaacctttatgtccagactcagccaagagtcaggcccagtttgagttggatattgaaggatggctaggatcctgaagatctcaaacacagtggaaggaacagcatagacaaagatcaggggtgaaaaggaagcgcaggcatggcatgccgagggtggggcactcggaggggataaggcttggctgccccacattgggggcaatgttcccaatgtgggaatagctaaattcttaattagttttaatttaggtcaagtcatgtttctgtcccgagtcacatcaactgagactaagaagggagagagttggttgaaaaggatgaattaaaccttgaagactcgggctcattcttggatttacagtacaaaactctttggttcaaggatgcactacagggtaaagagggccgtggcttcttttccagtccatgtgttccactagagaaaagtgaaccacagcatttgcagttcccaagctgggagctggcatgcatttctcagatgacatgatgggcgagctgcccaggtccaggcatccctccccagtctccagttccacacagagcaagagctggtggcagggcccagctcccaaagccaggtctgctgcccactggagccagagttggaacctctcttgactccaccctgacaaggctgatttttctagacagaccaccactctccttccagtgtgagctgatctccagcagggctagacacagtcttgttttgctggcattgtgtgagccagcttgaaagaaattgctctgctttctcagcaagtaactaactatgagccaagccttgtctttctgggtgtaaaggtctctttctttcttgcccagctattactttgaaaagaagtggtcctgatctcatgttttcagagtataagaaatgcacaggagagtgagtacgtggcaggcttttgcactcacagacactcccatctatttatttttacttatgtaaatcaagggatttttaaaaaatttgctatattcctaaatgttaaagaatacatttgcccaggtttcaaatgtggtatgaagtcaacaatagtgtaggtttctgagggtggggtcatttgtgataagagggcttaaagagctaatgtttggcaacccaggtcacttggagtcaacttggctaatgttggggagcatcagactgcagtgagtcaggtgaaatgttagagggtcagtcccatcaatctgctctgcttcaatgtgcgcatgcccagtgtcatggagggaccactgaaatttgtcctttctgtggcctctgcagatattgatgaatgccggaccatccctgaggcttgtcgtggggacatgatgtgtgtcaaccagaatggcgggtatttgtgcatccctcgaaccaacccagtgtatcgagggccttactcaaatccctactctacatcctactcaggcccatacccagcagcggccccaccagtaccagcttccaactaccccacgatttcaaggcctcttgtctgccgctttgggtatcagatggatgaaggcaaccagtgtgtgggtgagtagcccagtaactgtcctcttacatagtggactttctcaagagtgctgtcagaatctaatatgtgctcccaaatggaactacctaccatgaaatatgtcaatcagacagtggtctgctgtctacaaatgatataatgttttattctagatatatttctgggtcctcttctgaattatatagaaatccagtttgttctttctttctgtcatttgatcaatccatccattgtctatctatcaatctatctatctatctatctatctatcatccatccaccatccatccatccacccatcatccatccatcagtccatccgtccatccgtccatccacccatctatccatccatccatccatccatccatcccatggatctcattggtgaccaacctcatttttcttaactaaataatgaatgcatctaatcagactcagggccagtgctctgtcttctatgtattgaatggattgagtattgctgcggaaaagccttgagaaccaacccaagatctgataaggaaagtgggcttcttaggtgggagccagtgttcttatgactaaaggggccttgctgatggggactctggggggaaaaataggcaccattatatcataagccccaaaggaattagcagtaccctatagagcttcaggttctattggccagtgctgccttggagaagagctgcctggggccctgcccagtcctttggtagtagttggactaaattcctgtaagtgtctccagctttagagggttacatcgaagagagatggacagtgaagctcaagctcttttgactgtgtatcccctctgccaaatccttttagacttagatccctaccataggcatatttatacatgacacatgcatcctgttatattcatgtggattgaggaatataaagcacacataagaaataggaaacgtaaaagaatgtaataaaaaataaattcgaattgaaatcctaatatttcctttccatggccatcagtctagtcaataagatttttgtgggtttcagggctctgaagtatctgacagatagagacagtgctgattataatatagaagtatgttcatgtgaatgagtgtgtatttacacttaaaatattcaaacagtatgcaaatacatgcccttcaacactacagggaaaattgaatatatacccgagctcataatgcttcatcattactggtctcaaaggacctggtgtgtatgttggggcacatatgcatgtgctgacttagatttaccttaactaagaacatgccaagggaaaatgtgcaacccagtcaagcctcatgctccttagctttgcgggagaggacagcatcatgcttccttacgacacgtagcagaacaataggccattgtaaccagaaggaacttcttggacgctctttagctacaacctctgattttttggaaaagtgaatgtggaccccagcaagctaggccatttcgcagttaggatatgagaccagccaactgctcccatctagtagaaaataatggtaccaaataagatgtagtgtgtgtgtgtgtgtgtgtgtgtgtgtgtgtgtgtgtgtgtgattggtggggagggggagagggagggaaagagggaggaagagagagggagagaaagggagagggagaggaagagagagaatgtggggagggaaagggagggaaagagggaggaagagaaggagggagagaaggagggagagggagaggatactggagggcagatgagctgagtaaaggcagtagaggctcaggctgttggaaaaggctctcatcttgtcctagaataggatcgttcttgggctatctcactcagcccttccattgaacgtttggccatccactgccttagagcttcctggatgccctccctcatcctacacacctccttccagggacttgaggctcttggcactgaagacattctgggaagcctattcatctggtgacccctctgacgtcataccacttgtggttctgaacctgttacatagacatgtggagcctttaataatggcccctttgtaagcccagtacaatctaggaaccccagcaaggactggcaccaggcccatccatttccaaaatgtctagtattatgcattcataattcctgagttcttctgacttcccttcactccaccccaccgtttcctgccttaccagggctgaggcccctatgggcattgtgagaggtggtggcagggggccagagcaggctgggaagggcagctctctaaccaatgttccagggaactagggcagagagcaggaggcagggggcagaggagagggaacacgttggtaggtatatggaaggggaaaaggccttcaaaggaggacaggcattcctggagcagtgagctctgaggaggagacagtgatgagaattccgtgagaatctgagacatttcttttctttctttctttttttttttttaaaaaaagatttatttattttataagtacactgtagctatcttcagacacaccagaagagggcgtcagatctcattacagatggttgtgagccaccatgtgcttgttgggatttaaactcgggtccttcttaagagcagtcagtgctcttaatcgctgagccatttctccagccttctgagacatttctgaaactttgcaaagaagagtgaatctcctcccctccaaaacaaacccaacagcatcaccagcagcagcaacggtagtgacaccaaacactggcttagtgtttgtgtagtagggtcatgggttcttagcacactacaggtagaactggtatttctgttgtgccttcagggaagtcagagcgcagagaagttaagacacctggcagtggtcacactgtgtgttgggttgagtctcagtgtgaaccgttcaggctctggatggggaacctggtgtttgggctataaagatttagtatatggaaaggttatggaaagggcttttagagagtcagtgcagaagccactgttaacagcaaagcccttgctcattttaaaagaaaaactttcttctgtaaaagtctgaactggacaagagttgagagaacacaatggttgctttccacctgtcacccagcgttagcggttatcggcactggcaccatctcctctttagctttagatgccatatcagtttaaatgttataggattatctgaaaaaaaagagagtaaagattctttataagaagattacaaaacaaacccacaagccttctttcaaacttaaaatatgccaggtggtggtggcgcacgcctttaatcccagcacttgggaagcagaagcaggtggatctctgagttcaaggccagcctggtccacataggggggtttcagcacaaccacgtctacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtagtggaggtggagtttggacagaataccaacaaaaaccaaaaccaaccaaccaaacaaacaaatgaaaaaccaatgcccagcccagaaaaccaacttatattttttattaggtatttatttcagttacatttccaatgctatcccaaaagtcctccacatgctcccccacccactcccccaccctcccactcccacttcttggccctggtgttcccctgtactgaggcatataaagtttgcaagaccaatgggcctctctttccactgatggccgaccaggccatcttctgatacatatgcagctagagacacaagctccggggggtactggttagttcatattgttgttccacctatagggttgcagatccctttagctccttgggtactttctctagttcctccattgggggccctgtgatgcatccaatagctgactgtgagcatccacttctgtgtttgctaggcccctgcaagtctcacaagagacagctatatctgggtccttacatcatcaaacctatcaatgtcagcaaaaattcatttttaccgtgaagtatctaaatgttgtttagattgattgtcttataaatggccttttcatagaagtggggagatagattagtgtgcaaaatgcttgcctcacagtcatgaggagctgagtttagatccccagcacctccacagaaaagccaggcgtgactgtacatgcctctaacatcaacagtgggaaatagagtcaggcagatccctggggcttggtggccagtggtctagtctagtcagcaagttccaagttcggtctcaaaaaaaaaaaagtgagggccagcaagatggctcaggaggtaagggctcttgctatccaaattgattcctgggataatacaatattgcatctacatgcctagtaaagagagaacagactccatcaaactgctctctaacctccacagaggcactgtggcacaagcatgcacgtgaacacggaataaaatataacaaaaatgaagacttaatgtctaactctatgtgcacactcacatacatgtggaacttatgtgcatctccccatacacacatgcatccacccacatgtatctcctccaactccacaaatgcccccccccccttgcattcagagtcagatctgtatagctttcttaatcgccccagttgctgactccgtcccttctccttgccacttccttgtggacacaaatgtttgtctggagtggctgctcatagcccattccttcttcccatctggttttctgggagctggaaataggtctctagactcggcccagttctggcgtcatgttctgggcaaacctcttcataggtggtgcctttagtctgctgctctttccatcccatcctggtttcctttcagaaagtgtgagagtcaccttgaacaagctaatggctgtctccaacccctggcatttcagacctactttcaaagaagtatgatcttcatcataactcaacttagcttgtgtcctcttcccatagactgacagtgcccagtgcccagtgtcctcagtgtccttccttattgacttctttgttttgggttccacttcaggggtgactaaactgttctggaacattgtggccttgggtttgagtccccaagtccctggttaaaagcctagatcacttgggacatttttgtggacaggggcatagtgacccaagaattatagtccccaagccaagaatggtttgtattgagaagacagacagcttggctcgagggtgaccagttcctcaaggctgttgggactcagagctggatgaagtgtgtcacccagattttccacccctggaagatatggtaaccagattctttagatggggctgagggcagtcaggcagagctcactggcaaggaagacaggctgttggagtggaggtcacggacctggatccagacatagtgcagatcaaacaacacacagagttctgagccagctaagagccatctgggaaaagtagagagaggttggctatgttgaattaaaagcaagaagtggggatccatgtgcaatgatgggtttcttagattcaaactgccaccccggaaccctcttttcatgacgtactgcctctgtgaatcaatcctggaatgtggttgccatcagtctctgcgtatttattccttatgggtttcagcatgccatctctctgtgtgacattctacataagcctggctttgctaaccagcttggcttgggagcaagttagggactccaccagtaacagaaattcatgatgtgttcagcagacgagaaagctgtttctctagagctatgctactctggggatcttctggccattcctgagaccacgagcagtgccttttattcccgagttggtttgggcttttgttgtgagtgatcagggcacccaagcaggcacagagcaacaaagaacagatctttctggaagatgcactcgagttggccaaagacgctcttgagttatttttcctgactgctagccagtatttagtcaactaatttacttcacagagtgcctcatttatgccaggctctctggtttaggcacaaaggggaatagccaggggtctgtggtcaaggaagggagatcagatactgtgtaagccgctgaaagacaagggagcctatgagttgctaatgtggcccaggcagagggccaggaagactctgggaatggaaaggatgaagccctcaagtcagccagaccctgaatttcttcttggttggctacttcctgcagctgaagcctggggttctacacctttgtctataaaatataaaataggtatgaccatgcccgcctgcatgaaaacaccttacctagagtttgcatggaatgtccaatgttaattgaaaatgatttgtggaggaggcatctagggtcttgaagggataacaagttcaaagattcatatagtctgaaatgcattggaggcctaattctttacaaaccttaaggaaatgacccaaagctgagtttgaccacacctttttgtaggccttcaaagtcttgaggagactttagaaacctgctttaaggtccccaaaaaagcttggtttgtttaagttgtgagacaaagccatggaagtcagcccagtgtggcatttgttcccagccccaaggcatggccaagagcacgttgaaacctcaaccacagcagagcaggtctgtggttagcacgcaggagggaggaaccggaggccttcacttctagcagtctttctgtctttttctctctagctctccagcatgggctgtaatgtgatgcccttcaggctcagaaagtgtgcagagtggggggttcttaggtgctgaggggtttaggaccaactaggcttggggaggaaacagcttcccacagaagcaggggctctgcagttagcttttgtcagtagcctttgagctgctccggcaagcctgtccactggcaatttatatttgtttttttttttttttttcaagacagggtttctctgtgtagccctggctgtcctggaactcactctgtagaccaggctggccttgaactcagagatctgcctgcctctgcctcccaagtgctgggattaaaggcgtgtgcccaaaccacctggcccatttctctagctataaatttggataatactacaaacttccaaggattgttttgagaattagataggatacagcacacagatcatctaatctacctggctcatgtcggcagcttacctattagctgttatcatgatttcaaacctatcctctctgttgatctctcctactcctgtttccacagccccgccacctctagttgttcctgttgttgcttgtcctttgtcctgaaagcttgagtatctcctgcttctgggggccgaggactggcttattgccatgttccatctgcagccgttggagtcagcatggacttccaccgagaactcagcaggaaagagactctgggaagtcagctggtgtgcagacatacctccagaggtcagggagcacaagctatggtgctcccaggtggtgcaatgttgctgatctaggatcagacctgaagccacaaaacccttgtcttcccatctgcttacttaaggagaggcaaaaacatttaaaaaattacaatcaccgaattgcttgactttattaagatatattatttcacttaaaaacagattaccccaattatgttaaagcctaacctgaggcagcaaagggacaaagggacagctacgacagggggggagagctggactttggcacttgatttactagttattggctgagggcattaagaaagtcaggtagcctctgatttaagtgctgtcagctgtaaaaagggttagtattgtattagggctcttaacctgaggtcagtacatttaaatcaaggcatctagtttttaccacctgattcttggctaatgtataattgaaagctagcattggtgtctagtgtattggtgacttgccatgggcctcctagtaggacccctgcctgtatagagccaggtgtttacagatcacagcacagctgggacagttactttgggtcgattttgaaatcttatgcttgtcattactccagaatttagagaaagacattagacctgttgctcaatcttgctatttggtgcactaaaggacgtgcatgtacacacagctggggagagatggcttggccagtaaagtgtctgctaggcacgaggactcaagtttgatcccagcacccactagcacccatgtgaaaagttggatgtgtcagcctgggcttctgtcaccagtatgggagagatggagacaagctctctggagtttactggctagccagtctagctgaattggtgagtctcaggctcagtggactgtagaaccaaattccctgggaaggttcagaatgtaacttaaccatttctgtgcacgccccgtgtggctctcctctgctatgggtggtatcttcgggaagcctctggctctcacctgcactccagccatgatacaagaaacaacaacctgggagtcgtttgtgccagagaacaaatgaaataagaagtgaaaacaccatatgattgcaggtcatcagtttcatgtgcgaggctagaaaaacttaggagtcgtatcagtattgccaataacagattagtggaggtaaccccaagttataattcctgcttcgaggaaaagaaaggagggtctttgattcttgaagggcctggatcaagtgacttattatgccagtagacaatgggagacagtgtgacactacagtgacagcccaggctttagactcacccctgcttgggtttacaccccttcatcacacagtgacctcgctcaagatcttgtctgcaagatgggataccagtatttacttgtgggatgcttggaagtttagcagagaagatgctgtgcatccaatagtttggtctgcaccctctaaaggatgtgccgtctctgctgcctgcttccaaatctatggttctttacattgtaagagcagatgtccagtcacgaactcgtggtggcttagcacaggctggaagacttgggaagagagtaacaagcagaaagggaagggaggtatggtctcccttcagtttgtgattacatacagatacagttgtgtgttgcttagaatgggggtatgttctgagaagtgcactcactattgatagtctggtcattgtgtaaatgtcatagcatctacttatctcagcatcaccaggtgatatagtcacatcagacgtcatagacacacatcctgctgttgactcactaagcaagcatgctgattcttctcttccatctgtcttctcagtccccaccaaagtggcacttgcaccttctctggggcctcatggcgaagtctgtggtgccagagcaacttggataccctgttccctttcttctctcttgaactgctagtttatctggtcacttaggttctacagtgttctagcctggcaagctattgtgggaattgtaggctgggcaccctctataccagcctcccaggatctcaagctgaaagcagaaagtcaagagctctctataactcagggatacaccctgtttacatcttttatattaagggcatggcatagggctccagaagtgggttggattcttggtgggaggtattcctgggatgcaggcactacatacaccagcactcactctgtagccacagcctatggtagagtgagctgtcaatcagttataatcataggaatgaatggaatgaacgaatgaatgaatgaatgaatggaaggaaaattattctttccttctctcacttgctctctcattcctcatgtaaatcccacctctatgatttcccatactgtactgggtgccaagggaggccatgataactatgatggccactgtgtatgccccacacgcagccaggtgctggcatatggctgcactgtgagtagtgaatagaactgggtgaacagggagcctgagaagctgatggaacagatgccagtgaaggcctttgggttggatgacttgtggagttctacctccactggccttttcttaaggtctctccctctnnnnnnnnnnnnnnnnnnnnccctacccacagtggtctgggccctcccccacaaatcaccaattgaggaaaatactttacaactggatttcatggagactccttcctctctgatgactctagcttatattaaattgatacacaaacctagccaatatacaataacatcctcatgtggttcacagatccatatagacattaacaaattcgcacacacgttcatacatatggtatggtgtgtgaatgtttactttacatcaagtgccattcgaattactattccttgttaagccatttggccttcatttcaactgctagcactatcgcttttctcacttttcaagtaaaataatgagaaaactttaaggtctcagatggctactcatttgccatcagtgctaaatacttgccaacacaatgtgtgacttgaaagatctgatgagtgctagctttttctttttttaagttacttttatattgtattttttcagtgctggaaatgcaatccaaagccttgagaatagtatgcaaatgttgtctagctgaactgtatctcccctctctctctctctctctctctctctctctctctctctctctctctctctctcagagggtctagtggtctagtgggagagactggctctcacacatctgccagcagctaaagcccctccccatacaatcccagagtgtgcccttcagttgcatcccatgccaagctgccttgggaacctgcagccagtcatgggcttctgcttgtctctcacacaggagtgtgtctgagaaagggtctcagccatctccttagggtctgtccagggaaggacattcatgggattcttgtcttccagcgcactccaggcggcagacaagaagaagtcaaggactggccttccatttccctccagcttgttggtttggggccagaggggagatggggacagcctaagctggtcctgccctaggcagccagcatctggggcaggctcgggagacgtctgacttggtagtgctggggaggtaatgctgcctgggggcttttcagtgctgtctgactttccttcaaattagaacatttgcagaaatgcagccagacttgatttatgggctctgcatatttcacaggtctttacacatcccccaggaatcagtgaggtcagacagaacaaacttcacatccggaatcagtatgaaattggcatcttccttagttccagtgggaggagggaggataataattttaaaggaggttacatgaaacaatgcaaaggcacacacacaaaaaaaattccagcctctgcttcactcctattggggataaagaaaaaagatatatgttttctgtgtctgagcctagtgaggagtagccatgtctgctggagccactgttactaggatggagaatgatgggacagggctgctagggtgactgatgaacgcagtgagagcccaggagtgaccatagatagcatcttgtacttgtcctttggcgcacactctgtaacaatgataaatcgacattcctggttattcaacatctcatggcccagaaggaactttctgtcttgctcaccattatttttttagtgcctgatgagaatttgctgagtgagtggatgagccacacacagcgaatggagtgagtaggattcaaatgaggagagagagagagagagagagagagagagagagagagagagagagagagagagactgatatctttacaggtagtgtttctcacataggcccaacttattactgctgactgctgacgaatctattcattccttgagttctttgcaggagtcaggtaagttggtgggaactgcaagatctgacacacaataatcacaatacattgggcctacatcagagttccaaggtattggggtggccctggctaggatagtcacaattttgcaggacagctgcatctatttaattagaaagatagccatggagtccttctgtgtatcagactctgccaagtttgagggatggacaacatacaccccctactcttgggatctcccagctgagtctttgtgagggtgctgggttgcagggacacaggcacataaatagtcagaatctatccaggggtaaccagtgagatcagttggggccaagtgctaaaagggtgctctatatgaattctacactgagaaggtatctgtgggtctttaggggatcattggagatttgagcaggattttcctgttagagaaggtggggcggggggaggaggtaaaggctgggaacagaatggacaaagaggtggagcagagaagttcatggtatgttcaggactgctaaccgtggcagcagtcagccttggctatgagaacactggttacctgcctgtgtgcatacctactccgtgtgcttcacaggcacaggctgagaacagagagacttagaatgagagatgatgctttgaatattatcagggactagactgtctgccgtttgagagccacgcaactgatttggtctttattctgtgaacagagaattaaaagttacttgtacactggtgtcttggttggggtttctattgttgtgaagagacaccatgaccatggcaacttgtataaagaaaatatttagttggggctggcttacagtttcagaggtctagtccattattgtcatagcaagagacatggtagtatgtaggcagacatggtgttggagaagaagctgagaattctacatcttgatttaaaggcagcaggagactgccatattgggtgtagctcaagcgtataagacctcaaagcctgcctccatagtgacacatttcctcctacaaggctacacctacttcaacagggccacacctcctagtagtgcagctttctatgcgccacacatttaaacacatgagtctatgggggccattcctattcaaacaaccacaattggttttaagatttctgttttggaggcttagtcaatgggggtctgtatctagtcatagcactgcagcaagcttacaatggggtactccagtcccttcttctttgtactctatcttcttattcatgtgagaggaactagatagcagctaagggtcccttcaacttcctcagagccaaggctgacttactaccgttccccaagatctcatgaactctgccatgtgccatgtgctatgatggcaggtgaggggtggcttagagtcttagtcctagtgactagtgactgccacttcatatgttctcaggccccttatcagaactctcctttaagctggagcagagccgtgcccttgccaagtccctctgggaaggggcatctgtggtttgccaacagccctggggatgatgagcacgccagagtgtgaggagggtctgcaggcagccacatagatcacagcccccggggaagtcagggccctttgagattgaccaggattttaagactacaagaggtccacaatggcagaaggttctaagaaatgacccatcttagacttgtggggcaccttttctttgtctcaatagcttaggctttgttttttcttcttttttttaaagacgggctcacttatctagactggctttgaattttctatatagtcaaggatgaccctgaatctgtgattctcctgcctctacctcctaaatggtgggattaccagttatgtggtcctgggtaatcggtacattcaaggcaaacatttttatcacctgagccacatccacagtccatgataaatcaattgtattcagctctttaatgcaaacaaaataccagcaaggcccttagaacatccagtgaagtgcagatgttcaaatctctcatggccctgtgccctgtgtttgaacctttatttccagcaaggaggagagggtgcctccttgcccttctggacaaagggcttgagtcccaggatatctatatggggacaagaagcttgagtgtgggtgggtgggtagggggttcttttgagtcaagcagattagcaccaagaggtctttactttgggtgtggaggccccatgttctatgagaaaactggagcaacccagcccagatatcaccacagtaagcctcttgggaactttgtaggtaaaagagttagcattttatgatttgctaacagagaccacttctcacacttcctgaagtcggactttgagagctcttagtgtctgaagcccctagtctttgatttctgaaggacaaagtcgatgcttccaagactacaattaggtttttaaccacaaaaactttgtcttcactgacaaaggggagttgaaaactgaggcagtggccaggggaattgtcaagagcaggcttggctaacccagtcccagttcttattcctcctcctccaagttccttcaagggatcatgggaaatgggatatagtggattcagggagcccaactcctgtacaaagcacatgtgactgtgcaaggactgagcatcctgggagagtcgattctgctggaggccgtcttcatggaggactagcacctgctatgtgacattatgtaccaaaagttcacttaaaatctttggattcttcattatcaaggcaaatgcattgctatggaaagagatgggatccagaagccgagtgactgtgggcaagtcattacttggctatgggaagaggatgctctgaggtgagtgtagagtctcactcactgagagaaccagtgagcattgcagaccctcaggtctgatcttatcccatgttaactttcatattctaaggagtttggtcaggatgtggcaagccaaagcataaaccaaccattctttttgaaactaggctcttaaattcagttcctttcctgataacctaggtttgtgaaattcttttcctaaacccactctatggacacatcaagcttggcaccatctgtaagccatagagctccattttactcccatagaagctcagcaaatagttgtaaactgagcacatttgactattaacatgttatgcctccagagatacaaaaacaaaatgcaagcaaacaacaagtacaaaaagcgtggggcaggaaagcctggggcctctgcagatggacaggccaccaaggagttactagaaaacaaagacatcaagatcacaggagacagtgcagacttggccttggctctcttgagcaggaaaggcttgccagggtcacattccagggcagctgtttgaccatgaagcacaggatatgggattccaaatcaaactacgcagccacatgcctactaatagagtctcatcaacaaggttgttgagagcaaaccatgagcgaaagtgaggtagttcatcctccctgaagcctgggagcagcctccactgtggaaagtgttggggcgtgtgtgtgtgtgtgtgtgtgtgtgtgtgcgtgtgtgtgtagttttgctacagactaggtgtcttaatgagcagagctatatcacgttctggctctggaggtcgaggtgaaggtggttgcagggtcctgtttttctgagggccacaggtgtggttctgctgtgtctctcttcttgacctgtagccagctgcagttcccctatgtctgccctttcccttctctctgcacatggctctgtccagttttctcttcttggaagggcacgattcattgtggattagggctttattttacttcagctgtgccttcttcaaagaccctcatctccaaatgcagacattttatgaggtactggaagtcaggacttaaacatataaatttgaggaggcagaaaaacatggaacatggtctttttctctctcagggacgcttctgaggctagagaccacagagaagccatttaaaaaaaatcttctttgctatcccttctaggaggccttgttgtatctttactgtccctgttttgagcccattggaacttcctcctttgtgcccccaaatacttcacttgaacctttacagggatatttctcaccatttcttctagaccagttgcacccatgcttcctgtgctaaagtctctatcttggttgtctttgcatctcttgaatccctcacctcctgtctagaataggagggggtcaattatgtttgttggcctatggatgggcccatggttcaagaatgttgagtaataatgttgaataaacaggaagataaggctattagcaaaagccacagcaacaaacctttgcttcaactctttgccctcaatgacaaagccgagctactgaatttacaaagaagtaagactctttccattcttccctcatggcttgaccacagcaggtcaacaaaagaatctgcaaactgggcgcttagcattcttgaaaccccagacttctggctctttgggccagttttgaagaaagtcttcaatcatttcttaaataatggcattcttctggcccaactctatgaagacttctctttccacccccaacccagtgaccttctggccccttgtttcttggctgaatgtctgggtcttctggagagagcaaaagcagcttcagcggcactcggagttcttcccacagaggcagagtcacgctccccagaaagcctgactctgcacaaacagacgggcttcagcaggtggccttcaaagaatagtgtaagacttaaaagtgctttgttccagaatggagctcagaaaagagtgtggtgctgtctaagacaagtcacccatctcactaagagaacactcacctaaggttgggtcagaagatccttcctcactccagcctcccctcagacccaagctgcactggcacaaagcaacccggtgcccatgctgcccttctctgtggttcctgggatgcttggcctggaactcagatgcccgagtccttggcccattcatgcctgctaactgtgtgcggttagcacttttgtgatgttccctgtgggccctgactgacaaaagataagaggagagtgttacattggtgtgttcttcagagatttctgctgactcagcaggtttcttggatttaccttttagcttttttcttgtttgttttttgtcttttgagatagggtctctataagtagccctggctgtcctgaaactcactatgtagaccaggctggccttgaactcacagagatccacctgcctctgcctcctgagtgctgggatcaaaggcacatgccaccatgcccagctgctttggtttttgtcaaagcacacatccgtactagaactcaacggcttattgaagctgtagtgacattgaattaaactctgattaaaactttagaacacactatttagggaactcaaagagggggacttcagtgaggacctaaagactaaacaaatcctcctagaggattacagctgggctggtctttaaggaaaagaagagagaatggatctcagtggtctgacctcaaatgatccctgctagagaagactctgttctatgcagccagtgacaaacctaactcatcttggcttaataaacagaagaacacaaagcaacaaaacgacagaagaatacttggtgtacaatatgccacatgtagtttgtatttaatactgaaaaaagcctagggacattagttccagacaagaccagagctaagagccttggccttttcttgccttggattctcaaaatagatggtgtctgaaaacctccagcctatgtgttaacccagagacattgcctctgatccccagagcatcagtacgaggacattggcaggctctgcttagctagcttgggtctcttgctgttttccaaaacagctataccagatcacaccctaagcagcagtatgcagggcatatagatatattcgagacagggtttctttgtgtagccctggctgtcctggaactcactctgtagaccaggctggccttgaactcagaaatttcgcctgcctctgcctcccaagtgctgggattaaaggtgtgtgccatcactgcctcgatgcagggcatattttgatctgaaggctcaccaacagttgatattggcaaacttctccatttctgccaatctggtggtttctttataaatggtacataaaaacaaacaaacaaacaaacaaacagatgaacaaacacacccacccacccaatagtgtctttgttgcaaatgtgtagaaatacaacttatttctaagtgttgatcttatgttgagatggctggtgaaattctgtcatcatgtctagtctttggtagaatattttggctgtactgataattacactatccaagagtaatggatgtctttcccttattttccaatgcttatagtctttaaatatttgtttctcatgttttctgtactgttggagagtttttagcatactacagagtaggtgatgacagtggacatcatctgtctctaggtagcaaaaaggtcacgactcaaaaggatcacgcctaatacttcgctatgaagaataatgtttactgagttgtctttctcttgtttaaaaggttcacgacgagggccaagatggtggctcagggggtacagtacttaccccacaattaagactggagtttggatccccatcacccctctaaatgcaggcatgatagcctacctatactcaggtggcagagactttcacaggcagagacaagagagagcaggtttcctcattagactatctgaatcagcaatccctgggtttaagtgagacaatgcctcaatatataaggtagagagtgtttgaggaagacacctgacatcaaactctggcctttacatgtacacatatacatgcacaccatgtacacatatacatatatgagtaacacatacacaagcaaaaatcattatgtatcttggtgatagagtacttgcctagtaaatggaagactgggttctatctccagcactgaaagagagagagagagagagagagagagagagagagagagagttgaatcatcttgtgggaattatttaaaagaacccaccaaagagagagagagagtgtatgttgaatcatgtttgttgtgggaattatttaaaaaggacccaccaactcttcatccccacttctttcatcctgctaactccctggtggggctgggctgtgctcctgcactcctgctgctgctggcaactctctctagctaacccccgcagcatctggcttacttgtcccaggagtcactggttccctctctgctataatcccgttccagtaactaaatggaaccgccaacctcatggttgcatatcacaatacccagtaaccaggtaaaatcaagactcttaacgcttgtagttaaccaatcagatttatgtatcaataaaatcacaatgtacaagattccaatgcagtaatttcagagccagttgataatgataaacgctttatcccaattagtctaaccacgtgataagatcaaggcagcctccattctcctttcccctctcctgagaggctcctagttctctttcactcttctccccgcctccccttccccctgtccaatcacaggcctcttgctgccctaatgtgtttggacaggtaaaatcctgcaacagaatcaaatgcttttaatgcacgtattgaaataattatatactttgaaaatgtgcttatacgattacgtccattggtaggcttgtgtgtctgtatatgtgtgttgtgtgtttgtgttctgtttgtatgtgtgtgcgtgttaatgttcttattcccataggttgaagcctgttgtctccatggtcactccttaccttatttcttgagacagtctttctctgaatctggagcttgccagtttatctagtgtagtaaggtcttgggatctgcctatctctaccacccagcgctgggttacagccataaactgccatgcccggctcccttaacatggtccctcctgtttatgcaccaagtacttttctgagtgaagtatctctccagtccctggtaggttttcttgttacacactttgcatattcatttctaagataaccaccttggtcatgacatagcataatttgtttaaaatatctgtctgatttgtttgtctagcactttgtttaagattttggacagcaatatctacaaattaaagtggcctttcacattcctgttttgaattatgctggctgattctggtatcatatcatcttgatagagtgagatgttttttcttccttattctctggaaagctaaactggtctattcatggactggttcatggaaacttcattagcatttgcctgtaagatcaccgaggtctggtatttttgtatgtgtgtgaatgggaaggttttcagctgccaatgtaaattctttacaattatggggtaatttgactatttggactttctagtctctctctctcctttttttttttttccagcgatggtcttgctatgtaatgtaggcttggctcaaactcactatgtagtcggagctgttcataaactggcaacactccttgcctccaccttctgagtgctgggtttctagacaggaatcactacatctggctcttaattcctccctcaggagttttgcaaagttgtgtttttctaaagatgacttcatttatgtttttagattcatttgaatgaacttttccctacatcctctgaacgatcttttgattccatgctgcagccacagttcattttctattttcatttctaatatttttttgtactcaaaagtatttattttttttattattctaaattatatgtatgggcacatgagtaacagagtctgctgaagccagtgtcatcaggtgacctggaactggtggtacatacaggtgattgtgagcaacctgatggtgctgggaactaaatttggatcctctacaagagcatcactgagccacctttctagccctttaacctgtttttgtttgtttgttttttgtttttgtttttttttagtgacaaatatgtttccaagtcatagaacagtttaaccattttaaagaaccaatctctgcctttggtaaactcatttcttttcaatttttcccttctttttattcttttctgctgttatttttcaaaaatattattttaaattgtgtatgtgtatgtctgtgaacaggtaggtatgtacacatccagtatgtgtgtgcgtgtctgtgtatagataggtgtgtgcgtgcccccagaagagagtaatgggtcccctgggactggagtcccaggcatttgtaagctgtctgctggtgctgggaactgaattcaggttctctgcagaggtagtaaatgttcacaactactgagccatctgtcccatcctctgttgtgatctttactgtcttctttttaagtgttgggtttcttttttcccttttataattcctcaggattgggacataatttattaatttttaaatgtgaaaaattttctttatcagcacttgagacaacctccccaccccacacatcatatgttctacaagtttgaatatatagttacatgttatttaacaatgggaatgtgtcctgagaaatgtgttgtcaggcaattttgtcttcatgtggacattttggagtggacatacacagaccaagatgggataaagtcttagttacttttctattgctatgagaatataccatggcgaaggcaacatatagaagaaggagcttgtttgaggcttacactttcagtgggctagagtctatgaccatcacagtggggagcagcatggcagcaggcaggcaagcaggcacagcatcagagtagtagactgcttaaatattgagacacaagcatgaggcagagagagctaaatgggaattgtgtgggcttttaaaacctcacagcccacccccagtggcacatgtccttcaaaaagaccaaactttctttctttctttctttccttccttctttctttctttctttctttctttctttctttctttctttctttctttctttctttctttctttcttccttccttccttccttccttccttccttccttccttcctttctttcttttttcttttttctttttttcgagacagggtttctctgtgtagccctggctgtcctggaactcactttgtagaccaggctggcctcgaactcagaaatccgcctgcctctgcctcctgagtgctaggattaaaggtgtgcaccaccaccgcctagcaagaccaaactttctaatccttcccaaatagtttcaccaattggggaccaaagaattcagatatatgagcctatggggaggagcggctgctctcatccaagccaacactgatggcctcctccacatctggacgacttggctcagccttattcccaagctacagaccaatatagcatgttacagtactgaatgctgcaggcaactgtaacacatgggtatttacttataccctgtaggtgagagggggtatgagaggccataactatttgtgtatctaaaactagaaaggtactataaaaactcaggggacagggtgggcagaacctgaagaactctggttctcactggctcctgcagaatctggagtggcgtgctgttaagttggcgccatcactgtggagtcggagtacacgctagccatagtctaaggcattggttctcaacctgtgggttaagacccctggcagacccctttctccagagatatttacattatggttcacaacagtagcaaaattacagttatgaagcaacaacaaaaatattcttatggttgaggtgtcaccacaacatgagaaactgtattaaagggttatagtagtaggaaagttgagaactactgttctcaggaaaagctgtatttagttttaaatcaaagattaaagagtttttaaaaatttaaggtgtcttttacttaatttttaaaagtttcatttcaatcttttgggcacagaataatatgtgtagtctattgtcaactgaaatgtcattttgtcttagggcacacagctttttcatactattaagatcaaagaatattccagttttctttgtgattatatcttagtctgtgatgaatatagtggtgaaaatttcaaattatagttactaggatttatatttttcatattgatttccatttaattgcattctcatcaggaaacatggtttgcccgacacaggttctggggagttcatttggaatatgtttattattttcatgtttgtagtgtccagccaggttccaagaacatagaatttgcttagtgaatgtttgtagagagagtgaatgatgatgtctatgaaccatctgtcacaggagttgtctcttcctgaagtcagactatccacttctgtcagttagattgagttttagagtagcctacacattcagaaactcaatgacctgaagaacagtcttctgccctgctcacttcctcagactttggtaccagaagcagacatgggaggtttgctgcttgtaaaactgttgacttgagactccaccacagtcttaaacatcaaagatttagataatgacccacatatttattttatgatctgtagagagacaatttttctataatggcaataattctgtaaattcatttaagatggcatgtcccccagtaaatctccctcactttgtgtgtgtgtggtatgtatgtatgtgtgtatgtatgtatgtatgtaggtatgtatgtgtttacatggatgagttcatgcagaagccaaaggccggcatcgattgctccattaactgctctccactttatttttttgagacagggtctctcactgaatctggagttgactggacagctggccagtaagcccaaggatacttctgtctctgcctgtctagtgttggggttacagacacatcaccattcacatgaatactggcgatctaaacacaggctctcatgcttacacagcaggcacttcactaactgagatatctccccagatcctcaagggaatctcttaccttgttgaatcccccaaactcaggcatgatgcttttatttattttatgagtatgagtatactgtagctgtcttcagacacaccagaagaagacatcggactcgatttcagatggttgtgagccatcacgtggttgctgggaattgaactcaggacttctggaagagcagtcagtgctcgaaacctctgaaccatctctccagccctgatgcttttgtttaaagaaaaaaaaatgaagggattgacatcaacctagttagcagttggctagttgaaaaattaactaaccatctctgccacttttatcatttataacaaggtggtaatgtcttcgacttgcctaaaaggatgtatgggaataaaaaccagacttagttctgctcatgaagagcagtagacaaagattggaaatgcccaatgtgttcagcaccaatcagtacagttggctaaatgaaggaatgcggcggaccagcctcagtcagggttctcctcaatcttcgggagaactcggggttctggacaggtgggcaatggagttggcgatgaaaagggggtgacaaacagacaagacacaagggagtgtggtatctgaatgtagtttgtctcaaagcgagcaccaatcttataagtgacttttacacaaaacagaggaatgtgtacaaaaagctaacaggaaccaactgggataaaattcaatgttaacaactgggatcaaaagcagccctacccatggtcaacttaatcttagaagtcaggggcaagggcttcatgcccttgacatagttcctattctagtctattgtatagtccaccttccccctaggccattgtaaattcctgtgtatgggtgtaactcagctatctatagttctaagtatctactctggttcctccttagaccacaaccttccttcttcctagataatggtaaattcctgcatatggggagtaacttggctatttttctaagtgattgtgtgtgtgtgggggggactttctactaataagtagtctgccatacctgactgtaatgaagactctaagtatacatactttgctaagcttgccctgagatttctaactctagatagtagatagtaatgcctgatttctttcactatctctcttacaatactagaggcaattctgaatgtcactgaaaaggcaacattcttaccgaattcaaagcccattaaggactgcccaggactggtgaggaatctaacttagctgtcaaaatcaatccttagaggcacttataataaagcaatagtaagggaaagcacacagacttgtactctgactaacacaaggacaaaattggagcatatgtgctgtgggatgccacagttccaggagacaaagtctctgtgaacttttcacctcgggacagcgtctaggtttctggggcctgtcacaggtgtcactactggagtggatgtagcaaaggaagtaacatgaagctctagctgagcagcacagttccctctatgagtcaataagtactttggcatggtaatgtgggaaaaaataatcatcaattctgtctttttggcagaaaagacattttgatgagatgtctgtcaaataggtccagagaggagtccatagggagataccaggacattttgatgtcagagcaaatcctaggaaacatggcaatgtttataacatatataaatatataattatatacaatacatcaatatataattaatatatcaattatgttatattaatatatatgttagttatatattcatatacatgttatagatagcacacatacgctataaaactgtgctatagaaacactgaatgcatgttcatataatatataaaaacatggcaatggtttggtttttttttagatttatttatttatttattatatatgtaagtacactgtagctgtcttcagacactccagaagagggagtcagatctcgttacagatggttgtgagccaccatgtggttgctgggatttgaactccggaccttcggaagagcagtcggatgctcttacccactgagccatctcaccagcccggcaatgtttataacatatatatttattatatatttataatgtatatacatatatatgttgtaaaggctgtgttatacaaacatagccatgtttctttttttttagttggatattttctttatttacatttcaaatgttatcccctttccctgtcccccccctcccagagcccccctatcccatcctccctccccctgcttctataagagtgttcctctactcacccacccactcccacttccctcctctcaattcccctgcactgggacatctatcaagctttcataggaccaaagacctttcctcctattgatgcctgacaaggccatcatttgctatatacgcagctggagccatgtgtactccttggttgaagtcttagtccctgggagctctggggggtctggttgattgatattgttgtttttcctatggggttgcaaaccccttcaactccttcagtcctttctctaactcttctattgggtatctggtgctcagtccaatggttggctgtgagcatctgcccctgtatttgtaaacatagccatgtttctatattgcaacaaactagccatctctctataacagtaattaattataatgggcatgcctgcctaatgaaagagcagaatagcacactatgcttcaagttctttcttaagtggcatcaggagagtctcccccatcaggctaccccttgcattaactttttcctacctgactacaatgccctgtgtatacctgctttgtatgctgaggcaagccagacttcttggcatcccttcctcttgtgtcctccagggggcctcctctgcctgcctctgctcaggtagacacctgagctctcagaggatccggtctgtcagcttctctggagacttttttttttttttttttaagagggggtggtgttgtgtaggaaggcatccctgaaggtcactgtggagccagtttgggatttgagcttggctctcacacctttcttcctctcttttcatttagaagacagatcctcctgtttctcctcctccgctagtaaaacagtgaaacactcttgtcttaataccagtccctgactgggaagaccagttcctgactggcattgtgataaggacttggcttgcaattgatcctacccagttgctatcgtcattaattctctctatacatgaaacaaacaaccaaacaaacaaatcagggttttagggactgacaaaaagaacccctcagaatttgttttacattatgtgtctaaaaagtgaggtcaggaggatgtgaaccaggtctggccccagctcccctgtggctacctccctgttgccctttggacccaggatttaccctccattataattcagaactctttgtagttattttccttctattgtctctctgctttcctgtttttcatctccatcttctttctccctgcttcttgggtcccatgcagtaacactaagttgcagaggacatgtgggctgtttgcacacagagctgagatccttagggcacagcatggcagctgtggtcttccttctgggtttagatgtcgggcacaggtcacttgtttatctctctgattaggaacagtttgtaaaagttggagtaaagccaagtgaagaaatagtctttgattctcagccattaacttctgcattgtggaaaacatacatgacataaaatgtgctgcctcggctatcttcaggggctactgctcagccatgttgagtgtatttacactgacatgaagcagacctcagatcttagaactccatctttcaacttgaaaactctgcacctatggagtaaccatctcttctcctagaaaccatcattctactctctggctctgtttgactcccgtggacatgtcacaggagaggggtcaggtagtaaatatctgtcctttgcaactggcctgctttgcttaacagaatgtcatcaagactcccccaagttgtcacatgtaactgcagagagtagctctagtcagtcttcccagcatccctgaggcaaggaacctgagtttgtttatgtcccacgagggtttattgtcctgatgatgggtaagtgtgggatacagagctcaaatccttgctccacggatcattcactctgctggctggggcatgtgccttgactcactgttataccgaactagcagtgcaaacctcagagagaagtcgggaagatatggtgagatactgttagtgaagaagtcattgtgcgttttgtatgtgtgtttttgtgtttgtgctgtgcacatgtataaaggttggaggataaccttggatgtcattttctgcatcgtgttcctttcctttgagacaggttctctcattggcttggagatgatcaattaggctagattggctgaccagcaagcaccagggatccttcaacatatctcactagcctgtgctaccttgtccgtttttacgtaggttttgaggattgaactcaagtccttgtgtttgtgaagcaagcacactaccaattgaaccatgccctggttccatctacgtacttaggagctctgttggtcttctgtacttggtgcaagctcttggagagcgggggatgtggttcctatcagtgataaggaagctgagatgcaggagaatgcatcagcaatgtgtgcaggtttgtcctggtgaccaggtgaaggactgagagtctgatcaagggccctctcacctcaggggtgggaagggcacacctgaagcttttcgtactaagggagctctgagggtagcccaggagggaacgtttgttgctgctgctggactgattaattccttgggggtggatttgcacacctgcatactctcacacgagtatcagggctcatgagggttttgctctggatggaaaaatagattgggcttctacttgaatcctaaggggtgctgctgatatgtgctttcggggcagggagggccattattttctttcctcaacacttctcagaataaactttctctgggatgttgaatcttctgaggaagacagaggaagctatatctatcaggcatggttgggaaagtctgtgccctgcctggttaatatgttgatgtgccgatccccagtgtgatggatcatcatcttgggaggtgataatgtttggatgaggtcatgagggtggtaccctcctctgagacttaaaaagggtcaaagagctttgaggtctttatcctatccctcactccccactgaaaagtggtggtgtcattaattaagatagagccctggtgtgtgtgtgtgtgtgtgtgtgtgtgtgtgtgtgtgtgtagttcacagactgcaacactgaggaaaagcagacaggagtatcctaggcatggtagtgcctgacgttaagcccaggtctttggaggaagaaagcagatggatctttgggagttctaaggcagccaggcctgcagagtgagaccctgtctcaaaatgaaatgtaaaaagaatgaggtggaggaattggctcagagaagacaagaaaacagtgcatttggggagccaggaaaatttcaggatataagatccatgcatttatgagcaaatcttacagatttggtggagaaataataccatgtcttgtaggaaaatcttgacctttctcctgcttgggatctctgcactttggccatgaccttggggggggggggctgtttctaagaacttagttaagatttggggactgagtttacactcatggaaaacccaacactgctaggggaccaataggagggaaggactttcaagatatgtgctgctgtaggtgcccagtagcacaggattgaattgtagaggtgagtgtgtactgtgtgtgggtcaggctatattaggagttttatttatttattttaaaagatttattttattttaaattacgtctatatgtgtgtgtctgtgtgggcatgtacatgtgtgagcatgcacgtgctcctgcctatgatagccagaagatgacatcagatgacatcagatcccacagagctggagttgcaggtcattgagggttgccagatgtgagtatggaacctatgcttccataccctgaaggagcagtcagtgtgcactcttagcctctcacccagcaccccctaggggttttaataataccctgaattctcagtgcatccatgggggaggggtatcgtcaggagctccttggatataaggatcctcagatactcatgtctcttactacaaacttgcctagtttttgtgcataatctgcttatccaccaaaatactcaaccatctctaggctgcttgtgacaacacccgatacaacatgaatgctatgcaagtagtggctatattgtgttgtttgggtgggaacccatgatgagacaaaaacctgcttgatgtgtgtcaccctaccacttgggaagagacagaggtagaagggttgagcctttgaagccagccatggcaacatagtaagatgctgttaaagtggtgtgtgtggggggaataaagttggtagacttccagtttccacatgtcctaaatctgcagctgggtgagtttgtggctgcagaacccatggataccaaggactgagtgtactattgtatctaccaggctttatcttaaagaattgagttttagatatctaatcctgttccccacccccaacagtttatctcgaacactccccgaaagcctaagcatattatgtgggcacagaactcagcagcggtcagaggagtgtagcaccttcttactcgaagtgtagtccctgagccacatgtgttggtgtcaccagggagctgtcaagtgaacagcatctcagaattctgttttaacaagatcctcactgattcacatatacatgaaagttgaaaagcattactgtcccatatattcctctgccccagactcatttaaatcacttcaaaacagcacagcgtgccaagtttcaaccccagacaatctcatgtagtcagtgattcgtgtggacagagaaaatgctgcctggtacacacccaaacctcttctctgttgatggacaaatggcaagaatttactaagtggaaatctaatttgagtgctatgctgtttgctttaaagtcacgataatggcctaagtcttaagcccctaaataccatgtgcaggttgccaaccagcaggctgatcctcttagtttgagaacatcttgtctcatgatgcttgagaaaacccctgtatcgtctcttcttcacagcagtggccacccgtactctggcacaagcggaatgaacttggccaattcactccccattttgaaagcaagctcagccagttgctgtttatcatgcattctgtggatgaaaataattacccccccccccaaccaatatgatcctcattactgacatacttagtctctgtggaagatgagagctaaggccatctgagaacactcctccaacctctcactttatggatagatgaataacatccagggagagtctgggtctcagattccagctggtttcatccaagatggaaggattcttttgttgttgttcgggaaatggaccacacatttgttgcctaattagtggcacagtgcttaatatcaagaactgagaaaagggctgtaaacatagagggatttttgactcctaatgatcatgcaagaccatcaggcacatggagtgcagatgtgcgaggaatttagcaagcgagttctcaaacgctgaggtctttaattaagcaggtgtttgggaagtaggtcctgtgtggcttccaggcttggctggattgggctgcctgaaaaaatggcagtggcccagcccagcagccgggctggaatagccttcctgccgaggtgcaggaatgtggcagtattattctcccagttcttatcaaaccccattagcttgggcaaggaaggaaccaaaaatgggctggaaaaacatgttgtttcaccggctaaaaatctactaccacagaaattatttctgccgtgtccaaaagggaagattggagcccttgggaaggtgtggatgtgaagtactcttagagggctgttgcccagcaagaatgtttccctttggctgatggcttttctcacactagaacaggcacgttcagcagaggctccctaaatcagctccacttgttcacaggattggagtttgggcacagaaagggaaaattcagactgagcagggttgaggagtggctatggaattctgtaagccacgtctcttcatgtttctgctgtctgtcatcctagaaggactcagagtgcagaggtgggaaagtgagatgatgctgaaggatggtgtctgccatttttctcctcttgccatagtctccaannnnnnnnnnnnnnnnnnnntgtagtgtgtgtgtgtgtagtgtgtgtgtgtgtgttgtgtgtgtgtgtagtgtgtgtgtgtgttgtgtgtgtgttgtgtgtatgtgtgtgtgtgtgttgtgtgtgtgtagtgtgtgttgtatgtgtgtagtgtgtgtgtatagtgtgtatagtgtgttgtgtgtgtgtgtagtgtgtgtgtatagtgtgttgtgtgtgtgtgtagtgtgtgtgtatagtgtgttgtgtgtgtgtgtgtagtgtgtgtgttgtgtgtgttgtgtgtgtgtagtgtgtgtgtgtgtgtgtgtgtgtagtgtgtgtgtgtgtgtgtagtgtgtgtatgtagtatttgtgtgtgtgtgtagtgtgtgtgggggatatgagggagagaggccctggccatgtccacacagcccagtgagcttcagtgataaggtcttgggtgtctctgttaaattcttgaccatggcccacaggaggcagaagccagacttccccatcttccatggttggtagggacaacttgacactggcaaatacatggggatgtccaagcactggttctgtggtaggcactggtgttggggtgagtatccttgggaggcagcaggttccacacaccagcaggttccaggggagggtgctggggtacattctatgcttcccagttatcacctgggcccacattcatcaatgccagttcctcaagttcttattctttttcatgacagccatttctgaagagttctcagtccattggtggttttcttttccctcttaaactttggtgctgtgagtatggcttagaaaatgctctccctgtggcatgggagagctgtgtgtgtgtgtgtgtgtgtgtgtgtgtgtgtgtgtgtatcctcttacttctatattttaaggtgcatatgtggaggtcagagaatttcttatgtgagtccatgttccccttgtaccacttgagtcctggaatcaactcaaatgccagccaccaggctcagcgccagcgcttttatctactgagctgccacaccagtcctgtcacttacgcttttaaattttaactcagtgttttgtctttttccgcccacaattgttttgccatgtcggcctacttggccagatactcagtgggtagcctaagctggtcttaaatttttggtaatcctctggccttagcctcctaggaactgggattacagacatgagcctccacattcagcttatataactttagaacattttttatttttgtttacacatatgtgtctatgtaagtacatctcacacgggtgtggatgtccgcagagatcagaagaggggccagattccttagagctagaattgcaggtggttgtgagcctcttcatgtagattctgggacccaaacttggatcctctggaaagagagcaagtactctgagccacctagccagctccccagctcacgttttcaaagaacatcttccttcagttagaattatcaatatgaaaatagtgtaaatacgtcactgttaactttcagagtgactgtcacaaggtagagcacttctatgtgagtatacacatatagcaccagcaggcatatatttgcatgctattcacactgcaatgcacctatgatggaacattgtctattgtagtcatatatggaaattattagctaattaactgagaatcaacaaacactaaggctgcccttgaaaccatttcatatgtgacaaaaaaggtgtgtggtgctttctgagatgggacatcaactgagctcaagtcagcagcaggatacccacaatgtcttcagagaacagagagattggagtgccagtcagacttggcttccactgggcacttttgctccagggtctagggcctgtggcagcttgtggaaggcagccccgtctcatgctgactctagagtcagaggggaggaacattttgttgtccccagggtggttggatgttgtgcagtgatgagagaagccggtccctccatttggtgcctctgtgaggccttgcccagatgtagagggccaacctgccttcacacagctgttgcctacctgcccatgacagctcattgtctgactgaaatgatgacacttggtgagtaacatgaaatgctggatgagttacttcatgttgagcactgtcctgggtccagggatccactctgcccgtggctttcctaaaaaggtatcaaagcacagtagtgactggtctgatggctcttccgagttgtctgtcgccgagaagaccatgctggggacacgtgaaggacacagtgcctcacggaacaacaaagccgtgaggtttggtgaggcgaggatttctttcggggcgggagcacaccaggcttttccgggttccagaaaatgtcatgagcactttccttaaaggctaaaaggctagtcacctggacagcagagggacattttcccacctggggagagaccagtcacaattaccgtggtagactcctccaggtacccaggcagtggactcaggctgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacatacacacactcacacatacataaatatactcacactcactcacacacacattcacacaggatgcactcacacattcacacatactctcacacacactctcacacacactcacatatacactcacacacacatacacacactcacacacacattcacacaatgcactcacacatacactcacatacatatgcatacatacacacacatatactcactcacacacacattctcaaggacacacacacacacacacacacacacacacaaaaccacagcataaagaatgaatacatgaatgaataagtgattgtactctctcagcattcttttctccgaggagaccattcctaactatcacacaggaaaggaaacagacatgattgcacacaaggataatgacacctgctcaggttgccataacttgtgcttttccactgatgcagaaaatgacaccctgccaaagaatgtccttggagccattctatgtatttttccttctgttatttaagtcagatgtatttaatgtaagcagttcagctctgagctggaatctgcacagcctcgttcacccccttgtggaaacgcagactgaacgttttcagtttgggctcctccagcaggtgtgtaagctgacagtgctttgcagggtgatggccactttaaaattccacattccaaaatcctgtcagttagttggctgaggaagcctggctgggatttaacagtcctcatgttccagggatctatggatccactgggttctcaaaacagatattatgtagacaagtccatttaaaatatatagtaaaagttaattgaattaagtgaaaattaaatctaaaaatttaaattcattaattaaatgtgtgtgtttaagttcatgcaggcatgtatgtgtgtgtttacatgtgtatgcatgtgtctgtatatgtgcatatgcacttgtgtgtgtgtgtgtgtgtgtgtgtgtgtgtgtgtgtgtgtgtgtatgtatgtatgtataggtagtcatgctatggcatggagctcagagtacaaactgtgtgagtcagttctctctgtccatcatatcaattccaggaattgaattcaggttgttagggatggcaggtgcctttctttcttttattaactgacccatcttgttggccctacattttcaattatatatctatatataaaataacagagtacagtctttagtatggtaaaaagcagtagagttttgaaaaaagacaaacttgaaaggttttgtttccaggcttgaatgctgtatgtgtgtgtgtgtgcaataaacccatgttgaagtcctatgtgtcctcctgagacgagtgtgctgtgcttggtttctgcaggacttttctgtaggcatgttgtttatgttacatgtcacacaaaggcagaggcttgggtacttgtcaccatggctttccaatagctcctcctcacctcctcctggtcacattcactcaccattctcctcaggtcagagacaagaacagagactcccaaagttgttcccagggtataacctccatccatcactctctgctgggaaaatgtaaatatgtcctggctgatggtggcgttatttattgtcataagcttggaagtaggttgggacaggagtggccactggccaagcattacttcctggttccccagggaggctgggctgtatgggctgagctgaggtagaagggggaggcaaagagcaggggcaggagtttgtcagggtggaatgaaggtgcttctgcctcgaaccaagactcttggggagattcatgtccagagcagtgacgactggctccccatggaaaccagtcaccttgttactttggagtctatcagggattcatcagttttcttagtgttggcttgttgtggatagtgggttgtcacttaacctgaggatactgctgcttacctggttgaatagtacgttcagctatgctggcttcctgagcacacagcacgataaaacgagtgctaattgatgtaaaagctcgtctcaaggagctcacactttagggtcctggagcctcctagctccactccacacatgcaaacatgttatctgtggttgaattcaggacctcaggcacatcaggcaggtatactgtgtcctcagcccacagataccttttgagtggatggggagagagtctgcaatttgtagcatcaacaggcagatatgcaaagtgggttgtagagaagtcagtaatagctcgcttcccttgggtagccccgcctgcatctgcttggtcccagctgtgtcctctgttatctccacacataggagacttgagtcaggcaagaggaggaggcatgggctgagcttgtacctctgtgtttaccgtttcctcagctccatttgcccagctgcaaagtgggctcacggagtcctgtgaggataaatgtggggttcagcaaaccacacagtgaatggcagctttcttttttttatttatttttatttttttattaggtattttcctcatttacattttcaatgctatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgggtaatttctctagctcctccttgggggaccgtgtgacccatccaatagctgactgtgatcatccacttctgtgtttgctaggccccggcatagtctcacaagagagagctatatctgggtcctttcagcaaaatcttgctagtgtatgcaatggtgtcagcatttggaagctgattatgggatggatccctgcatatgtcaatcattagatggtccatcctttcgtcacagctccaaattttgtctctgtaactccttccatgggtgttttgttcccatttgaatggcagctttcaatggtacttttctgacttgctgctggtccattttggcagaggtggagagaagctgtcaatgagcaaatccagctgccatcttgaaagaggaagggtaggcaggagagacccagattgaaagaaggagtcgtcggtgtactgcatgtccagagaaggttgacaaaggtcaagaaggataaaggctgaggaatagtgcaaacggctgtgtttcctcccctatgtgtagttctttgagcaaaagccactctagaggccagtgtgtctcagaagtgcctatcaggaaaatactctgctcttggtgtgacccagtgattttatcagcagcctcccagctgagactcaggcacagcttgcacttctggtggctccagggttcttagacatgggaggcattctctggaatcatttttgtgttacagatgtggacgagtgtgcaacagactcacaccagtgcaaccctacccagatctgtatcaacactgaaggaggttacacctgctcctgcaccgatgggtactggcttctggaagggcagtgcctaggtaagaaagagctcctcaaggctctgagagaaattctggggagttgatggttgtcatggatacagtacaatgtgggaactgtaaggaggtccaggtacgtttttctttgggcacgtatagagagctatgagatgaccttacacgtgtgaccatccattaaaataagttttcatcatcactagcattccatatgtttttttgaaattacattttaagggatttggcaaaaagttgctgaaatcttcaggaagcttatagctaagccaggaagtggtacaagtgagggttattctaccctggttacacatagtcctaagccaagggaatccttttgcttagttacaggaatgtttcacagctcaaagttagatgaagaatgccagtgtcatcctttctagctctgacacctgccactccactctgcccacccacagctgtgttctctccaaaggtgtcactcatcactagttgacagttttatcccttgcagttgtcattggctagggatattttttttttcttatcctctgaattttcatttagccaagttggcttaaagttagaatcaaacaacagtatagaatatatacataagtggaaacaaacaaacaaacaaacaaacaaccaaaaccaaaaccaaaaccaaaaccagaaaccgttcttccaggtctctggattgaggctgaatttactttgtggactatctgaagagtccttgaggcacgataagctgcctgatcttggcctgcttctcctttccaggcaggcacagaagagcacatgggcctccgggaatacgatagttcctgtgcatttaaaccaacctctgctctaatggaaaatgtgatgctatggcttgtatgtaagccggccagtgagagggagttatttgtgcaggaacttcttcttatgtagaattccagagctggaaaggatgttccatattatgtcatctaacttttatagagttggagacaaactcaaagaggaggaacattttggataaacttaaaacaagtcgggtctaatattgatgtctctggctttcccagtcagattttttttttcttaccacaaagggcactaagatatgggacagggtacatgggctcattatagactcatagagggcagatctctccatctgaaagatgccaaaagatgttgctcttctgcttgtcaatttgttctcttccacagagcactgtggagagctgctcattggtacatactttgcctacatggtatggtccattagcattcacatctgacctacagccctttcttaattttttgtggatcctatgccttctcttggcggaactcttctttctctttaacatgtgggttccatagctacccactatcccttctgcacacagttggagatttaccttttttttttttttgaaaaatgaaggctagggtttccttcctaaatacccctgaagagagggtaccttctctgcctctgatgcctctccaggcactggtgatgttcccaattgtgtcttgggaggaggtcagaattagcaactgtacaagtcaaaatgttttccaagtagaagctgcccgcctcagaggaatgtagttgggccatgttagaagcaaattggacagaagataaagcagaatcccaaggtagggcacagaatgtggtgaaggctaaagaaataggcagtgggttgggttgggctggtggtgggggaactctttctagatgtaggccgtagaacctgagcacagagagcaaggcctgaagagtgctatctatatgttactaagagttgaggttccagggaggggacgttaggattctacagcacagtagggatgatgtaaagtccagtgactgcttcagtcagatcatctggtccctgagcccacataagtaaaggacactgtcctcccagagatcggagaatggggctttcactggaggcaccttgcctcaaaggagtgagttgtctagcccattcctcctccccctttttttagcccaggatgttataaagtgcttttccaatgacatcaggctccttataggctggtgcatgttacagggaggtcacatgtcacagctctgctggaagcacacactccccattgtattgccactttccatggctcagatgtttctatcatgtccactccagagctgaggtgagcacaaacatcctcccatcaccacattcatagatcttactgtaggactgattgcccagctcatgctgatggcccagtatcctgttcctgccatctggacatagccattgttaatagagctggcagacagttcatcagagcgctcctgctgattctttacatgctaagctaacttgttcacgcccagggtactggaaggactgtagagaatcatagtattgaaccttattattgcataagtcttagttaagcctgaattgggtaggttctgagaagccatcttgtgcttctccctatcaaatatccctatcaaagcagaaaaaatttgccacaaatttcaggataggttcagttgttcatgcgacagagattgtttggggaagtagaaggttacaaggaagctgagcactgtggtccagtgggttcatcattcctgaaatttactaggttctgttgtttaagcatccatcttctttctggccccatcctagaagaggaagacaatgatactaggttgatggcggcctcaaggaagagtcctgtcttaccttgcctgaatttgtttctagatattgatgaatgtcgctatggttactgccagcagctctgtgcaaatgttccaggatcctattcctgtacatgcaaccctggtttcaccctcaacgacgatggaaggtcttgccaaggtatgccatgtgcacaataacttggacacagaatgaaacactagatacagtgtcccagcaaatgtgggctgtttccagatctctggtctgtatcaggagtacctattgctcagcacaggcaagggagggttacctttcatgaccccctcagaaggctccacaaagcagattaaagcaaaggtacttgttgattttcgcacaatcacttccaacatgggtcagtaagaaaagcaatgtttgtctgtcatggttcctattggaaagctgctgctctggaagtcaatgaaggccttaagaccccaaaactaatataagtcatgacctgctctgagttctacctctagctccggcctccagtcccgagcactggtctggtctggatggagactcaggatgaggcctttattgcagtctgccaccgggtttcacaggcccatttccttgtcacactatttgagtgagttctggcgtgcaggcctttggccagctacttagaggatattatgtctccattagtttaatcatatctaaatcactgggtaaacaggaaggcttcagccttccagggtttgatcctgaattctttatgaggctcctctaaagctggtcctgctaattgttccaagaagcccctgcctgggctccttttgcaaggagtggtcatttttttttccttttttgtctgagagcagagctgggcaggagtttgaggaaataaataaaacagggcccttccttcccactggagtagggagcaggcgtctggctccctcgctgttgtgataagctgcttagggctgacgacaagttcttggggccaaggctgaggttagaggtgccagcccaggttttccctcagaggctggcacggtatactcgggcagcatggccacacctgggcacttggccaccaggatattgcatcagaagggcccacaggtcacacaggctgttacagatcctgtcaagcttttgcaatcattccacctcacatctcctcaaagggcttatgtcctgcaaacctcactggccccatcaatagtcttatagacaggagtgtttgtggtcatgatccacagataaagaaaccaactctcacaaaggtgaagccacttggtcagagtcaggtggcttgattgtggcagagttgagaggaaggccaagggctcagtgaatcagttggggaaccttgccctcaggattcaggctgctggccagtaacccccgtgaatcctctgctctccacccctctagctctggccatagctcatgcaaccatgcctggcattttacacagtgctggagatctgaactcagttcctcatgctaacacaacaagcgcttttcagaccgagctgttgcctcaggtccaggcccttgggattcagaagtaaccactggaaaatctggcagagagaggccgtgagggtgcaaggggtttaaccctttctgttctatcaaaagtagttttgagcgatagaagcagcattgagctcatttttcaccaattggcaaatgtctggccagaaactgaggacaccagccccaaagtgcagcaacattggcctatctaaactggtatgtggcttagtgcactagggacatactcctgcccagtcccgcccctgtctggatggagaaatgcccagtctctcatgagtgctgggtgcgtgggcaccagagcagcccggtatctcaccagacccttcctacatggctgttcatttgtttgtttttcctcttagggctccagagttggcaggaagcaggcactttgtgggcatggaattagccttcccctatatgaggcccctcaaaagctgcttaccacaaaggcctttacttctgagaacattcaaagctcttttcagagccttaagaggcttaactggacttgtgaagtggagaaaaagtctcttaactagaactgccaccagaggcatgtgacatgtgggagggggtacttgccaagggtcagttgatgccagcatcagaaagatctccttccctctgtcccctacctcaatgaactatacaaaatgagtcctgtggattttgaagggattcctaactcatgctgtagttctcaccaggcccttgttggcatgtgaattgggggcaagtctcttaatgttcagaagtatgaaaatagctctgctgatgtgtaattgatacacagtataccacatgaacccatcactgcactgaggaggagggatctgccattactctttgtcctctttgtaatcctttcctttccctatggaacatgaagaatgggggaggggcaatggtctgaaagcagaattgctacaagaataaccggtgaggttatttattcataacaaacatattcgcagaattgctgcgattgtttagctgacacaagtcagcgagagtgaagagaggagcaaatcagagatgggaaagagtgggttctgcctgggaattctgtgggtgagtctgggagagcaggcttcctggtaggtacaagtgtacatacacatagatgcagtgtgtgacatcttcatctcccttctggcttgccactctagaagggactgcatacagaggctctcgatcttcagggtacctgttggggatggtcctagttgctttccttgtggttgtaataaagcatcctgacagagcaacttaaaagacaaaggacttatggttcaagacagaaggccaccatcatgtctaggccacagcaggaggaggcacctggtcacatggcacccacatggagcagagagtggtgaaacctagttcttgctcactttctccgtgtactcagtgcaggggatggtgctgcccacatcagtaaattactcaacaaaataactctcaggcatggccagaggctacattctttataggtgtgcctgaaggctcatctggatcctgtaaattgacagttaatatagtctcacagaacatgagatcatggtctgataggtcctcggtgggggatccttggcacctaggaagctgggctcttggtgatagattttgctgccaattcatgtttctgctttgtgtgtgtgtggttgtttgtttgcttgtttgttttcttttgtcacactaatagtgatgcactttggttttgtacagatgtgaacgagtgcgaaactgagaatccctgtgttcagacctgtgtcaacacctatggctctttcatctgccgctgtgacccaggatatgaacttgaggaagatggcattcactgcagtggtaatgggctgggcattggagctgtccacctgttcagagatccggggctggggcaagggatttatcacaggtgtttcctctggtttcctggttgtgtgtctagctggagacatttcccagtgtcatgggaacataaccacacagaacaaagatgagtcacttcctgagacgtggagttcagtcttaccttcctggtcatctgactttaatgagaagccagtgtttggatctgggatggagttggtgagagcaagaactcactcagttttgccagttgatctgagagtttcctatcctttgccagcactggcctaaaacctgaaaatggtatagatgatatttatggaggactgtgatttaggggtaattgattttgctactatgttagaaggacattgagtaaataaactatacatatgcatgcacatactttgggaatgtcatcaaataatcatggtccagcactaggcctggtgcacagtgagcattaaatttaaatgaaatgaacatgaaatttaaataaattccatccaagcccaggtgctgttattctcttctcaggctagtttcttgagtccgttgtaattcttttttttttttttttctcccagaaagttaaattcctagatagtcagaaaacgatcatggaagttagaactttttgaaagtaagaaacacatttcatttacattttgtctgtagcatcccatacaacacagatcggtgggctcatttgtttgtctctgtgtctgtctgtccccccattctttgtaaattttttgttaaaggtaagatcatcccaccagctttaatgtcctctgcaattgtaaattagctcagctcacattaataatgtttcctgtgatttttcaaaataaaagcaggcagtgctctaggtgtgaaaattatccagcagaatggaaagagacccaatcttgagtttcaccataacagggacacacagaggctgtgaatgagacttgtttactagcttctcttgggactggaatgttctagggacagagttctcagaaacaaatggctacctctccccagggccaggccaccctcagagtcacagcaagcagttacagagcctcagcctgattaaataccagccccacatacagaactaaaatatccaagggcatgaaaggcccctttcttcctctgtttctacttcctttatggcactccttagagagtctgggccaaagaactgagggatgtggaaagctttgcattatgggatgggattagtactttctctgaaattacctgaaatcccatagatgtttattgaccactgtcagggtcttgaggtagggactctggagctagatggatctgggttcaaactctgcctctgttagtcatcacttcttcccatggagtttttcaggccttggtttcttccctgttaaataacatggagtggttgtaaagacaaattggtgttcctcaatgctatggtcacttagtgagttttccctaagtattagagactttggacttcacgaggagctcaaatcctttctagtttggcagaatttctcttttgatcctaaatgacctatttattctccatggtcactgaataacacgttctaccaactttactgggaaccctggtctcagcaggccttgtagacagctagaagtgtcctagggactgtgttttgtgcactttatcctagatactggggcactgtcattcttagttggctctcaaagctggggtagtccctctttgcagcaccagatcccttgtccctgtgtcctcccgggatttgctaagccatgctgatcctagaaatgagatagggtttcacacggaggaatggcaatggcctgatgtgtactccctgccagacacctggcttctatttcagcttttcagtggagggtggagctacaggcctttgtggggaaaaaaactttctgggatttctggaattgcagatattaagacaaactagagtgtagtgagtcagggaccctccttcatccagtaggaggtaggttgggcttttccttcctatcctacactgaagctaactttgctggggtatttctcctcgcacattggcactcccagatccgatgattttagatcctgagcagctgttactcaggggatgttacctcatcaagtgcatcagagttgctctgaggctccacattcagatccatgatctcctatttaatcatttgatctatgaacttggtctagttgccgaaatcctgtgagcctcatttaaaaaaaaaaaatcttttaattcaaatagtcataacaccttcttctcagggttgaggtagagattaaatatgagacatgttgaacatttaatgtggtggttgatacacagtaggccttgggaattgatagatatcactactgacatctcataaaggagttaatgaaacccgcaaactacacagaaacgattggtgacatgtcacgatggagtggagctggggacccccagatttctctgcaaagctggctgaggattggataatactggagcatgctaactccagttagtgaattacatcctaaatccaccgactcttcacccatgggcaagagacagctcagaaaaatggggagaggttcccttcttgggtaaagaaaacattagtcatgcgatatgtgggttcttcaaagacaaagcggcagtctccttcatgccaacactctcggggttgatctgagccgtcagtggtctgtgagttacagagtagtcagaggacatgccacatgggaaccagggaaagcaagtttttgggaaacaacaaatgcaagaaaaacatgttttctttggcgtgcctgtcaaatgaggcgcaaatggggcctgtattgccaaattctgtgtgtgatcaagaattggcttttctggaatgcctgctcctatgtcagctgccaaggtctatgcagagtaatggtagcattgttgggacagtgctgccccctgccctcctctgcaggatggttccaggctagctagctgctgctgtatctcttgttctaaggaacatctgaggcagccaggccaccagaggcattgtacccgctctgctccttgactcaaatacagggagtaagctcaccatcggtagatgtggtcaagaagtaagttggcaacctcgtagccttgaagtcattgtctcttagggaagagaggtagtcggtgaaaataaccaacagctataccttgttactctcagatatggacgagtgcagcttctccgagttcctctgtcaacacgagtgtgtgaaccagccgggctcatacttctgctcgtgccctccaggctacgtcctgttggatgataaccgaagctgccagggtaagactgcccacagggactggtggagctgactcaggtggtcatctggatgtatcctcctgtggaatcttgttgcttcaggaagatggcagagttgggtgtggttgggcctggaagatctgggaaggatgtctgagtggatatctttctcttctctctgagtagcctgtcctctggccaggagaggggggtagttacatgtgtctgtacaatgacctctgtagaggtaggtggcactttctgagggatggtttctatcttgccaggcagatcgacctctgcaaccccaagaatgactactttggccctaaccaaggcctcttttagctaggtcccactgagtgtcggctttctcgtgttgccttgaaggcagcttgtctagctggctctctctgacttcctagagattgaatactggggttcctcacagggtccagaccctgaatacaaaatggctaagccttcttgagattgacagtcctgcacttgatcccttgcagaatgactgcccctttattaaccttattcccaacaacatgtaagaattatccatggtggtgacagacatcagaaacgtcactcaaattactatgaacgtgggctttttggcttacctaatctactagccacacgaaaaataatatagacaaatagatctagtcagttttaatgctatattttgtttaaagccatgagtccaaacattttatagttttaatatatactcaatataaaagttgctgataagatgctataaattctttttactgaagcatagagatcttgtgtctatttcctgttacaagcacatctcaattttcactgcccatgttttgagtgcccaataactgtgtggaaccaatggctgccatattggatgacaagatgcaagtggctctcactcttatcctccccctcccccacatagctggtccagggctaacaccatgcttctcctctaccctgcatttcagatatcaatgaatgtgagcaccgaaaccacacgtgtacctcactgcagacttgctacaatctacaagggggcttcaaatgtattgatcccatcagctgtgaggagccttatctgctgattggtgaaaagtaagccaaggctaatccttgggaagtggaagggaatggggacctggctcaggagactgtcagtatcttatcaaggagctttcctgagccaaggagtcaggagatctgctctagtcaagtttctgaagtcctaaaggcagaccaattactaaatcatcacatggctagtaataacattgagaagataacttcaaccatttgattttactgggatgtgttttgcaggcctggagtcctctgtgtttcttttctttccccttacccccgctgctggcccatctctgttcctcatcctgcatggaaagcatacgtgcacagcatacagcacagacatgtacaccttccctcctttctaccgtcagctatgagccccctcccctcagcaactgcaaaccctcacagtggagatgaaggactggatcagccacagccatcccattcttctctcaaagaagattcggggcttacaagtaaaattcctgctgtgatttaaaaaaaaaatggaccaaagatgaggacaaagtcaggcctgggggctccttgagaggtgttgtcatgtgttgctataagtagtacttcctagaaattctttagaacagggacctcccagtttctgattccagatccccaagtagcccaatagagcactaaaccactctccatgtttgggtctctctggttcgggaactgatgttgtccaactggcaggcttgatcagatgctactagtgaaacctctgccctgaaaaagcttggtaacttcctccttctaagccccagagccacgtgatggccatctgcttccagctccttgtctgctcaggagtcctgtacaggagcactgccagctggaacaaggtgtgttctcaccttgaccaacacccagtgggcccagcctccccgagtttgtgcatatacttcctcccagatggaaggcatttctttcatctcctcgtggccagaccaactccatctttcagttctctactcagtgcccctctcccagctgttcacgatcctcttcagctgggagccatcactcccctttccaattttcttttaggaaacaattattttctctctgacatgtgacattttaatgtgatcattttggcatcagggctattttgacttggctgctcgctcagttgcagtcttaacaacatgatactttgatgattctctgtagtcttttgcttgttaactattagtggtgctctgttttgtgctgggcactgtagcttaatggcatgtgggagaaggtacagtaaagaaactgccagcatagcagctccattatggggcaaggcttttaccctaagaggaagaacatatccagtgacaactggaagagcccagagcagagagaaagagaaacagattggacatagccagggcaagggaagccagagtgggagaaagaagtggaggtagcaagagctagtgagagagcaggagaaagcatgagagagtgtgaccagagggtggacatatcctgcagagaaggcaaagcttcagggagggactccttttggggacagaaaacctgttccacaagttccagaggaatgcttgcttttatctaaccaccagaaatccttctacagtccaatttgtgctcatttctggctatatgggcttcctgagaccaccaaaagtctaggagtggagaaagacagcaagcagattggctaatgaatgaatacataatggcagactgagtgaggagtttatagacaaggaaagaggaagttggacctgttctgggaatctaaaggccccactgagagaatgacctttggatagggtgagaagttgagttgacattaactaacaagagactggaagagcagaagggaacagcatgtataaaggcaattaaagccagggtggccttaaagcctacagggatcacaggaagttgagctccttccccataggaagggtaaagagaagtggcctgagaaaactgggggcagggtggacaaatccagaaggttcattagagtccatagacgctaaaacttaagttcagttttcactcgggcttcaccgagggaccactgaagagtgcaggagaccgtgtaacctgacttagcttgacaaagggcaatctgttagggggccatcacagagacccaggtgagaaatgagtgacagagtggccagcactgaggggtgaacactgttatttttaggtcattgtcccttaacttccagtctacctgcaaacactgtcagttccacttccaaaataaattctaagcccagatgcctctttgcatgcacctccaattgtgcacgctgtcccatgagggggggggggaggttcaggaatggaggaaagatggataagtcagcaggtgtctctagtaggcattccttggcaacagatgcctatggctttctgttgggttatgttattcctagggttagaaattatctgctttgtattataaatatttgtgtttaagaattgtgtatttctaaactgcttgaggacacggatgttacttaatgttgaatttctgaagtgtccagtgagttctgagctcttaaattatagtccatgcctgctgagctgagctgagtgcagcagagaatgtgaagccatccccgaaaaccatcggcctaatataatttttatttttatttttttaaaaaatgtatatgggtatatttgcctgcatgttatctgccatatgcatgccgggtacccaaagaggccagaagagacctcagatcaccctggcaatggacttacagacagttgtgagctgccatgtcttggaatggagtgaagatagattgtgagctgccatgagggtgttgggaatcaatcctgggtcctctagtagagcgaccaaggctttttaactgctgagtgatctctccagcctccacttttaaatatttttaatacatgtccttgactgggaagtgagggctatatgaccatcagcacatgtctgaatatatgacgcatacgaagcataccggagaatgttccagggttctgatgaccagagatccaattacattctttagtagccagattacctgatgccaagaaagctacgatctaggaagcagatctcatctacattctaggaagccttcagattaaaactgggagtagaggtggtctcctgttacaccactacatgatgagagcaatttgattttgttttcaagtgagggaggaggcacagccagtgcctggaaactcatatggtttctctcctgtcagccgctgtatgtgtcctgctgagcacaccagctgcagagaccagccattcaccatcctgtatcgggacatggatgtggtgtcaggacgctccgttcctgctgacatcttccagatgcaagcaacaacccgataccctggtgcctattacattttccagatcaaatctggcaacgagggtcgagagttctatatgcgggtaagagggagtgtgaaccatggctgccatggttaacaatggctgccatctttaacagtgactgccatctttgacaaaggccactgtctttgtgcgtgtgcatgtgcacgtgtgcgagtgtgtatgtgcattctcgagagtgaacacatgtcaaggccaaagatcaatgttgattgtcttcattctattgctctctaccttcaccctctatctggtgatttctatctttaatcttcttgctatctgatgatttctatctttaataacagccttgtgtggtctagtctacagccacagtcacatttcatggaagcaggtatatatatgtgtgtgtatatatatatatatatatacacacacacacacatatatatatatgtatatgtatatgtatgtatatgtatatgtgtatatatatatatatgtgtgtgtgtgtgtgtatatatcatataggaagtgtagaaagaagagaggaggtatgagcccagtgctcagagactcttgtctattactttctgcatggtcttccttcgtgtctcccaggagctttgtctgtgaaaggagaagttaggccatgacaggttttagtttcaaaactatgaaaaggacttcattcctttgcttacacatttatttacattttgacaagtatattataacttactatgcatatttaatagctgaaaatacagcactaaaaaaaacctatgtcctcactctcctagtacgtaaatgtcagcaaaaaagaataaaaaaagcgtagttctcaggtgtggactccactgactttacagagtgagcattgacacttctaaaatctgaactagttaaaacgaaatataatgtctttcctggcacttgtcacatctcaagtgctgcttagcacctgtagctatgctatgaaatagctcagatacaaaacactgtaaaaagtttgaaaacatgatagcacatgtcctaaaatgtgtttactttgcataataaattatgtaccttcaatactatgccatgtgtatacctttaatactatgctgtgggtatacctttgtaccacaccatggatatatttttagtaccatgacattcacatgactggacttctcatctcttcagtccctggaatgacttacctacactgaatggcctataaccacttttgtcatattgtagtatgcatgtaaccattgttgagggaaggttctagagcttcatctctatagacaacctctttcagatggtgaagccagagtaatatctacctgagctctctgcattggcagttggagacagggatccctcaaatttactggccagccagcttagctgaattggtgagcttctggctcagtgagagaccctgtctcaaaaaagaagtggaaccaggcatgatggtatccctttaatcccagcactcagaaagtggagaaagaggtagatgggtttttgtgagtccaggctagcctggtttacgtagcaatatctaagtcatcctgggctatagagagaccttgtctcagaggggaaattggtagagagcgattaagaaagaaaaagactcttgatgttgtcttcttgttttacatgcatgtacacacatatgcataacacttacatgtacatgaacacacacacacaaacacatgtacacaaacatgatgggatattcctttctgtggctcttgtagcaaatgaccccatggtagcttaagacaacagaaatatttttctttatacttttggaactcaaaatgtctgaaattatttctgcatctaccccaatgcattgcagggctgtatgtcccatgtctagaggagaagcgtttcctatgtcttctagtttctggtgatcactgcacgtcctgtgtctcaggatttctattgctgtgatgaaacatcaggaccaaagcaagctggtagcaaagggtttatttggcttaacttccttccacattatagtccatcattgaaggaagtcagggcaggaattcaaacagggcagaagcctaaaggcaggagcagatgcagaggccacttagagatgctgcttatggctcaccccctaacagttttatcagcccttcttatagaacccaagaccaccagcccaggcaccacccacaatgagcttgaccctctccggtaagtcaccaagtaagaaaatgccctacaggtttgcctacatctcattttatggaagctttttctcagttgaggctccctcctctccagtgattcttgcttgtgtcaggttgacataaaactatccatcacatcctgactgtggcctagtcacgccaggccacttatacattattattcctgcctccatctttgcatatggctgagtaccctttgccattctcttacagagagccttgtgacttaggaacaccagtttccctgggttcagactcttaacatcatcttcaaaattttttttcttaacactatttacttctcacctgaaatgaaacctcatggtcacaatttggtccactgaacccaggagcctgtatatgatcctctagagtcaccattgggaacaggcctatggatgttttatatagttaatttgagacctattcaagggcctatgacagagccatatctctgaacgtcatgcttgcccctgaagctgtcaatcttagggagtagtgtattctcactcgtccctaagacattatctactatcagcagaatcaggtcatgtgtgaccacctgacttgtggagctagtttagagctggctcagaccaaagcagaaggatcaaaggcttggggagaagttggcagaggtagtggaggactttctgcaagatgaaagagatgaatggatggtacatgtgtgtgcatgtgcatgactgcttgtgtgcatacatgcatgcatgcatgtgtgtgtctatccttccttgagcttatatgcactggtatgtgcaagaaactcactcctgccaagtcttgatgggcttactgtaagccagcccatcagtgtccttcatctggaagcacaggagtcctagttatggggcaaagagatggctctctcccgttagggatttaagacttcattaattcttgcctcagttaaactccagccccaggcagagcaagagctctgtagaggcttccctgtctaggcaacaggtccttcctttgaatgccacccactaaaatcccccaggccccataatcactctggtgaccagcctgagaggtgcccagggatggtagaaaaaggagactaccttttagatggaatggccaggagagagatcccattctttggaatttcctctgggcctagactgttagagtagctaaggaacactggacactgagctcaaagctgcatgtagcttctatctccctatgaccaagaaagacctgcaagctctttttatttttattcagaagaggcatagaagcaacaaagggacacaggcctgccataaagataaccaaagggtcttaagggtgggggaggaagccaagatctccaagactgctcctgagaccagacaaaggtttgggtgagacttggggaagtcacagggcttgagggtggcacactgaaactgatgggatcaacgggcttatgagcataacactgtccagagctcagaaccttgctcaggaggccgctcccttttgtttactgtgatggggctaagtcctgttccttggtcttctccagttttccccaatcctgttatcttgagcatgttatctaattgctcgcagtttcaatttcctgatctctagagaagatcctaatgttatttgctttaggattagctgaagtcattcacttagcatggcatctggaacacgggatgactttgacaaatgtgaaaggctgaggggagggcatgaacctgctaagcactttgcccattttctcccctgctgcctcaaactgtgcacacctaggcgacatcatctcagcttgcttctgtaagactctaggaatgttccttgacaactgtcctactgtctcattctctttcaccaaagtccttgctaacttacatagaaactacaacctctgtatctttcagtgtcaagtttctgaatgtccctggtgaggcagtccttacggcccctttcttcctctctcagcaaggatagcactactttttggattctctaggattagaggcagggtgcatagatggtgagatggacacagggtgagatggacaaacagggtccatatcttgtcactgtagccagaaatcatgcctgttctgaggaagacacttaaatccttgctacatcatgttggatgctgctgctgctgacgcttattatgtctatgggtgttccacttaccatttccctgtatgggcagtagagtctctgactggctacttgccacatcaaacctctctttctggcattattgtccacatagattttcggtggtaaagttggcaggttgccccggcaacctgaccagcagccattactcagggcctggaatgtggggtagttttgacttattcttctagtgttaaggtctaagaagaacatcctgttgcaatggaaagcatttaataagtggacactgctgttgccactgctactgctactgcagttttaagaaagagagcttggaaaagttgggaatgctacccaggcaattggagcatcatgtggccattcaggttctcccatactgatgttcattggtttttataagaagcacttgggagtagcattctgtcagtagacaagccatattacatttgcaattacacacgcacacacacccattcacatgcaaacatatgcatgcatgctcacaagtgcatacatatacacatgaacatatgttatatgtacagacccaaggatgcatgcacatgcgtctctacaggcatagcctgtggggtcatatgagcagtctgtcaagagctgaaccttggacagaagtctaagtctaatgcattagtgtttctcacagacaccttcaggacaaggtccttaacaccgttggcctgccttgaagcagacagtacaaactgacaaaatgaatgaatgggtgaatgttgtggctattttcccgcacagctgtccctgctgaagtcctggccctgggctctgagtttgaaagggctgagaaggaagtccgcataaggtacctgcacaaggaggtaccaattatgtgtatgctgatggaaatactgaaagctggtgccaggaggaaattgcatggctgtaatggctgatagcccaatggacaaggcaggcctaatgcttggcccatacctgcctggcagccccacctctgtcacaccagtgagcaatcttggaggaggtgccaagctttgtggggagccctccctctatggagacaaagtaaatgcttagtgtaccttcatccaggccaagttccttgatttcatggagtttgttccattcattttctgggtactgcagcttctgagaagtgataatccagcctgtccatgttctcactcatgctgtttcctctgcagacatctgtatctgtctgttgcattggtcctgggtacctctattgagggcatcacaagggagaggactcaaagtccatcatctcttctgataattgttgaataatgaaaaagaggtggaggtttacaaccatcatctcttctgataattgttgaataatgaaaaagaggtggaggtttacaaccaggcagaaaaaatgaaatggaactctccagctctacccctggatgaccccaatcaattatttaacccactaggcctcagtttgtttgtccatagaatggaataatgagctatacctttaggataatccttacataagggcaactggcccccatcacaccctatcccagaatttggtgcttttaggtcagcattttaaaattatttatgtgtccaccaagtacccggcaacctgataagctacagatcctagctcaatagatctttggtgagcctaaaatccatgtttctaaacagtggtaccacactgtattctagggatgcagagatggaccaaggctgcaacacatgtgattatatatagtaagacattcattctctcaacatacagtaataattcactcatgtgcaaagctaaagtccttgtggcagggtctgacttagatttgggactcagagaaggcttgccttagggaatgatctttcaggtgagacctaccaggtaaagagtgggcaaagctgagaaaaagtccagcaccactgaggtgctcaggtgacctagcttcacggaagcaggctaagacagcatcctcactgaagttgctgccaccagacatctcttccactaacatcgtatcatttttgactagttcccctggttctgtccacagcaaacagggcctatcagtgccaccctggtgatgacacgccccatcaaagggcctcgggacatccagctggacttggagatgatcactgtcaacactgtcatcaacttcagaggcagctccgtgatccgactgcggatatatgtgtcgcagtatccgttctgagcctctggctaaggcctctgacactgcctttcaccagcaccgagggacgggaggagaaaggaaaccagcaagaatgagagcgagacagacattgcacctttcctgctgaatatctcctgggggcatcagcctagcatcttgacccatatctgtactattgcagatggtcactctgaaggacaccctgccctcagttcctatgatgcagttatccaaaagtgttcatcttagcccctgatatgaggttgccagtgactcttcaaagccttccatttatttccatcgttttataaaaaagaaaatagattagatttgctggggtatgagtcctcgaaggttcaaaagactgagtggcttgctctcacctcttcctctccttcctccatctcttgctgcattgctgctttgcaaaagtcctcatgggctcgtgggaaatgctgggaatagctagtttgcttcttgcatgttctgagaaggctatgggaacacaccacagcaggatcgaaggtttttatagagtctattttaaaatcacatctggtattttcagcataaaagaaattttagttgtctttaaaatttgtatgagtgtttaaccttttcttattcattttgaggcttcttaaagtggtagaattccttccaaaggcctcagatacatgttatgttcagtctttccaacctcatcctttcctgcatcttagcccagtttttacatagaccccttaatcatgctttcttaagagtttttacccaactgtgttggaagacagaggtatccagactgattaaatatttgaagaaatcttgtgtttggttaattatgactccatggataatttagtgcttggggttggttttgatctatgcagtggcttggaaagttctctgaggggctgaaacctccttcataactgaatcaagatggcaaaagatggggaactgagaaatgaggatggtggagaagtgagggccagcatccaccccaagattttttatagatgctttcttatgtggtctgttgtgggttgtctccaagggcagagggcagagggcagaggacacaggacacagggccaaggatactaaggatacaggccagaacatactcaaatccctgtaaaccagtgagtggcccctgaccctctgtagagggaagcctgattaagcaggaaccatccccagaaactgttgctattgatcctgggtggggcctgagaatcaagatttgttaaagaggaataaatagcaaagttgaggatgaaatgtcagaggtggggggaagtggctagtgtggcccaagtttgggttaccttgccttcagcacctgtatagtttcttccagaacttttaaatcttgtcatcccttcgatggtcaggagctccgggtttctccccaggcagatgtaaagagcacaaggcacagagaagagatcaggttagatggctgcccacatgacattctcaggaatggataggagacaacaggaggagaaaatgtgttccttaagacccgaagacacacctgaaggaccaggctcctatcctacctcttggtgataaattcctccaagatacccaggtctgtaccctggacccccaggctagtaggcaacagattaggtttttttttgtgtgtgtgtgttttgatggtaggcatagactgtgtgtgtgtgttttgtttatttggtttttttgagacagaatctttctatgtatccttgattggcctcaaattcactatgtagactaggttggtcttgagtttagagatctgatttcgtttacctccttgtgctgggattaaaagtgtatactacccccaaatccataggctttcttcagcagaggcaaaaaagcattaccacctacatctgagcagccccagcctttcttaaccagagtgtgtctcacgccacaacacatctctgcctcacttttcccccctaactaaaaccaagtccattctaaaccatgtccatcagtgagccttctggcaggctcaggtaacattagtaacacctacccaggtggcggagaggattctatttggaagcttggagaaagggacaaatcccttcagctaggctttctagagctcaaggctagaaggcaccctctaattcaggcatcctgagtttgaggagtcttaggagttaaggacagggcagagtagagacgctaagtgccagcactcagagcatccacaaccattggcccaggctcagcacagcatgggctcaacttgcgtcacacagaggctgaggagcttggccttgtagtttctgaacccattgctttccaaggtgctatatttggaactagactccgagtaagtccttagggtttactttttagttgtcattgtctaaatgtggcttcctgcttcgaagaaaaaaggcacccaaaggctccacaaaagcaggctcaaaaggcctcttggccattggattgctctttcaaaacatcactgatgagttcagtttaaatgaataagaagcatgtaggatgaatttatcttaagatacacttgggcctagaagttcaagaggagaatggcctgtggcagagtgtgtactggaggaccaaacccaaaatattcagaatggttctagaggctcccagaacccaaaaggctgcttgttttacccacttgttggaaacagttggatttttttttcctcccatggctaagggggcggaggttggcctgctggcagaattacagcattgtactctaaagtggggtctagtggattggctgttttggaagccctaatatatcagggctctccaggctcgtctcttgtcagtatggctgcatcctggagctgaagtcttccaagtcaaccctggttccatcagatcccaaagaatgaagcaatctatgaagagagggtaccagacaaagatccaagacaccagcccaaatcctgtgttcccaccacctgactgactgagttccccacaggtgaatacttccatttagctgcttctgactctaacgttctcagaggccccaggatgtactttggggatgacagccagcatttccattaaagtgcagttttggagtttcacagaagcgtgccaatcttaacacacttcctaattggcacagaatccttctacctgttacccttcaggctccggtaacacactcagtttttctttaggtaacagtcttggactcaggagtgttatttgcccagatggtgaaatgtttaaggaggtctgattatttcattttcaatggtttaaatgtatttttgtggtctcagtgtgaactctactgtgcacaaattgtttattctgagccaaagagccactcagagagactgactgcaagacacaggggcgactaccatttcttctcatctttccagatgaaatccaagtggtaaaaggtcttcacttaagagagtaccatgctttattgtttacaaatgtttttccatattcatgagagtaatacatgtataccatgaagtatgaccacactcctcccatttctcctctctttattcttccaatctatcctcctcccagcttagtgtcttctttaaaatttttagttttgataacccacaaagtcaaattagcattgcccacatgtgcatggtgttcagctctctactggaggatgggaaatctaccagtagccacaccctaaaagaggaatgattctcccttacctgctccagcagctatcagctgccagtagctccccaatacagatgggggctgtgaagcacctttcttgaccttgctgaaatttcaactggcttgcccttgtacaggtcttgtgtaggtcatatcagctgctttgagctcattagtgtggtagccgcattctgactggaagacagcatttcacagctctcttcctcagcttcaggcttttcccacctcctcttccacagagaaagaacttaggttgaacttattgctggactcagaaccatggtgcaccgttcactggggacacatttatctgactatctatgaatcaccagacaaaactagaacatgacctcttttagttagagtttagtaattactaagccatatctattttgtacaaccaaaaactctcatgagcattcatgggcatgcatttgaaatttataataaatgccctttgtttgaaaccattaaatacatttaatagaaaaccaaaatacatggcatgtaaaaaagtttcttttgggttggtggggtgactcagtggataagggtgcatgcctccaagtctgatggcctgagttcagtccttgcagtctacgtggtagaaggagaaaactatctttgagagctaccatctaacctctgcagctatatcctcatccatacacatacatgtaggttctccaggagccacacatgtgtgctcagacagacaaataagtacatgttaaaaacattaaaaagtaatttgtttttttatttggcctgtgatgcattctgatatttctctcctgctctaaagtgagactttagctaaactcttgattggttctagacttgttcatattcaccgccacaccagcaaacatacacattgttctttacatagaggtttttgtactgaaatttcttagtccctttatttagcagatgtttggagtcctcaaggataaactaaaagatgcttaccaaacaaaccaaaaacaaaacaaaacaaaatccagaacacacacacacacacacacacacacacacacaaacaaaaaaccaaaccaaaccaaccaaacaaacaaaaaaacccaaaacaaccagaggctccggaacgaagggatgtacaagagtcatcatcaagtgtatttcttgagaagaccatcttcactcacatctccgacttgctaacaggtctttattatgactcatagccagcatctaacacagaaataaactatggcatgagagggtaagtgtcaacttgcaagtgagcattgctggtgtcttacagtggctacagcaccttagcagggccagcaacagcagcaccctcccctccaaggaatttggaatattcttgatcggaaatgtgaaaatgaaggcagaagtatactgcacatagatgcaaatgcaaacactacagtgacatccattgatgaagattctattcattattaacattgacccagggccagagagctatcagactggtcgatttcacttagaaatcattctggtttgggaagaaacgttatggtttgaacctagaccttttctaattcttttcacatttctatccaaagaaaacttttgacctttccccttttattatttctctctctctctctctctctctctctctctctctctctctctctctctctctctctctctctctctctgtgtgtgtgtgtataatgtacatgtgtgggcatgtataccatgtcatgtgtttggaggtctgaggacaagtttgtggagttggtagtctccttacacagttctgtggattcagggaatcaaactcaggtgtctaagcctgcacagcaaggacatttacccactgaaccaccctatgctccactggaaaaacttaaagatttgtacatatcagagagctgctacactttaacataggtgctcagagttttctcaaatctcatatacaaacctttcagaacttagccgttaagggaagacatctggattcctggtacatattcacattcctggtacgtattcaaattcctggtatgtattcagatgctctgcatccctgctcttaaaacttttaccaaaaaggacatgattgaaaccaagctatggtatgtgcaacgattccaggtcttttcagcaaatctccagtctcattttcttctaattccatcccccaagctgacatttccacatagcattttgccaatctccctaagaagcaattttatggatcataatagggctgcatttttcttgggcaaaggcattattgaaatcattaacttctaggagaagcaagcagctcaggggtcctccccattcagaaatatggcttatttggagggatcaaggtccttggttttctttcccctcttctgcccctacttcacaaagtactgaggattgagcctagggcctcaagtatggtagacaagtgctccaccacgaggtacaattccagctcctgatagaactttaaaatgttattattttagggccttcctgaaatgactattatatcatcaaagccaagaggtttttttgtttgtttgtttgttttaagtagtgggtaaatagctcctaggtgaactacaagaatctgggactaataaaagcaccgaacaagagcaggttgcccccatctgaaacaattacagggctggggcaaatgattagtgggagaagttgcattgtccagcaaacactaagacactgaaatcctacctttgctctcacactcactacctcacccctgcttctttccttcacattcactacttcacttacccctgctgttcacactcactaccccaaattgtttgctttcatcttgggaaatggcctctgggctgctttgtcctgaattttcatcagttttccctcagctccactctcctcccttattagttctcccacagccttaggaaggctgaggtaagaaagaagaggaaggggaagaagaagaaggagctggctgacttctcttccgtctgaggttgggatttttgggtaagaaggggtatgtgtgtgtgtatgtgtgtgtgcatgcacatttgtgcatgtggcttttgttcctcatctttctccccttacttcatccatgcctctctcttccccatcttcttttttctgttcccacaccatctagtctccatcctcaagtcagaaggaggccctacccagtgggagtcaagcttggtgcaggtgacaaagtagatgatttatgcaacttcacctcttcttttttttttttctcagtccagaaacaatagtttattgaacacacactaatactgatcagatcagcaaccagattgaaactacgacaacaaagatccttttctgtccacttataaaggaaaaggaaaacacacaacaggcacaatgagctcatacaaaggtgtaggaaggactgcccaatggttagctctggctcaccattttagacataacaggtcatattgatctttgatttgatggttcctacataaagctttgtggaatttcttaagattaagaaacttcagtatgtacagaacagaactgaacagaactgaactgaacatagcttcacctcttcttgctctaatccttcttttctctcaaacacttggaaccttccctcagaccatcactttcgagcaaggctgtggttgcatttttcctgtggtaactgctcccagaagaaagtctccttctctggttgtgtgaacctcggtgtttcttgagagcatgtgggcattctttacaggagacatctatttttagagctctttctaatatcatgtctccatcccataacagactagttttcctctagccttgtgcagaaaccaatcttcttcactccttcccagattgcattgcttaatcttctcagcactccctttgtctccacaccatcaaaatgttgagcaactttacatgacaccagaggacttaggttctctaactgcagctccaggggccctgacaacctcttctagcctccttaggctcctgagtgcacatactgcacatgcataacttagagaagcatgtgtgtggtgtnnnnnnnnnnnnnnnnnnnnnnnnnnnnnnnnnnnnnnnnnnnnnncacacagaataatgcaaacacaaatcataaaagtttcaataaattgacagagtacatctaaacaatgcagcaatcttccttcttttttccttttttcttttcttttcttttcttttcttttcttttcttttcttttcttttcttttcttctctctctctctctctctttctttctttctttctttctttctctctctccctttctctctctctctctctctctctctctctctctctctctctctctctctccctccctcccccgcctcttccttcaaaactgcataacgtcattcagcatgagccccaggtggagatgttaaagactcagcagtgtgcactggagggcagcttgcttggaatcatgagtggcagcagttgagaagggaactggatgcagatgagaggctgaggcccatgatgcttgcacatctggactctctcatggcagccagagtagttccttgcactttgggctagttttatttatttatttatttttactgtttataacatgcatttgttggagagtatatgagaagggggagggatgtaaaatgagatggtctgagttcaccaggacaattctttgatctacagagccacatacacttatggaagtaaaatttcttcatttcctcacagttgagcaggcagtggcttccagagtgagtgatgaggaattttagttattatccccccaccccaaaagaatgaattctgaaatgggcaaaaatgattagcagccaaatatgaaaactgaaaattgcgttaaacatgctactacctaacttcctgaaacatcatttgcttgcaattcagggaaataaatgttcttcagccatgttcccctggaaacatactgcatttattctccccagcaaaggtcacacgacacggtgacacatggacaatggatcttttgatatggcttttggtctcgtgtccatccccagcctacagcatgtctccagtctaacgtcctttgctagcttttatttcaagggatctaagagtcatgtggtcactcggtaggatgaggccaggagagatctaattgaggtcacctttcgtaactttacatgaggatttggtaaagtaagtggcgtgataagggacagctgagccatagaatggctggaagtgtatggcaatgcaactcagaaccagagagtttcagaaggcttcggtgggaagtcatgactgcctcttcagccacatgctagtgttgcatagagaacctcaagggactctgggctctgatgtttgttagaactatggccacagcctaagtattggtagctctgggagcagttggagcacttgttggttacactaaatgcacaactctttcccactcctactccatgacttctctgctcttctttctttcccaaacttttattgagcacctgaacccttctaggtgcttaatcatgccccaaagggctggtgtgttatttttgtccttggtctccttttaaaaactcactagcttacctcacacctttcatcctgtcccctccttcacctctctgtttgccctccttcatgtctctgttattcgtaactcaaaagtcagctaaggacacctgaccactataagatctagagaatgtcgctgtgatttctttgtctcatgccctgtggaaatggagacctttcatagttccaaagccccacagaagatgcagggcagccatgatttctgtagcctttttggactccaaagcctcaacttttcttgaattcctttcgttcttaagcccatcacctattaagagattcttaccagtggaccccgatgtgacatgatacttcttgcttgatttctacaaagacaacatgaatagtgtcctccataattcatgtctacttggaacctgggggtgtaaacctagtggaatggggtgttagcacacttgcttggtcaaatgaagacaattttctaatgggataggatgaacctttaacccagtcctgaagtccttacaagaggagtagacagccagagagatttagagagaaaggggcagcatgaaggctgggcagagctggagtgtcagctatatgccaagaacattggggacttctgggagttatcagagttaggaagaggcagggaggaactttcaagccttcagaggattgttgccatacagacaaattgactgggggatgtttagccctcggcattgtaagagattacatttttgttgttttgagctgcccagtgtgtgacactgtcatgacaacctcagaaaacaaacacacaccatgcttatctgggtgtgtggccaacttccccgaggagttgggagtgcagggcaatgacattttagctttccactcctgttttctactggcttcctcttccactacccatccttccctctcccctatttaactttccccttcatttctccttcctctgagggctccaggcttctgattcatctaactctactctgaaggattcaagatcgcaacctaatatttaggtcaaagcctcccaggatgctaggttgcaccaaggtcctctgtgaagaatagcaaaggcagacaagggctttaaaaactgttcacatcatctctctcctcgtggcagatataaccattctctacttcctgtttttcatctgttcagagaggcaatgttacagagagttcaagttacacagagtggaagtcaagaaaacagtctgtcagtcatggctgactatactgtttcctgttctagatgctgcccttaggaagagtttgacgcagtagctatcaatctgtgggtcatgcccttttcacaggggtcacatatcagctatcctgcatatcaaatatttacactatgattcatagcagtagcaaagttacaattataaagtaacaacaaaataattgtgtggttagaggtcaccacatgagagctgtgttaaagggctgcagcattacgtactaaaggaatttaagaagttactctttctgggatgaacactctagaagaccaccctttagctttcttccttaaaacctt

SEQ ID NO: 134 - DNA, 2468 bp, Mus musculus
tgaggagtctagccagttggtgagcgctgtaatctgaaccagctgtgtccagaccgaggccccatttgcattgtttaacatacttagaaaatgaagtgttcatttttaacattcctcctccaattggcttaatgctgaattactgaagggggttaagcgaaaccaggtgccggcggcgagggctctgcagtggctcccagcacccggcactgtcccggccctccgcgctgcccgctcggcccctccggaaccaagccgccccagtcccaccgcagagcctgccttcctcgcgtcgcttctcctcccgcgcatcttggatatgccaggattaaaaaggatactcactgttaccatcttggcactctggcttccacatcctgggaatgcacagcagcagtgcacaaacggctttgacctggaccgccagtcaggacagtgtctagatattgatgaatgccggaccatccctgaggcttgtcgtggggacatgatgtgtgtcaaccagaatggcgggtatttgtgcatccctcgaaccaacccagtgtatcgagggccttactcaaatccctactctacatcctactcaggcccatacccagcagcggccccaccagtaccagcttccaactaccccacgatttcaaggcctcttgtctgccgctttgggtatcagatggatgaaggcaaccagtgtgtggatgtggacgagtgtgcaacagactcacaccagtgcaaccctacccagatctgtatcaacactgaaggaggttacacctgctcctgcaccgatgggtactggcttctggaagggcagtgcctagatattgatgaatgtcgctatggttactgccagcagctctgtgcaaatgttccaggatcctattcctgtacatgcaaccctggtttcaccctcaacgacgatggaaggtcttgccaagatgtgaacgagtgcgaaactgagaatccctgtgttcagacctgtgtcaacacctatggctctttcatctgccgctgtgacccaggatatgaacttgaggaagatggcattcactgcagtgatatggacgagtgcagcttctccgagttcctctgtcaacacgagtgtgtgaaccagccgggctcatacttctgctcgtgccctccaggctacgtcctgttggatgataaccgaagctgccaggatatcaatgaatgtgagcaccgaaaccacacgtgtacctcactgcagacttgctacaatctacaagggggcttcaaatgtattgatcccatcagctgtgaggagccttatctgctgattggtgaaaaccgctgtatgtgtcctgctgagcacaccagctgcagagaccagccattcaccatcctgtatcgggacatggatgtggtgtcaggacgctccgttcctgctgacatcttccagatgcaagcaacaacccgataccctggtgcctattacattttccagatcaaatctggcaacgagggtcgagagttctatatgcggcaaacagggcctatcagtgccaccctggtgatgacacgccccatcaaagggcctcgggacatccagctggacttggagatgatcactgtcaacactgtcatcaacttcagaggcagctccgtgatccgactgcggatatatgtgtcgcagtatccgttctgagcctctggctaaggcctctgacactgcctttcaccagcaccgagggacgggaggagaaaggaaaccagcaagaatgagagcgagacagacattgcacctttcctgctgaatatctcctgggggcatcagcctagcatcttgacccatatctgtactattgcagatggtcactctgaaggacaccctgccctcagttcctatgatgcagttatccaaaagtgttcatcttagcccctgatatgaggttgccagtgactcttcaaagccttccatttatttccatcgttttataaaaaagaaaatagattagatttgctggggtatgagtcctcgaaggttcaaaagactgagtggcttgctctcacctcttcctctccttcctccatctcttgctgcattgctgctttgcaaaagtcctcatgggctcgtgggaaatgctgggaatagctagtttgcttcttgcatgttctgagaaggctatgggaacacaccacagcaggatcgaaggtttttatagagtctattttaaaatcacatctggtattttcagcataaaagaaattttagttgtctttaaaatttgtatgagtgtttaaccttttcttattcattttgaggcttcttaaagtggtagaattccttccaaaggcctcagatacatgttatgttcagtctttccaacctcatcctttcctgcatcttagcccagtttttacatagaccccttaatcatgctttcttaagagtttttacccaactgtgttggaagacagaggtatccagactgattaaatatttgaag

SEQ ID NO: 135 - protein, 514 aa, Mus musculus
HSSSNWLNAELLKGVKRNQVPAARALQWLPAPGTVPALRAARSAPPEPSRPSPTAEPAFLASLLLPRILDMPGLKRILTVTILALWLPHPGNAQQQCTNGFDLDRQSGQCLDIDECRTIPEACRGDMMCVNQNGGYLCIPRTNPVYRGPYSNPYSTSYSGPYPAAAPPVPNYPTISRPLVCRFGYQMDEGNQCVDVDECATDSHQCNPTQICINTEGGYTCSCTDGYWLLEGQCLDIDECRYGYCQQLCANVPGSYSCTCNPGFTLNDDGRSCQDVNECETENPCVQTCVNTYGSFICRCDPGYELEEDGIHCSDMDECSFSEFLCQHECVNQPGSYFCSCPPGYVLLDDNRSCQDINECEHRNHTCTSLQTCYNLQGGFKCIDPISCEEPYLLIGENRCMCPAEHTSCRDQPFTILYRDMDVVSGRSVPADIFQMQATTRYPGAYYIFQIKSGNEGREFYMRQTGPISATLVMWIKGPRDIQLDLEMITVNTVINFRGSSVIRLRIYVSQYPF

SEQ ID NO: 136 - DNA, 98345 bp, Homo sapiens
ttgaacccagggagtttcttactctgctttcatcttctgatcctctctacttcctgacttctgccccacatttattttcctgggtacagaaaagctgttctggtatcattaaatttctctaccctatgaccttaggaaacgtttcttctagcaaagcctgtgtttcaagactgttgtctcatcgtagactcaaaaaagtctaattcgaaattaaattatcatacttttgctgtcacaatttctcattctaaaccaatgtccaatgcagctttagatttgagattttacaatagaatgtttgttagaggagtcccaggagtaattagagatcatgtccatagattaaggaggataatgtgaaaaaactcaccatgcctgtaagtattactgataattttcacaggtatcctgaaggaaaggagaatgggttaagggagaggggaaaaaaagaaagtcagacttttatcacacatgataaagtggaaaaaaatctattgacactcatttttaaattgttacataattcttcacaaacagaaaactcgaaagaggagttaatacacgtccatgaacccatattccagctttgatagttaacacggttttgctgatctcatttcatttatgctccattaatttagtaggcctttctaagtgataaagatacattagaaattaacagatcttacaaaattaacaataattctttattctctgatacctagtctatattcaaattctctcattgtatcaaaggtgcgtctttacacacacttggttaacgcaaatcaggacccaaacgccatgcaaatgttgcatttgcttgttctgtttcagtaccagtcatttgcctctgctcttggatccattaactgtcctgtctccaacttgttctgctggttccctgcacatttttcttctcaagcttctttgccactggcttcgtgttgatttcagccaatgggaagtacacggaggagactcaaaggatgggaggagggaaaaagccagggcatttcttccagcctctgcctcttgacagtgaccacttctctagccctccagcaacctccacctgattcaattcttgtaggtagcccccactcctgggttctggtggcatcatctccttcttccttagtccttccagctctaggggaggtggtggctttctgaaggagcatagatctgggttgcctcaacattccatttggcttttcagctctttcagctcttttgaaactagttcgctgtgttaaattcctctgccaaactacctggtacaggctattttttcctggacaggtcctgaatgacaaaggcttttcccctcctttctatttctttacaccctctctccctttttttattcttttttgctattgtttcttcctcgagggtcttttaattttttcctctattctctatacttcttgcaaactggcagtcatgtcagatcgagagccatgctgggcaatatgagagccaccagccacatgtggttatttaaatgtcaacttaggctgggcgcagtggctcacgcctgtaatcccagcactttgggaggctgagacaggtggatcacttgaggtcaggagttcgagaccagcctggccaccatggtgaaaccccgtctctaataaaaatacaaaaatttgctgggcgtggaggtgggcacctgtaatcccagctactcaggaggcttaggcaagagaatcacttgaacctgggaggcagaggttgcagtgaacgaaattttgccattgcactccagcctgggtaacaagagcaaaactccgtatcaaaaaaaaaaaaaaagtaaacttaaattagttaaatgaaacaaaaaatttgcactggccgcatttcaagtgctcagtgggcacagtggttagtcactgtcacattggacagggcagatacagaacatttccagcatggcagaaagttcagcttgacgttgccattctagaaacttgattaaattcaagttcaatacttttaggcaagaatacttatagagaaggcttgtgttgggagaacttgttccttaaaaatcattcagagctgctgagaaagtaacaatttctcctcagaatcacctgagggtgtttgtaaaacacagattcctcacccccacacccctttaatctcagggtgtaaggcctagtttattaattttaacaagctctcagatgactctgttgcactctgtcatttgaaacctcggttttaagacagccttaactgtcttcaagaccaaacattcaagatatgagatcctgtctctcctacatgtggtgttaaaagttctttctcttatgaaatatgatgatgtgatatatgatggttgtattttcttttgtttttactggcaaaattaaaaattggcacctaatattctctctattttcaaggtggttgactttactagtctggtaaattcaagaatctgggagccactaatacagtctatcttatgtggattgtaagtaggaaatgaggtaaatggaccatcttaccattttacagtcatagtaaatatgttagggttgcccaaaatctcaatccatattaaatgtcagaaaacaaattgacaagaacaaaacagagatggcaggtggaagcaggtcattaccagtttttgacctcaactctggggctccccggcagagtctgcttgcctgaagtctctaggacagagcccacattttgcacatggttatatgtcaaaaccacagtcagctaaaacaataagaaaagctcaggtgttttaatgatttgctgaatttcctggaaattccaggtatgtctagaaaatcctgacattctcaaaccagtcggttacattaaagtacaggccaggtgcggtggctcacgcctataatcccagtactttgggaggccgaggcaggtggatcacttgaggtcaggagttcgagaccagccggggtaacatggcgaaacttcatctctactaaaaaaatacaacaattagctgggcgtggtgctggcgcctgtaatcccagctactcaggaggctgaggtaggagaattgcttgaacccaggaggcggaggttgcagtgagccaagattataccactgcactccagcctgggcaacagagggagattctatctcaaaaaaaaaaaaaaaaaaaagtacataatcagaattacagagggaaatgccgggctcagcggctaatgcctgtaatcccagcacttggggagactgaggtgagagggttgcttgaggtcagaagtttgagaccagcctgggcaacatagcgagacttggtctctacaaaaaattaaaaaattaaccaggtatagtggtgcacaactgtagtcccagctactccagggattgaggcaggaggatcccttcaacccaggagtttgatgatacaatgaactatgatagttccactgcacttcagtctgggtgacagagtgagacgctgtctctaaaaaaaaaaaatgtaggggtaaacacccaggaaaacttaaagccatggatgaaagagagaagatgcatcatcaactagagacacaggaacaattagaggtggagaaaaggcatcgtatttggccaggaggaatcactaggcaacttagggagcattatgtgggtgaatggtgggaacttagtcagattttagcaggttaaggtgggactagatggtgaggagttggctgagacaagtactcagtgagaagtctgaccaagggaggaggagagaggaagcctctgggagcatcaggaccaacagacattcccctaccctcacggcaggatgggcagaactgtggggtggagcctctgcccaatgctgaacctcacgtgttggctgtcattttagttttctgactgttttgggccaagtttggataatatatgaaaccaaaggctttactagcgttcagaaaaaggagagagagcgagacagagcaatgatggaagggcccatggagttctggaatattcctggggggctgagacagggagggaagtagccagggaagctgtgagtagagaaagcaggcttggtaaactggaaggaaggaggactctagaatccaacaggctggtgagggctggagtttggacccctgattatctgcatggccctgatgtccctgcacctgtttatctgcaaaacggagggtttcctatttcacagggttattgtgggggtcaaaggagaggagctgtagcatctaacataatcattgacatccaataacaccccctccctgttttacatttgctcataaaaaggcattacaatatgactatttttggacagtaaaaaaataaaagttttgtttatttttgagatagagtcttgctgtgtcacccaggctggagtgcagtagaacaatcatgacttactgcagccttggcctcctgggctcaagcaatcctcccgcctctgcctaatgagtagctgggactacagacacacactactttgcctggctaagttttaaagtgttttgtagagacaaggtctcatcgtgttgcccaggctggtcttgaacccctggcctcaagcaatcctcctgcctaaacctcccgagttgctgggattacaggcatgcgccaccttgcccagctctgatttaatattaatagtcaacatatatcattcaatctataattttgtgagttttcccccaatttgacacactgctttacaaaaaaaataaaattgcttatttgtctttcaacccacagcggcagagtgaagaaattgggcttcactggaaccaggaagatctcattcagcggatgataacctcttacatttatgctacaatttgcattttgtaaagttgttttatagttttgattgtgtttgattctgatgatgggaggtggagcagatgataggattcctattttgcaaatgaaaaagcaaaaacgattttgttttgttttgtttttgagacagagtctttctctgttgcccaggctggagtgcagtggcgtgatcttggctcacggcaacttctgcctcccgggttcaaacgattctcctgccgcagcctcccaagtcgctgggactaggctgcacgccaccatgcccggctaagttttgtatttttagtagagacagggtttcaccatgttggccaggctggtctcaaagtcctgacctcaggtgatccgcctgcctcagcctcccaaaggctgggattacaggcatgaatcactgtgcctggcccagcaaaaacactttgaagaggaagcgatgatctctggaagacagcaagggtcatttagcagttcatgccaaaggaacatttttcctttttaaaatagatttgctagatcaggaaatgctataggtaacgtgttttgatgttagcagaacacttgacaaagtgtctcacgaagtctttgtggacacggggaaccgttttaatggataggaagctcgttatgcagaagagggaggaatctgtccctgcagagcggagaattagaagccatggacattagttccatacagggaagcagatttgggttcagctcaagaaagaactttctaacaaagagaggcgggcggatcacgaggtcaggagatcgagaccatcctggctaacacggtgaaacccggtctctactaaaaatacaaaaaatcagccgggcgaggtggcgggtgcctgtagtcccagctactcgggaggctgaggcaggagaatggcgtgaacccgggaggcggagtttgcagtgagctgagatcgcgccactgcactccagcctgggcgacagcgagactccgtctcaaaaaaaaaaaaaaaaaaaaagaccagctcttttgtgagagaagttggtctcgcctggagtcagacaatgggcagtgaccccaaaatagtgaagaaagagaagggattagtgccaatctggatggattgctgcactccaactatcccggtaacatttatttgtggttttttcgagacagagttttgctcttgttgcccaggctggagtgcaatggtggaatctcagctcactacaacctccacttcccaggttcaagcaattctcctgcctcagcctccctagtagctggaattacaggcgcccaccaccatgcccagctaatatttgtattattagtagtattagaattagtattagtgttattttgtattattattatgtctcaaactcctgacctcaggtgatccgcccgcctcagccgcccaaggtgctgggattacaggcgtgagccactgcgcccggcctcccagtagcatttttattgataactgtgataaagtcaaagaagtcacattcagcagctctgtatttgtcaaagctgagagtgatatttagtactttagacaacaattcatgttgagagaaatatcttttttttttttttttttgagacagtctcgctctgtcaccaggctggagtgcagtggcacgatctcggctcgctgcaaactctgcctcccgggttcaagcgattctcctgcctcagcctcccgagtagctaggattacaggtgcacgccactacacccagcaaatttttgtatttttagtagacggggtttcaccatgttgaccaggatggtctcaatctcctgacttcgtgatccgcccgcgtcggcctcccaaagtgctgggattacaggcgtgagccaccgagcctggccgagagaaagatcttaaacagtggataaaaatgtaatatggacatatgtaaaaccttgtgcttgcttaaaaataatttgcagtccaagtacagggtggaggagatgctgttacgtagcctgtgcattacaggttgcttttgttggtgcaaattcagtatgaatcaagagacagaaactgccagaggagatgaacaggctgccttggggtcacagggcacatgaggagcagctgaaagcccctgggatgttcagcctggagatgagaatagtagcgtgggcgaggagtggaagggtaataggaagcttgttgtttccaagttggggggcccctggctttagaggggagaattagattccatgaacagtaattacatacagggaagtggatttgggttcaactgaagagagaattttctaacagtttgagttattcaatagtgagatgggctgttttgtggcgctgtgatttcctcgtccacagaagtggataatttactatttattaaggatattttggagggcattgtgtagggaatgggaacgtggacacagtgaaaatcaagaggataactgttatttcattcccgcaacaaccctggcgatgttatcatcgccatcttgcagatgagaaaactgagatgtcgagagggtaggaggaaaaaccaagacttggacccaagtgttttatggcagtcttcgttttctccccctttccaaccctacaattttaagatggaaacaatctctcatccaagatgggtcccgggacagttttgcttccaacggtctcaatttgcctatgtaggaaacaggtatattgatttcctctccttccgtgttcttcaagaaggttgacagtatctgcgaggtgaatggactgagtcccttaaaactcttcctacccccacaactagttctacatcagatattttaagttttattattttgaatattactcatattttgaataggtaatacaggtacaaggtacaaaattcaagttatgccaaaaagtgagcaatgaggagcgaattttcctctcctatttcttttccaattgtctgcctgatttccctcctaggagatggttacagaccatatgtttaaacccccagattcatatgttgaaatctgaatccccaaggtgatggctctaggagatgaggccttcagcaggtgattagatcatgagggtgaagctctcacgaatgggaccagtgcccttataaaaggaatcccagtctctggccaggcgcggtggctcaagcctgtaatctcagcattttgggaggccgaggcccatggattgcttgagcccaggagttcaagaccagcctggccaacatggcaaaaccccatctctactaaaaatacaaaaattagccaggcacggtggtgcgtgcctataatcccagctacttgggaggctgaagcaggagaattgcctgaacttgggaggtagaacttgcagtgagccgagattacaccaccatactccagcctgggcgagagagtgagactccatctcaaaaaaaggaaccctagtctccctctctccatcatgtgaggacatagcaagaagacagtcatctgcaaccaggagaggaccctcatgagaacctggctatgcccacaccctgatctcagacttccagcctccagaactgggagagataaatgttattgcataaaccacccagtctatggtattctgttatagcagcctgagctaagaccaataatactcatggtttcttgtgcatccttcaggtgatgtcttttctgtacgtgtacaagcaagaacttatgtatttattttttttcccacaaatgatggcatgctttacacacagttctgcagcttactttttacatttattactatattagatcaatctatgtgaaattaccaatattctactgttttgacccacaaaatatattggaaacccttcaatagcagtgcatacggagctgtttcagtctttttttcaaaataagatataacatacataagacttcacaaatattaaatgtacacacccctacataaccagcatccagatcaatcattagattattaccagcacccagaaggggctgggctgcctcccagtcactatctgactttgaattttatataaatggagtcgtttgatgtggactcttaagtgtctaggttttaattggttgcacaatagtccctttggaagccccttactttatttaaccctattggtgccttgctgatcgaccttaaaggtgtttataatcttttgcttttacaaacaatggggggatgaacaaccttataaacataaggtatttaaaaaagtgttttacaggaaatttcaaacacgtaaaaggaaatagattagactagtataatggacacagcttcaacaactatccacattctgttattctcctttgggtagaattccatttacttacccccaaaaatgccttagggaaggctaaatatgtagactccagaggctcagctgtaccaatgaatagctgcgtgactatggggaggttacctaacctctcttatcttcacctctaataacatggagatgatcattcctactgcttagagtggtggtgaggacaggggacctggatcagggcttttcggctgcaggtaggaagatgcaggtggaagcagatgggataggccacagtccatccactggcgttttatagagtgagtgccttctgtaagatttcattgacaaaagtactccaatggcttaaaaacaaacaaacaaacaaacaaacaaacaggaaaaagaaacaggttgaagcctccactagaatgaatgcaaaggactcagcatgtcttatgtgctgtctccaccattctgcttttccagactgtcccttcttcaaatcaccgtttaacttgttaaaatcactttcgagccaggggacacttttccaggaaagcgagaaaatgccagggagaatcggggaatgagggcggggagagaaaagcgtcctaagacttgcattgcacaagctgaagtctggaattcgcaccagcgggattccatcctcttcccccccaccccaccccgctgctccccaccccttcttcgggaagatcgcgactctcccgtcgctcgccccaagcctctgcttcgtaggttctggtttcccaatcgatcgtgagtttctagtccctggagctgcgtgggtcgtgagttcaagtccctttccttccggaggcgacaacgttctcgcgggtccccttgccacgcagcgcgggcgtgcacgcccctccccgccgggccgcgctgccagccccgccccgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggtgggttctcggcgctggacttttctttctccagggtctggaagccttgctaaaaatccgatgggtggaaaatggttatggctgcgattcaggcggtgtcaggatattggaaaaggcatgagctagtgatgcaatgatattgttaattataaaaagctgcgcctctgtaatttccatcttgaagcgttcttttgggagtgggtattttctaatacagtttcaaaagccagcatcagagagggctgcgaaattctcagcgcttcattcctctttcttttctggaaagggcagcaactttgtcgttttaagggatttttgtatgtattttttaaatttcgggaggccaattactagttcactagcaattactgcgccgcatcggctgatagacaagcagacaggctagctgaacaccgcggggctggatttgctctatgtttgtgtgggattctcacagaagtttcaagccaatgagaagtgggaactgcagacagagatacatgtaagcaaatgttttgctattctttaaggaaattgcaattacagttaagtaatccttaagtcttggagaactttacctaaatgacacccacagtctttattcagcgagctcttgaaaacatactgctttgaacaaattaaccttgtgtgcgtatgtatgtgtctgtggggtgtgtgtgtgtgtgtgtgtgtgctgaaaactaagctgtaacaatgtcatcctggattggggaccagcacttctgtgacaggcagtcctggtatttggttggtctctccggctttccttgtgtttcaggctgaggcacaacaccggcgaacccacctgctttagaaagttcccaggaccggttatgagcaccaacctgcctccccccagctattcttatagttagttcatttttggagtttccagggttttttttttttaatcacaaggtgcagctattcgtgatgctgtgaggcagtagtgcttgggtattctttcattttaggaaaatcctattagcctggaacctgtttggcccccaggactcagctgtggctcttccaagaggctgggcttgaggcaagacctgtcccagggctgcctctagccaaagggaatggggctgcggggagtagggggaaagatggggttagcatgccttttcaactagctcttgaagtccactgtgttgcagtcagcctgttctttctccaacataaacgagacagggttttataaccaactgaaaggaaacttcatgtgaagaaacaggaaaacattgaaattcataatacacagactggaaaataaatttgttattgttctttcattccttccagatataaatctggccatggcaaatatcaaaaagccctgggatttggctctgcactttataaggtcagagctgtctccagcgttctagaatctggctcacccaggcacttacatgaaaacttgtggactctcagcgtccttattttttggattggggactcgataaaggaaatggcctcgcatctcctaagatcgtatcagggccctattccctctggatgtcagcttaactccaggtcctctaatacccagggttgctgatgcagatgggccatgtgtcctgaaagggagggattatattgttgtggtgcacgtttgtagtaacgggccccagaattcagccatgtccccaggttcactgctctgttgaagaagccttcaagatcaccttctccaggaagtcttgttgctacccacagcctggttgttatggcacccaataggtatttctttccatgcccttgccaaggtgtatggacattgtcgtggctccccaactggttctcaagggtagtggttgtttcacagttctgtagctcctccatctggcatccacacccacaagcagtagttgcttggataaactgctgttgaactgaataatagtactagataacgctctgcttttgtttagattttctttttttttttttttttgagacggagtctcgctgtctcccgggctggaatgcagtggcgcaatctcggctccctgcaacctctgcctcctgggttcaagtgatttgtctgccttggcctccagagtagctgggactacaggcgcctgccaccacagtcggctaatttttgtatttttagtagagacggggtttcaccatgttgcccaggctggtctcaaactcctgacctcgggtgatccacccacctcggcctcccaaagtgctgggattagaggtgggagccaccatgcccagcctgattttgtctttttttctaccataaccattttgaagagtctagttcagtagtgttaactgcattcacattgctgtgcaatctccagaactcttttcaccttgcatgactgaatctctgtacctattaaacaattccccatcttcccctcccactaagcccctggttaccaacattccactttttgtctctgtaatttcgactacactaggtgcctcgtataaatggacccatgcagactttgtcttttttgtgagtggcttttttcacttaacataatacagtcagggttcattcatattgtagcatgtgtcagaatttccttcctttttaagactgaatactattcccttgtgtgtacagactgcattttgtttatccatgtatccatcgaaggactgcgtccacctttaggctattgtgaataatgctgctatgaacacaggtttacaaatacctgtttcaagtccttgcttttaattttttgagggtatatacctagaagtagaatggctggatcacatggaaattctatgtttagtgttttgggagtcatcatactgttttccatagagactgcaccatatttacaccaacagtgcacaggagtttcactttctccacatcctccctaacgcttgctcttttccattttttaatagcctcatgagtgtgaagtagtagagattttgtatttttattttgtttttattttttgagacagagtctcgctttgtctcagagcgtgtaccaccatgcctggcaaatttttgtatttttagtagagagacaaggtttcaccatgttggccaggctggtctcgaactcctgacctcaggtgaccttcctgcctcggcctcccaaagtgctgggattacaggcatgagccaccacacccggctgcttttgtatttttaaagcaatcttgctggccacaatcttactggattaaagcctgtgcgtggcgaagggcagagttgcagactcccagagcatcactgtcttgtgcatggcagaactgagcccagggtgcgtgactcctcctcctgttttcccgcgggtttcattttccctgggctgtgcaggttccccgagtcctttcctccatcaggacctgctggcagcagttcccgcaggccacactcttcaggggacagggccaccccaacccatccactgatgggggattttcacacatgtggactcaatgctctggttcagtgacttcctgtgacacctttctttggtgccactcaaagtgcctcacattctcactttcttttcctttcactgtttgagggcatgatgatggcttattcactctgtaatcatgtcagcataaagatgttcaaaagtcaagcacatctcgcataaagaataaagaccaaggaactggttaataccatagtgggaggttttagcttttttggggggtggggggaggacaaggtctcgctctgtcacccaggctggagtgcagtggtatgatctcagctcactgcagcctcaaaccccctgggctcaggtgatcccacctcagcctcctgagtagctgggactttaggcgcgtgctatcatgcccagttaattttttttttaattttgtagaaatggggtttcaccatgttgcccaggcttgtctcaaactcctgggttcaagcaatcctcttgcctcagcctctcaaagtgctgggattacaagcgtaagccaccgcacctgaccttagcttttttttttgaagcagccaaaccctttattaaaaagtgtgatctaacacatgatcccaatgcaggaggcaagtagaagaggtgtggttctgcttgggtggtcgcggtgtctggaaccaccatgacctccctggagcacaccccaccccatacaagcccaaggtgatatcaccgttacacgtcacgggccgcatgcgacccacactcccctagacctgaatctgtcttgggcatttatatttgacttttcacctccacaggatactcactgttaccattctggctctctgtcttccaagccctgggaatgcacaggtaagatttttatttttaaaaaatatctacaagcgtattaaaatccggggtgagggagtccagccttgcgctacggaaccctaggtttgtgggggtgggagtggctttacagttgacctcatctgagctcttcattctcagaggttaacagtggaagctcagagaaagtgagacttggcccaggtgacatgacttgtaagtgacaaggctggggctggtactcagtttcctgactcccagtccaagactcttttctattttattataagttctagggtacatgtgcaggatgtgcaggtttgttacataggtaaatgtgggccatggtggtttgctgcacctatcaattcatcactaggtattaagcccagcatccatttttaatcagatcacatggcctcatttgtgcccctcacagcaggcctcaacctaccttcagtgttgaaaagtaaaatatgctgtagtgtttctgggcaatggcacctgaggacccccacgggtctgcatgtgttgccacagacacacccctcctggaggaggtgggagaggaagtgggtgttacccaaacatcccagcatgtagtgttgcataattcagctccaaacctaggagggcccatccctgggctgaaacccctcagaggagtaagaagggggtgggtgaggccaggctcagggccttaggggttctggaagaagcttgcagcatcctggactttattttaagcaacaggagagatggacccctgtgtgtcagccctgaaatgtgggcagatccctcctgaaaactccgagtggcctctctgtgtctctggctcaggaaagaagtgagagaagccctatctctgagcaggctgagggctgcaggcaggtaggggagcattttctctcttcatattaagaattttgaagcatattcaggccactggcaatgggaaggattttgggaggagtaacaaagaattttagaccttgcggttttctaaggcagcctcatggtgtacacatgaagacaggtaggccccaagggcagaggttcagggtcgtgtttactgcactttaggcacgttatatagattaacatacatcgtccttaccaccattttgaactacgtacatacccccccattttacagatggggaaactgaggcatagaaaagttacgcagagagtaggggctagagtgagaatttgaagccatgccctggtccagcagtcttgaacctatgccagtccttgacaaccagggctggaacctggatctcctggcctcccagcttcccggcacagcttcctggctcgtctgttccacttcctttgccccaactccctgggacccctgaaccctctcccgggagtgcaggccatatacatcatctctgcaaatcaaccaacagctcagcgaagcccaacctccgaagctgtagaaaaggccagggatgggagctcctagaaaatgtcaggccctggggtcttcctgaagagtccacccaacacattttttttttaagtacatacatttgtagctcaagttgtatgtaaaagctacaaccctctggaattgttgagatctatctctttctggaagcatctttatgtcgtcatcttgctgaggttgaaatggagaaatttactcaattcaacttttcttagaaaactgaccacatctctgtgtagcttttatttatgtacagacatcaaaatcaggtagaggatttcatgggggcaaataactcatattcgacactctgaaggcgaggtagcacctaaagaaagagtcattgcccttaaaagcagtcttattcattcccagaaaggggatgaacagggagcatgccacattaggctcagcagatatgattcctcttgctcttcacaactacagcattaaaaaccctgaaacctgtctgctaaaaatgggagctatgaagcaatggtacagggagtttttttttaaataaagtttttctaaaaacacagagatggggtcttgagggcggtctcaaaatcctgggctcaagaaatccttcctcctcagcctcccaaagtgctgggattacatgcatgagccactgcgcctggcctggtgtggggagtttagaaagtagttctaagtataaaataattacaaggaaaaattttagaagaacaaataggggttataatacaggtattggtattttggaggcctttcttttttgctccatttccccaactttctgtgttgcagcaataagacttttatggtgtgaaatgaccttgcctgtttctcctctctccttccctgcaggcacagtgcacgaatggctttgacctggatcgccagtcaggacagtgtttaggtatgagccactgtggatccttcattggggtggaggcattcagcccagttgcagtgctatttatttctttctctgttgttcaatgattagccatgcccatgggagaatacagtgacatggaatgactgaagtcagtggtgcccttttattgatcaccttctttgtgcctggccttgagctaagcactgagaggggtgaaagaattgatctctgttctcttgaaggtttctattggattggtgtttcctagggctgccgtaacaaattaccaccaacttagtggcttaaacaacaccagtgtatgattttacagttcagtaggtcagaagtttgacttgagtctccaccagaatagaattaaggtgtcagtagggctgtgtgctcttctggaggctctaagggagacttttattcccttctggttgttggcagaattgagtttcttgtggttgtaggactgaggttctgtttccttgctgactgtcagtggagggcaattcctaccttttagaagcctcctgctttccttggctggtggctcctccctccatcctcaaagccaacacagcgagtcaagcgtttctcactttgaatctcttctttttctgttgtagcatctctctgaccaatcagcctcttcttcttctacttttaagaactcctgtgaatatatcgggcccacccagaaaatccaggataacctccccatctcaaggtcagctgcttagtaagcttaattccagctgctaccttaattcccctttgccgtgtaacccaacctattcacaggttctgaggactaggaagagattttggagtgtttgtgggggtcattctcttagcatgccatcttttgcaatggactctgcaaaagaagaggagaaagtaataccttatgtccagggtcaataaagcatcgatggggccgggtgcggtggctcacgcctgtaatcccagcactttgggaggccgaggcgagtgcatcacctgagggcaggagtgcgagaccagcctggccaacatggtgaaaccctgtctctactaaaaatacaaaaaaattagccaggagtagtggcatgtgcttgtagccccagctactcaggaagctgaggcaggagaatggtttgaacctgggaggcagaggttgcaatgagctgagatcgcaccactgtactccagcctgggcaacagagagagactctgtctcaaaaaaaaaaaaaaaaaaaattaatggaggtcacatttgaattgggtattgaaagatgaataggatcctaagaaatgccattccaggtagaaggaacagcattaacaaggaccaggtgtggaaaggacactcagagcatggaatagtttgttgttgacagagcatagggcatatgaacggaagaagacagccctacttgcccccatcttaggggaagtatttagcttttaaattatatttaatttaagcaaaatcatttgtcttctctgagctaacgtcaccatgctccagaggggagatagatggtttgaaaaatcgatgaacagtgaggaataaaaccctgtcctgggaaatctgggcttacgttttgattttaaaataaggtgttttgatttgaagatttgatgaggaatcaagagtagagcagtggccttcttttctggccccccatttcagcgatggcttcaggcttcaagctggagaacaggctgttgcattctgcaccttgccattgcttttacctctggtaggattgggtgtgagtttctcagatgagatgctgggggtgagttgtcgggtgcaggcatgtggtctccagtctctagccccgcacagagcagactccaaggctgctgacatggctcggtatacgggatcatgtctactgctcgctggagccacagttcaggcctcccctgtctgtaccctagcaaggctgattttctagagagtccacctctccccttccagacataacaagcagagcccagcctggctagaaattgttggctggcacagagctgacttgaaagcaaagctctgctttcttaacaagcaactagctgtcagtcaagccttttcttttttttcttttttcttttttttgtttttgtttttgttttgagatggagtttccctctcgtcgcctaggctggagtgcaatggcgcaatctcagctcactgcaacctctgcctcccgggttcaagcgattcttctgcctcagcctcccaagtagctggaattacaggcatgtgccaccacacccatctaatttttggtatttagtagagatgggatttccccatgttgggaggctggtcttgaactcctgacctcaggtgatccacctgcctcggcctcccaaagtgctgggattacaggcatgagccactgtgcccagcctaagccttgtcttttcctgatgcaagagactctttctcccctgaccactgttacttgaagtagaagtggagacaattgttaggcccatcccagtattttcagagtatagtatgtgcacacgaggatccttgatgtattagatggtacatctgcagataaacactctttattttaatagtgtatatttatttttactgttaccttctacttatgctagttttcacttgctgtagtcatgtaagactttaaatatacatttatttgggcttcaaatatgggcttacttaaagaaagagtatgtgcaaatgatagtacaggtttgttttagtccgttctctgttgcttatacctaaatacctaaaactgggtaatttataaagaagaggaatttatttcttacaattgtggaagctgagaagtccaaggttgaggatctccatctggtgagggccttcttgctggtgggggctctctgcagagttccgaagtacgcaaggcatcacacggtgaggggcctgggctgctagctgaggtctctcttcctcttcttagaaagccaccagtttcatttccaagataacccattaacccattaatctatgagtagattaatccattcatgagagtacagccctcaggatccaatcacctcttaaaggccccaccactcaatattgcaacactggggattaagtttcaatatgagttttggagggacattcaaactatagcaaggtttttgtagatatggtcaaaatcatgatggtggtatttgaaaggctgatgtttgagtgacactggttactttgatacacttcagccaacatttggggtaccttaccgcgatgagttgggaccgccctaggtgtttgggagtgcttcctccacgcctggtaccgagttctgcttaaatatgcaccggacacaaggcagttggggtgccactaatgctcgccctttctgtgcctttcagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtgggtgagtagcccggccttttgttcctctccgctgtgctttggtgaagacatcgtctgtatctggcatgctcaccacaaatgggttgttagttgccattcaatgcaccagtgaaacaatgacttactctctgcatacttatttcactcttagcagcctgtatctctgggttcctgcccaactagggaggttattttgctgttttgttcacagttctccagaaaaccaatttttttctttattttactttcatctatctacctacctatctgtatctatctatctataactcatctatatatttaaagaccaaggtaatattttctcaaataaccaatacatctggtcagacttattacagtaagtaaatctcagaggaagttctagacagggccaaagctctgtcctcagcccccgcacccttgattggaacatgtgcttctgcaatacaagaagccttgaagggcacggccaactgttctggaaagaaaattaggttacttgggttggaactaatgtgcttgtgaccaaaaggagcctcactgataggaactcacagcaagaatggacctccgggaagaagcaggcacaaaggaattggcaaggggtgtgaccaaggtgcgctgtgatcgcgcctgtgaatagtcactgcgttccagcctgggcaacatggtgacaccttgtctcttaagaaaaaatatatatgaattgaagttttattacttttttcctctaccccaaaagtttgagagaccattggtctagcaagatttttgtttgtcccattttgttttttgtttttcccatttttgtttgtcccaagattttgttgtcccatttcagggctctggagtgttgagctgtaacccactattagggaagctgtgttggttaatttaaggtgtcttctatatgcttatatgaaggagtgtgcattctctttttaatacaataattgcagacaagtgtcttcagagctatgagggaacactgggtatgcttgaacccaaacttctgcattttcgctggtctcaaggcgtgtggtctctgtgtgtgttggcgtggggagagagaaagagtgagaaagacagagctggttaatgtttaccttaaacgtagatgactgtgcaaagggaatgagcgcagggtccggtcaagccaactttggtggagaagatggtaacatgcttccttataaccagcatcaggaggaaagacctttgtaactggaagggacttttttttaccaatctttaacttcaacttcttcattttgtagaaaggagagtgtggactccaaccagttaggtaattacagaggtaggatgccagtccagctcccctaacttctcccctgtctacaatctcctaactataggaaatgacctctcctatctggtagaaaagaaatgatcccaaaagaaaatgcagagatagaggtgggaggtgctgctcttccaggatgtcacgtgggggctggataagccaagtgatcagcccttacgtgtcttgaggtgaggaagagggtgtaatgattctttcgaggcactctgcggttttggcagggggccttgggtggtcgtggtgcagacagctctagctgatgcctcgggcaagctcagcggcctcctttgcagaacggctgggaactgctgcggctttctccaaagtgtctccctccttcccctaaacctctttccagggtcccagtgcccttgacaatgaggacatggctgggaaacctattcctcccctggtccctctgacgtcatgccatttatggctctgaacctgtcacacgggagatgcggaactttcataatggcccttttgtaaggagaatacaatctaggagccctagtgaggactggcaccaggcccatccatttccaaaaagttcagcattatgcattcataagtcctgagttctttctaacttcccttcaccccaccccatggtttcctggttttacacagggctttcaaatggccctcgctgaggtccctctgcgtattgtaaagagctggcattgtgggggtggggggaagtaagagaagggatgggaaagggaggctctttctacctaccgctccttccaagaactgggatggaagagaggtgggcctgggagcaggtggaagggaagcaaggcaccgtggcggaaggtgggagggaaggaaaccagatggggggatcattgagaaaagacaaggaggtgagtgtggaggtgtcactgcccagagaatgtgggtgttttccagagcacagctctgatcctgtggaggaggcattgcatgagcagtgggtaagtcagggagacttgggaaacatttctgaaactttagtgttctaggagaggaggaaacatctccaaaggtgtcttgtcctcttcatcaaaataagaatagcgatcaacagtaacatccgcagcagcagtggtaataatatcaaacacttggatagaactcgtgtgctaggacctttacaataattaatgcgcttgatcctcataaccagctacaaggtaaaactattatcattcctattgtacccatgaggaaaccgaagcagagaaactaagaaacctgttcaaagtcacacagcaagtgaggggccgagccatgatttgaaccattcaggctttgaatgagaaaacaggctcagtgaggtatagatttgttcgagggtgctcagagtcagtgctgaagtcaggattaaaaacaaggtccttctcttgctatttttgttttctgagacagggtctggctgttacccaggctgtagtgcagtggcacaatcactgcaacctctgcctccttggctcaagcgatcctcccatttcagcctcccaagtagctgggactacaggcatgtgccaccatgatcctcgatcactgcaacctctgcctcctgggctcaagtgatcctctcatttcagcctcccaagtagctgggactacaggcatgtgccaccatgcctggcttatttttgtatttttttggtagagacagggttttgccatgttgcccaggctggtctcaaattcctgggctcaagcaatcctcatgcctcggcctcccacaatgctgggattataggtgtgagccgtggcacccagctatctctctttttttttcataatgaaactttttgctctgtaaaattttgaacctagtcaaaagtagaaagagcatagtaagcacctacctacttatcacccaacttctgtagttatcagcacgggcacaatctcctttcttctttacactctactcagtgcattaatttaaagcaaatcccagacatcatataatttcattcttaaagacttcagaattatctctaagagataaagaaattctttacaaaaacaaatttaaggccaggcacggtggctcatgcctgtaatcccagcactttgggaggccgaggtgggtggatcacctgaggtcaggagttcgagaccagcctggccaacatgatgaaaccccctaaaaatacaaaaattagttgggtgtggtggtatgcacctgttttcccagctactcgggaggctgaggcaggagaattgcttgaacccaggaggtggaggttgcagtgagccgagctcgtgccactacactccagcctgggtgacagagcaagactctgcctcaaaaaaataaaaaattaaaataaaaaaacttccaaaaagcacaataccattatcaaacctacagaagtcaataataatctctttttatcattaaatatccaggtagtgttcaaatctctctgattgtctcataaatgccttgcaatttcatcacaaatggccagaagaatccctgcagtccccggagtagcatggctctaacaaaatcctgctttctcagccacaaaacatttcactaacattagttattggagtccctacatttgccactgagccaagttggttagcaaagccagaacttggaatatccacccagagggatgacaagctgagccccaaaggggccatacatacgaagccatctcagcagcctgttgtctgttggtttgttggaatcagatccatgcaaattctgcaaattgcattggttgacaagtctcttaaatgtcttttagtctttactgtttccctggccacttatttgttgaagaggctgagctgcttgttctgtagaatttcatacgtttcggaggtggctgattgcactcttgccggggcgcgggttatcttattccttcgtcccctatattttcttgtaagctgctcatagatctagggacttgatccaattcaggttaaatttttgggcaggctattttgcaggtagcatctttgatcttttgccctcttcatgcactgatttcttctcaaagtgtaagacagtctgccttggggaggcaaatgagcatcccctttcacggcggtttactttttctagggtttggacccactttcaaggaagcacttcatcccttggtgccgcatgaagccatgctgtttccatgggctgggcggggccgggctcagcacctgggtggccagtccctcagagcttcctcctcaatttttctctttttggttccactttggaggtgactagaccctgtccttttggaacaatgtttggccttaggtttgagtccacaggcccctaggtgtgcacttgggacatttctgcagacacagtgaacagtgacctaggaattatagtccacgagccaagcaagttttgtgttgttcagaaaactggcatcttggcatgacagtgatgggactcatggctcattagagtgtgtcacccagatcctggacccttgggagatctggtgaccagattctcaggggagggagagccagacagacatggttaacgggtaagcagggaggggctgctgaaggagagcctcacccaacagctcacaatcaagacccagacagaggccaaatcaaacacatacgtagagttctgagctggccacatagacatcccagagaaggacggtgtggggctgaggatggtgtggtgctgaagcctcagggggtggggtgagctggtgccgagtggctggggcacccaagatgtggactcccattcaggaaccttcctctcatggcacgctgcctctaagaccgggtccctgaacgtggccgccactcaactctgtcaactcattcccttgggggctcaacttgtcatctctctgggtggacattccaagttctagctttgctaaccagcttggctcagtggcaaatgtagagactccatcagtaactcatgtttgtgaaatattttgcggctgagaaagcagccttttactagagccctgctactccggggactgcagaaattccggccatttgtgaaattacaagcaatatcttgattctctcttctagtccaggatttttgttattgttattgatctgagaacaggcagagagcaacacatggaatccttttggaaggtgggtggtgttggtctgaggctttctcttgagttatttttcctgaaagccagccagtacttcttcagtcaaccaatgtgtacagagtgctttgttggtgccaggctctggcctaggcaccgagggggatgtggagttttgcatggccacggagctctctctagagcttgtggacaaggaagggagattaaacgcaacacaagcacaagcagctgaaattcaagacggcctctgatgagttcctgagatggtataaaaagaaggcagagataagaagccttctggggtggaggggactggaactgggaagtcagacaggctttgagtctcaccttggtttggccacttcctacctgtgaggacgggggttggtttcctcatctgtaaaatggatataacaatgcctgtctcacagataacatgtgcaaacaccttgcccagtgtttacgcagagtatcccatagtaaacgttaactgggaaagatttgtggagaaggctgctagggtcttgagatgataacccaggggaagagtcacagagtctgaaaatgcatcaaacgtctaattcttcaaaacctttaaaatgacctaaaactgagcctagtacacatttaccttgcaggcctcgaacggctttccccagctaagcctgatgtggcttcactcggaatctgcttggaaatggcagcagaacctgggattatttaaattgtgagacagaaaagtgggaagtgggaacaaatgtggcataaaggccggggcaagtaggaacctcagcccctaatgctgacaggactgtggttagcaaaaactagggaggagaaggcggccttcactccaacagacttttcttagtttttatacagtcctctggcttggtctgtaacttgaaactcagtcctcaggctgagaccagaaggaaaatgcgtgaaacagatctggaggaaaatgcgtgaaaccatgaaaccgattctttagctgctgagggcattgggactacgcaggcccagagaggaaatgggatcgcattgaggtgggggttctgcagctgggttcgctcagatgtctttgtgaattggccccagcaagcttgttcatgggcatggcctccccaggtttcccaccttgctgcaagtctttccctatcattgctgggatgatgggcaagtggcttcacttctctaaacctcagattttcctcccgtaaacagggataacagtaccaaccgccacaggaaatttggagaattaagtgagatatgcatgcaaattgtctaacatcgaggctggcttatcataggggcttcctaagttcgttactgtaattattgttttcattatctcaaatctcatcattccgtgatgacttctcctgctccaaacccctagtcctgttattccattattttttattctttcttctgggaattagatttaatagtgtgtgtcgtttagggagttgaaagttgaattcttgccaattttcagcagtaggagttggggttaacttgtgcttccagggagacacaaacacagacaggactccaggaagttgtccaggacagctgttcccaaaagtagctgtgcccatgaatcacctggggaaaatgcagttctgactcaagaggtctggggtgggccccaagggtctgcattttcttataagcccccaggtgatgccacgctgctggtccagggaacaccctttaattagcaaggccctagttcatctgtctatttttcgacagaactgtgtttaaagaaaggtagaaggtttatttttttcatgcaatttgtatattgtttgaatttgttagaagaatgtgttacttatttaaaaacaaaacacaaactggaaagaaatgattttaaggcctagattgaggtagcatggtgtagtggtaaagggatgagatgagacattagtaagaactggattttgatcccagatttgctacttattagctgtgtgacatttagaaagccacttggcctctctggcctaagttttattatctgtgaaaagaaaggatggtattatactaagggtcgtaatctggggtctgtggatataaatcaagggatctatcgtcatatttttccccactaactttgaattgagatttagcattactgtccattgtaggcaacaggccacaggactattagcagtacctgggatggtattgacaagagaatcagatatttacatatcacattacagctgtggcagttattttgaaatacttggaagtattttgaaatgttttgaaaccttcaaaatcatagaagatactagatctgcctaatttttttttaatgcactgataaacaagtatctatatcactgtatcatgtgtgtgtgtggggtgtgtgtgtgtgtgtgtgtgtgttttgagacagggtctttttttttgagatggagtctcactctatcgcccaggctggagtacagtggcacgatcttggctcactgcaaactctgcctcccacgttcatgccattctcctgcctcagcctcccgagtagctgggactacaggcgcctgccactgcacccggctaattttttgtatttttagtagagatggggtttcacagtgttagccaggatggtctcgatctcctgatctcatgatctgcccacctgtgcctcccaaagtgctgggattacaggtgtgagccactgcgcccggcctgagacagggtcttgctctgttatccaagctggatggattacagtggcatgatctctgctcactgcatcctcaacctcccaggcataagtgaccctcccatctcagcctcccgagtagctgggactaccagtacatgccaccatgcccagctaacttttgtatcttttgtagagacagggtcttgctatgttgtccaggctagtctctaactcctgggctcaagcgatcctccttccttggcctcccaaagtgctgggattacaggtgtgagctgtcatgcccagccatacatttgttttttaaatattttgatagctgcatttcaatacaattgttttctttcgtaatcctctgagttttattttatgcaatttagggcattattctgagaagggagtacatgggctttagcagtctgccaaacaggttcaaggcacacacagaaaagtttaaattccctggttctgatgatttctcaggtttcctgcaactcaagaatgttctactattctaaatcttcccaatctttaggaaacataattttttgcgttagccctttcccacctggattgcctaggtgacgtggctcttctctgttgcgtgtgttttaacagcacacatgcctgctgacacctgccgggaccctaccaagtctccacttgtgaggaagtcccttccaccctcagtggtagatggctttggttattggcactggtctggtgaggttcagtgcactgactggcctcatgttctgggtggggtcccactggtgggccatgcccagcccttggtgcctttgtgtagtaggtcacttccccagtgtctagcgtggcagtcttttcaatgacctacaagtttttcttggctctcatcttatgttccttggtctagtcatgttacttttatttctactccactctggaattagccagttgtgtgtgaaaagcgagtggtgttgcagaggagggatgaagtgtggactttttaatggcaggaccattcagctctggtctggcaaaagtggctgcattaccaagtctccagagagcactgcctggagggcaggaggttgaagttacctgccaggttgcaaatagcctcgaatgccagggccagagctgagctgactgtttagcacatgtcttttaagttagtaggaggtgcatgctatgatactccttagagaagtgcagtcattctaaatgtgttgagatggagcaaggtgatcacaccatctcttttgttgtcaaggctagttttagatttcttttcaaaatccttctgatgtaagtgggttgaatccaccactggaggactctagaacagaatgactcacataggttctgtacagaaattcgcagatgttctgtggatgttctccgcggctcttatctgtttatgtggatggtgtctgcatagcatctgcagctcacacccccaaccctgctgtaatgcaagaaacagagggatttgggggatttgggagatgtttatgttatcagggatgttaaatgaaagaagtaaaaataccatatgaatgcaaggcattcattttatggagagtgtgtgcctgagtgggataaaacggattgaaacaataaatgaggaatcctgtttgatgttgacgacaacagcttcatgtaaatatcatcccataggcccaagctatttcttttgtggggaaaaatggagatcttcatttctcaaaggatctgaagtgagcaattcaatgatgccaggcactagtggtagagagtgtgatgcagtggaacgagcatgggcttagattcacacagacgtgggttcgaatcctatcactgcaccgttacaaagcctttaaatcctttgagtgtgtcccagctacaagatgggacaatgatgcttatcttccgggaatgttttgaggcttagtgaaggcaggatagtcaggtcttcaccctctaagcaatcgcgttgtcactcccacccgtccactgccccccgtccactccccccgatccactccacgtacctgcaagctctttatctcacaggagcagcaactctgtttgctttacatcttagcagtccctgccagtcatagggtcagacacgtggcaggtgcttgttggctgcttatctcaagtggggaagtatgtggaaggagcattagttggggagggagaagaagagggacctctttcaattcgtgatcatgtcttgacacttcaccccctctgtctccactctgacctcacacaggccacagaggcagctttcgagcctttctctggggccctcttagactctgggagtgctgaagagctacctgggtaccttcgttctcctatccgttgggctgccatcctctgtggacacatgtaccacacaggccacgcggtgcccaggcctggcaggctgggactggggaagtgctggtggtactgggctgacccgtcatcagagagacccatgagccagacagcctccctccagcagccagccctgggccttgagcatggaggcacagaggccagggcttcccagcagccccaggtgtgtgcaccgagggcaggcaggtgcccacaggctcttgtctttcataatggagggcatggctgtcgggggttcagggaagtgggtggggtgcctggcagggggattcctgagacaaaggcacagtgccagcctccactgtttatccacagcatctggcagagtgaggctctcgtggagtgatttttgaatgaatgaatggcggaaggaagagtgcgggcaccgatgaacccaggctagccagaggggagcgccactgccttcctcactcagtctcccagcactcacctccagcacaccctctgctgactcctcccactgtactgggtgtcaagcagggactaaggtgaccaagagtctccttgttccttaagcgccttgtgggctggggccatggtcgctgtggctgtcctgcacccagcaagacgctgggtaccacggcagctcagtgagtgttagatgcaatctaatgtacagaagcactgacgggctaatggaaaaagatgcctgtgaagaaccttccagtgagattaacttgcaaagaaacccacgtccactgtccccttccttaaggggaaacgctgtgggaggctgtgcccttcgtaccttgaagccacagctttgttttcctgccatgggggagactggctcccagggcttcaccaccagccagcgccagctccttgcacaactccagagggcaccactcaattgtattacatgtcactggcaccccctggagcccagcaaccatcccgaggctcctgtttgtcttggaaacagaggagcatgcttggggaagggtctctgggccatctccttgggggctggcagggaaaggacattcacaggattccttccctccagagggcctcagacaacagactagatgtcaaggactgaccgcctgttcccctccagcttgtcggagccgggccagaggggagatggggacagccagtgctgggccctgctgcaggcagccagcatccacagactctggggccggcgggtatgttggggccggggaagcagaatacttggggtcttgtcaatgctgtctgactttctttcaaactaaaacatttgtggaaatctagccagagttgatttatgagctctacatatttcacaggtcttaacacgtcccccaggaatcagtgaggtcagacagaacagactttgcatccggaatcagtatgaaattggcatcttcaacagtttccatgggaggaggggtttaagaatttgagggagattatatgaaacaatgcaaagacacaaaaaaccctgactctgcttcattccattagggaaaaagatgggtcatctgttttctgcatctgagctgagtgaggggtggccttctccgtggggacagggatgaagtatgatgggacaggactcctggggcaactgagagctcagagtggactcaggggtgaccacagcaccctgtacttattctccagctcacactccatagctgtgataaatacacatttgtgattatttatttaacatctctccacccaacagagctttctgtcttattcgccattgtattttttttttctttttctttttctcttgtgcagtggtgctatcttggctcactgcaagccccatctcctgggttcaagcaatcctcgtgcctcagcctcccgagtagctgggactacaggtgtgtgctaccagctattttttgtattttagaagagacggggtttcaccacgttggccaggctggtctcaaactcctgagctcaggcaatccgcccacctctgcctcccaaagtgttgggattacaggcgtgagccaccacacgcggtctcaccatagtatttttctagtgcctgataaatatttgttaaataagcagaaaagctacatgagtgaattatatatgtgggattcaaatgagaaagagaaatggattatatattaggtacagtttctacataggttaacttatgaccactgatggaattcatttatccatttaccatttatgtgttgaggtctgagctgtgcatgtaaagattaacccatttatgcctgatgttgcaatttttaaaatttttgcaatcagaccttggtgatgaccttgaacaggagaatataaataactcccacatgcttagcgttccaataatggaacactaggcataatttatcagatatcatcaccccctggcgagttcacagcctcttggcgggagtcgggtggtttggcaggaaatatgaaacccaaataattttatgtagcccagtgaaatgggatggcaacgaacgtaggtatgggacactttgttggctctggctggagtggtcacagaagctttcctaaagacagggttgcatatctgtgcgtccatttgattaaacaatattgactgatcacttttctgtgtcagacactgccaagggctaggagggtctaaggatgaacgagatgctgtccctgccctcaggatctctctgctgagtgggtgtgagtgggggttttggaggggggtgtacataactcatcagattctcttcatgagccagtgtcagatgtgactgatgagagcaatatgtcccaggtgctatgggagtgcccacgaggaatgtgaatgcatatggtggcctttagcaagtctttgcaggattgaataggatttccatgtcagagacgaggaagggcagtcagggttagggaacagcatgggcagagacatggagacaagaaagttcactgcatgttgagcagtcttggtcatgagtcaaccggtcacctgcacacttatgacacccagtgtggctgcagcatggacacatgttgtgggcagggcaggcacagaataagagatgaggcttagaaggttggcactcaagattccccaccagattgtggggccttgaattccatgcagttgacttgggctttattctgtgaacactggtttttgagcaggggagtgaaatgtttacaagcctatttggagatttctgcttagcctagtcttagcactgccacaagctcattgggtggttgtgctccagttccttctctttctggggcttcagttcacatctgcatgagaggggctgggccattatctgtgaggcttcctccagccttgaccactcaggatgcaaagatgcttatgacaaccaggtgaagggtggcttctggagacaggcagctttcggagatggtatcttctcatttgaggcattgattttgcatgtagtctaagctgtaggggctaattactgggtcacctcataattacatcacctccatgttctcagggtcctggtcaaagtctcctttaggcttaaaacagggatgagccctctgccgagacccctgaaaaaggggcatcagtggatggatgaaattggctctcactgtgatgatagggcctggcctggtcctgtgagaaatctgacactgcctttataattcctgggggaagtttgcaagcagctggagcaaaacacaagctccttaggaagccaagaatcctcccagattgaccaacaaggtagagatgtaagcgatcccaccatcagacgtctctggaaaatcccacctcagacctcagacctcctcaacagatcctttttccaggattgtctcaatctcatttctctccagagagcagacagtggctgggggccaggtggcactggcctgtggtctgttgtggtctccacttctccccatggaggctgggtcctgcggttactgccatgagtcctttcattgtagtaattcccactggaacactgcttctcgcttttccaaatgctttcgtgtccaccagctcatggaattctcaaaatagcccagggaggaaggcaggcctaggaatgtccttcccttcattttatttatttatttatttatttatttatttatttatttatttactttattattattattatttttgagacagagtcttgctctgtcacccaggctggagtgcagtggtgcgatctcggctcactgcaatttccgcctcctgggttcaagcgattctcatgcctcagcctcctgagtaactgggattacaggcacctgccaccaggcccagctaatttttgtatttttagtagaaatggggttttgccatgttggccgtgttcaaattcctgacctcaggtgatccgcccgccttggcctcccaaagtgctgggactacaggccaccgcgcctgtctgccccttcattttagagaatatgtggaagggctccatgactgtcccacatcccagagtttgcttgtgatttagactgaccagcatgtgggcccgccagctttaggcccttttaggccatcccacgacgtgccctggttggtcataggcaccatgccagctcctttctctaccccaaatataccaggcccttctggacctcagggccttcacactttctcttccttctatttggaactctctcctggctcttcacattgcgggctcattctcctctctggcttcagctcagttcagatggcaccccttagagagtcctactcaggctgccttgtctgaaattacaccgcagttactcccaatcacagccttatcattttccagcacagtcttcagcgtgcattaaatccaccggaggccttcaaacacagattgctgccgagtttctgactcagtaggtctggggtggggtcttttcttctgagtgatgctgacgctgctggcccgggggctgcactttgagagccactgattggtggctttttatgtatttgtttgttgattttcccatcccttagctgtaaacttcaagaggggaagaaacgttgccttgtaacctgctgcatccccactgcctggcccatagttggtgcttgctaagtacctgttagctggctattggctgaaggctcagctggaacctcttgcttcataatcaatcgtcttgcacctgagagggaagaaggacaagcattggcagaaactctgggagctacttggtctcagctcttctctgctttactacctttttctttaactttttcatgcttgagccttttctaagggtcattattaattttgggtaaagattacatggataattttcataaaatcccaggtgacggattttactttctgggttcagaattccaacgaagccgcaggacatctgggtaagagaattaaaatgtcgtgactggcttgcatagaacacctcgtagaattcccaatgtggtactttcagaaccctctgtgtctcaggcctactagcctttggcttcagaagaacaaagttgaaattttgccagattggagttgggttttaaccatgaaatgttatctatcttccctgacaaagaggagttgaagaccagttctaatgatagatcccctgaagatattgctttggccaagggagtgctgagggtaggcttgggctgacctggtccatacttcgtgctaccattgggggccacaggcaatggagtatgtgggttggaggcttgccaggaggagggttggcaactcctgcataaaccaccacaaggctgctatggactgagaatcgtgggaacagctgattctgcccaagggggttgaggaagtctttaccaaggagggacatttatagtttggttgagaaatctggaggataggtatgtgatatgacaggatttgtccaagatcacctggcaggccattggcagcgctgaaaaagcccaaagtctctggtttcttaatctccaaaaatcatgagttgtgcaaagagatcagattcagcagctgaatgaccttgagcaagtcacttctccgtggttgaaggatgatctttaagattcgtttagataattcattcatttcgagacactggggatagtaagtgaccagtcctctttgtaaatcatacagccctattctttccatattcaagctcaataaatagttgtacattgaatgaatttgactgctagcatcatctctttccaaagacagaaaatatggggcaggagaccctggtgcattagcaggcagacaagccacaaatgggttaataaaatagagtcattaagacaacaggagatagtgcaacttggcttttgactctgaggaggagggaaggcttgccaggattgcattccagcacagcctactgaccgtggggaagagtgtgtgggactccaagtcaagccccaagagccacacgcacgctaataagttctagtcaacaagaactctgaaaccagacaggggagggagaaggacaaggcagtctacttccctctggaagcttgggaggtgctcagggccagggggaaagcccacacaatgtactagtttgctaaggtggccataacagagtaccacagactgggcagcttaaacaacagaaatgtattgtctcctcgttctgctggccagaagtctgggatcacaatgttggcagagttggctccttttgagggctgcaagggaaggatctgttccttgtctttctaattggcttatagctggccctgtgtctttcctttcctttacttgactttgtctttcctctgtgggtgtttgtgtctcagtttcctcttcttaggaggacactagacattttggagtagggcccgctataacgggctcattttaactgaattacctctttgaagaccctgtccccaattgcagtcacattctgaggtactgggggttaggacttgaatatatgaattttggagggacacgattcaccctataacacaggacacagccctcttcctccagtggggacccttttgaggtcagagacccctggtaatccttccttccttccttccttccttccttccttccttccttccttcctttctttctttcttttcttttcttttcttttcttttctttttttttttcttttttttgagacagagtcttgctctgtcacccaggttagagttcagtggtgtgatctcggctgactgcaacctctacctcccaagttcacatcattttcctgcctcagccacccaagtagctgggattacaggtgcatgccaccatgcccagctaatttttgtatttttactagaggcagggtttcaccatgttggcctggctgacctcgaactcctgggctcaagtgatccacccatcttggcctcccaaagtgctgggattacacgcatgagccacagtgcccggctgccattcttttttcttatccttaatgaccttaatctgtgatttcttcccagaggccttcttagatctttactgatctcatcccaagcccattggaacctcctcttctctgagttcccaaaacactgtgcttgtgcctctgttgggacatttctcaccatctaccttagacttaggaatgtgcttgtgccacttactcattaaagcttcgtgtcctgttatctttatgtctctttcatatcccctatctcctgtcttgcagatagaacagggtcaataatgtttgctggcttgttgataggtcagctgtccaagaaagttgggtaataagtgctggataaacaggaagatgaggttgttagaaaacagcaacagcaacatgcctttccttagattttgtgcactcgtagacaaagtcaagctactggatttataaagaaaagatgctctttccatccttccatccttgtttggccccagtaggtcaacagaagaatctacaaactgggtgctcagcattcttaagcccccagagttcaaatcgaattcctcttttggccagtcttggagagactcttcaatcatatcttaaataatggcattcttttggctcagctctatggatactcctccttccgcccccagtcccctgaccttctgccctcttgtttcttggctgaaaatctgggtctgctgtagagagcaagagcagtttcagcagagctggggtccttcccacaaatccagagccacacactccagaaagcctgactatgcagaaacagctgggttttggcaggctgattctgaaaagcttcgaatcacttagaagcactttgttcccaaatggtatgtggaggatgaggaatgtaccatcagatgaggcaggtcacccatcttgttatgagaggactcatttgaggactgtcccttgaaacagcttccctgacctcccacctttaccttattctagatgtgacactcccaactggttcatgggtggtacaggtgcctggatattgatctcttcagctcttgggttggggggcaggggcttcagagggaggcttagtccttgggccaatttgcccattccattgtaccttacacacttgtgtaatgttctatgtgtgcctcaacatgaaaaaggttaagaagggcaactttagactggcgtgctctgcagagatttctaggaacatagagcaaatttctcatttaccttttaaagtgaaatacattcacttgttactcttggtgctgtggcttttgatgaagcaaatgccaacattaggactctgtgtctccataaagctatagggaaatttgattaaattcagtgtattagtcatcaggactttttgattgcaactgacagaaacccagctccaagtaacttaagcaaaacaacaataaactacctaaacgtattttgttttttctttctttcttttttttttttttttttttttttgagatggagtctcactctgtcacccaggctggagcgcagtggcttgatcttggctcactgcaacctctacctcccgcatttaagcaattctcctgtctcagcctcccgagtagctgggactacagttgcacgccaccatgcccagctaatgtgtgtatttttagtggagacatgtttcactatattggtcaggctggtcttgaattcctgaccttgtgatccacccacctcggcctcccaaagtgctgggattacaggcgtgagccaccacacccagcctaatttgttttttcataactgaaagctgagaagtagaactagcttcagacatgcctgagggcaagggcttaagtagtgtcatatggccttcatttttttctctctctccaatgactatctctaaaacataggcttcttcattctcaggacaggatctctcaagtggaggccgctggcagctccaggcttatgtctttctagtttaacaacccagagagattgccttaatctcgagctctggcaaaaggtcatagttgggctctagtagccagcatgggtcacaagcccatccctgagttcgtcacaatgactagcaacccatgggctttgatttagcaagcctacatcacaagcccaccccggaaccagcagtgggtccaaagctacctgccgtgcatggaccaaaagtgcagaaaggcagttccttaaaggaaaattagggtgctgttaccggatgaaggaagtttggatggtgggagggcaagagctgtacctggaatcctaacttttgcatggaaagagaagaaacagaaggacccaaagtttgttctgagcccacagtgacagataacaaaggatgcactcactcactaaaggatgcactatctcagtcatacacacacccttccatgacattgggggatggtcactagtaacaaaagtaggggcctagagctgccatctgagctgctcacctgtcctcaggtaagcaagtactgatactgcccccaaagaaaactaactctccctttcattgaaagttatcaggtagataataccatgaatcctctttacagaacatctgaagaaatgcctagtccctcacctgaattcttttttgtttgattttgagacagaatctcgctctgtcacccaggcaggagtgcagtggtgcgatctcctctcacggcaacctccgcctcccacgttcaagcgattctctgtctcagcctcctgagtagctgggattacaggcaccggccaccaggcctggctaatttttgtattctttttgtagagatggggtttcaccatgttggccaggctggtctcaaactcctggcctcaagtgatccacctacctcggcctcccaaagtgctgtgattacaggcgtgagccaccgtgcctggccacctgaattcttttgagctgttctttgttatcctgcccttaggaacaacaaaaaataaaaggcaaagaatggtagatttttaccatatgtaaccatcattatctttggtcatgttatagtatgatttgtttacaatatactgctggatttgtttggctaacattttatttaggatttttgtcattaatgtctataaagtagaatgacctgccacatttcttttttaatattactcttactagttttggtgtccacatataagcttgatagagtgagatattgttccttttctattctctggaaagttagaatggtctaaccttaggtcattcatggaaattttattcaaattcaattcatggaaagtttatttgaatttgcctataagatcattgagatttggtatttttgtgtgtgtgagtgggaagatttttagctactgatatgatttctttttttttttttttttttttttttgagatggagtcttgctctgtcgcccaggctggagtgcagtggcgtgatatcggctcactgcaacctccgcctcccgggttcatgccattctcctgcctcagcctcctgagtagctgggactacaggtgcccaccaccacgcctgggctaatttttttgtatttttaatagagacggggtttcaccatattagccaggatagtctcgatctcctgacctcgtgatccacccgccttggcctcccaaagtgctgggattacaggcgtgagccaccgtgcttggccgctacgatataatttcttaaagttaggggactgtttgcactttctgtttcttcttaagtcagttttacatagttacctttttctaagaacttgtctacttaataagtttttagcttcatttgcataagctttttcttaccattctttgtgttatctatttgatctttgctgactttgtagttctgttgtattttcattcccaatattgtgctaactcttttttttttattattttttatttttttagacagaaacttgctctgttgcccaggctggagtgcagtggtgcgatcttggctcactgcaacctccactccctgggttcaagtgattctcctgcctcagcctcctaagtagctgggattacaggtgctcgccaccacacccagctaatttttgaatttttagtagagatggggtttcaccatgttggtcaggctggtcttaaactcctgacctcagatgatctgcctgcctcagcctcccaaagtgctgggattacaggtgtgagtcactgcacccagccttgtgttaattctttaattaaaaaacaaaaaacaaaacaaaacaaaacaaaacaaaaaaaaaaaccacacagatattgccagagtcatatcagtttgctgttttcaaaaagaaatattttgctttgttgctctccccgatctctttcttttccttttgcttttatttcatcaattcctgttttttattcttttctttctatgttttggatttgtttctgtttaaatttttttctttttttattttttcgagagtctcattctgttgcctaggctgtatgcagtggcatgatcatggttcactgcagctttgatctcctgggcctcaagtatctgggaccacaggtatgtactatactgcccagctaatatttgttgttttttttttttttttttttttgagacagagtctcactctgtcgcccaggctggagtgcagtggcatgatctcggctcactgcaagctccgcctcctgggttcatgccattctcctgcctcagcctcctgagtagctgggactacaggcgcctgccaccacgctcggctaaatttttttgtatttttgtagagacagggtttcactgtgttagccaggatggtctcgatctcctgacctcgtgatctgcctgcctcggcctcccaaagtgctgggattacaggcatgagctactgcgcccagctaatatttgtattttatgtagaggcagggcctcgccatgtttctcaggctggtctcgaactcttgagctcaagtgatctgcctgccttggcctcccaaagtgctaggattacagatatgagcaactgtgcatggccccttttctaatttcttaagctggttgcttagctcattaactgtaagcctttcttctttcattaagtcagcacttaagactacatattttttggtgtgacctataagtttggatgtatggtatttattgctattaagttgtaagaatttttaattttccctgtaatcacttcttgttatccatgatttatttagtggtgagtttctgaatgttacacatttatggggatttaaattatctttttgttattgatttataacttaattgcgttgtcatcaggacatagggtcttcatgatttattcactttggtatccacaatgcctagcacaatgccaagaatgtagatgtcatttagtaagtatttgctgatataattgaatgatagttgagtgaacatctattgaccaggcgttagaagaattatctctgctcaaattgtccaatccttccagctacttgatattccaaaataactccacaaatgggcactggaaatataatggcccctcaaaattgtcttctatgctgctcactcctttcctcctttggcctggaaaacaggcactgagtgggtgagtgagaggatagtaaaactggcagtgtgagaccatcacacccagtctcatacataatagatttaggtaacggttctccctcttatttcttatatgacccagagaaatgcatttcttctttaatagtaataggctctattaatacattttaggtggcatttcctctagtggaatctcttatctcattgaatcctccaaaatattcaggcatgatattcccattttaaaaatggggaaatggacataaagctagttagtggaggggctggttgggttcgtgatgtgtattttttgttctgtacacgaaccatctccacctcatttttatcacttataatgacagggtagtaacaccttagacttccctaagggaatagaggtagataaaaacttgtgattgaattatacttgtaaaagggcgtttgaagacaaataatgaaaaatacgaatccattctgcactactcaatatggagtacatattgagttaatacacattggttaatacatattggttaaatgaatgaatggatgaatggatggatgagtgaacagctcttattttgatgagtacattttctgctttttggatcaacaacctctttagcatattaaagaagaaaagtgtctcagtcttttcctgagcccctaagaactgctttttttttttttttttgagtcagagtctcactctgtcacccaggctggagtgcaatggtacaaacatggctcatggcagcctcgatttcccgggctcaagcgatcctccaaccttagcctcccgagtagctgggaccacgggtgcacaccactatgcccagctaatttttttcttttctttgagatatcgtctagctctgtcacccaggctggagtgcagtggcacaatctcgactcactgcaacctccgcctcctgggttcaattgattctcctgcctcagcctcccaagtagctgagattacaggtgtgtgccaccacgcctggctaatttttgtatttttagtagatacagggtttcaccacgttggccaggctggtcttgaactcctgacctcaagtgatctgcccacctcggtctcccataaatgctaggattacaggtgtgggccaccacgtcctgcccagctaatttttctattttttattttttgtagagacagggtctcgctatgttgctcaggctggtctctaactcctggcctcacgtgatcctcacaccttaaccttccaaagtgttgggattacaggcatgagtcaccatacccagccccgaagggccttttgaagatgcctacttaaaaagtcttgaaagaggtccaaagggaaatgttagaacttccttattttagagcaaatctcaggaaatatggcagtgtttatacattataacatttagatagtacaacaacatttataacaatgtttgtgcattaaactaatatgtatacaatgtaacaatgatgcacagtgtaatattcatatgacatgagacaaactggaaaataaataattgtgctcctaaatgctttttaaagtaacatcagatgaggaggtcttccgctttcaggttaccctcttagcaagttttcttcctacttgctaataggtctacaaggtcatgccctcattttgtgtgccgaggcacagcgtgggcatctcccagccgttttttttttttttccgtcttttccttttgcatcctccagagggcctccttagccctgcagaggtaagaggtttaggcagtgagtagtgagggcagggagctcaactgggccccagagcatttggattcaccaacctttccagatagaagagacctcagaggccttattttctcaaacgagctgagaaagacttgctggaaggccactgcggagctagtggaaggttccggactagaacctgactttcagttccttctttattttttcttttaggaggtgggctccccgccctcacactcccttctcttcctcttcttcctcctcctacttcttgagatgaagctattgccagtcttgactgagggccaattctgtgcctggtactgtgtaaagagctttagttatgtgtgattctcacaaaaccccatgaattaactaccatcattatcaactcctttcacaaacgaggaaacgaaggtttttaggggcaagtaaacaaccaaccaaaaaacttgtttaaaattacaaagctggccaggcgtggtggctcacgcctgtaatcccagcactttgggaggctgaggtgggcggatcactggaggtctggagtttgtgaccagcctggccaacctggtgaaaagcccgtctctactaaaaatacaaaaattagctgggcatggtggcatgcacctgtattctcagccacttgggaagctgaggcgggagaatcacttgaacccaggaggtggaggttgcagtgagctgagatcgtgccgctgcactccagcctgggtgacagagtgagactctgtattaaaaaaaaaaaaaattacaaagctaaaaaaatgagggcagcagaatttgaaccagatccgaccccaaagctggtgttcccacttgcctgtgttgtcctttgaatcgagttactagaggctcaagatgcccacgtcatagtccagacctctttgttcctgcttctttccttccctgcctccccttctctaccttcatctttctccccgccatccctttctccccagcactctaccctgattccgtgatgcttgaattttaattcctctgtggagatggggttacagaagagatgtgggctgttggggtggagttaagtttctcaggagcacaggatggctgctggacttttctttatggggttttgtttttgatcacagatcgattatttctttcagtgggaacagtttatagaacttagaatgcaatcaatgaagaaatatgttttgatttacagatattcacttttttattgtagtaaaaatgcgtaacaagaaatgtattatcttgaccgttttcaagtgcacagcgcggtagtgtgaagtgtatttacattgttgtgccgcagaactttttcatcttgccaaacaaaaactccgtatctattaagcaactttctctctttccccttctctctagcccgtgataaccaccattctactttctgtttctatgaatttgacctctttaaatatatcatataagtggactcatacagtatttgtctttttgtgagtggcgtgtttcacttagcatactgtccccaagcttcattcatgttgtagcacgtgttagagtttccttcctttttaaggctgaacaatattccctcatgtgaatgtaccacattttgggtattcattcaacggctaatagacatttgggttgcttccacctcctggctattgtgaataatgctgctatgaacataggtgtataggtatcacttcaagatcctgcttacaattattttgtacgtatatccagaagtaatattgctggatcatgtggtaattttgtatttaatttttggagaaccaccatacagttttccatagtggctacccaattttacattcccacaagtgttcagtttctccacgtcctcaccaacacgtttttttctattttttgttgttgttttttgtttttaattgttgttttaaatcatatcagctgtcttagtccctttggtgttgctataactgaacaccacagaccaggtaatttataaagaatagaggcctatttagctcatggttctggaggctgagaggtcctaatgcatggtgccagcatctggtgggccttctggctgtgtcataacacggtggaaggcatcatgtggccagaaagcaagagtgtgaatatcagctcgggtctgtctttgtcttcttagaaagccaccaattccatcatgggggccccatcctgatgactttatctaattttatttacctcccaaaagctccagctgtaatcgacctaagaattttagttgcatttcccacacttttaatactgtcacagtggcaactgaatttcagtacatgaactttgagggacacattcaaaccatagcagtagtcatcctaacagttatgaggtgagtgactgggttttaaattaatattctgtattaggcactgtgcttggagtaggggctacaaagataaagtgtgtttcctgccctcgcatcactcacagtcttatggctaggctagtgtttctgcgggtgtgaacacttgtgctagcatcagcttgatgttggtaaaagtactgattcctggccgggcgcggtggctcacacctgtaatcccagcactttgggaggccgaggcaggcggatcacgaggtcaggagattgagaccatcctggctaacacggtgaaaccccatctctactaaaaatacaaaaaattagccgggcgtggtggtgggcacctgtagtcccagctactcgggaggctgaggcaggagaatggcgtgaacccgggaggtgaagcttgcggtgagccgagattgcgccacttcactccagcctgagcgacgagtgagactccatctcaaaaaaaataattaattaattaaaaaaaaaagtactgattcccaggactctttctagacctcctgaatcaagagctctatatttttagaacaagcctccaaagacactcttatgtacaccattgggctaggtcagtagttctcaatttggctgtacattcaaatcaatttctgggttcctcccaggggttctgatttaactgggttgggatgggctcctatgttttagaacttcccaggtgattcaaatgtacagtcaaggcacatttggcgaaacactggactaggtgatttctaaattctttccagatgtaaaattctgcccccagcagcatttttttagttcagcaaatatttattgacttgtctcctcctttcagggctctgggtcagccagggtgtgagggtcaagaaaagactgggctcaaataggcggccttgagttcgtatcctgactcattcatgctgactaccaggataacctttgagaagtccccaaaccaagagagggtgatagaagcctaatgaagaaagtctctgtagaagatgagagaggttcactgtgccaaatgctgctaagaaggggtgaaggatgaagactgggaatgagaaaggattgttggatttgtcattgaggaggccattggtgactttgatgagagaggctttaatggaataaaagagaaggaagcctgattggagtcaagaacgggaggtgtgcaggcagagcagtgacaatagacagcaacttctgggaagtctgtggcagaggagtgcagagaagtgtgaagtacattgcgtcagttgttttttattagaatttcctccactactgctaacactgattggaaaagcatttattaagaacccaattgagcaggcacttatgagcagactcttgacgcaaccctttagtgtcagtgaatatattttggggagcttactttattatggcatttgggttttttggtttttttttaatatgagagtcaaattgttctgattgaagctaactcagagacattattaaagcataaaacttattgccagtttttttgctgaactacaaggggctaggactagtgtgtggggggcatctcactggagaaaacatttcctaagactgagaaccagtaccagttcccacatgcaggagaggatggctgtgtttttactccttcttttctctctacttttccttcttcatccatctcttttcttttattttcctctttacgatccattccgcctccattatcctcctcgttctcttttgcttcctttgcttggcacacgatgcctttatagatgggctcccatctcatcctccacccccagcccagctctcactgtgcactcctacgtgttttaactgctccagtgaagctccccccggctctctgactgtacagtgcctctcatgtctctgtgctcttgcacgtgctgttccctaccttcttcttttggcgaactcctactcatttgtattagggtactcactaagccactgtaacaaagagaccttgaaaacgctggtttagataggagagaattttatttctctctcatgctgcagtccagaggcaggtggtttcgggctggtagggaggctcaatgtgtagttttcagctctggttccaaaatggctgctctggctcttaccatcacatctgcatcccaactagaaggaggagagaagggacaaggggactatgcaccaattctgtttaaaggcatgacccggacattgcacatattacatttacttatatctcactggccagaacttagtcacatagccacacttcactgtgagagaggcttaaaaatgcagtctttggttgggagaatagatattggcagatgatagtctctgctgcaggatccttctagatccatgtggtgtcttctactccaggaaggctgtttcacctgggagtgcccccattcttctctccagcatgacattcaccatcctgagttgggattacctcgtcccttgtctgttttcaactagactgtaaacagacagggcctgtgtgtcatttatctttgaatccctagtaccgataccagtgttgccgcactggtatagcataaatgactcctgagcagaggcattgggggcagtgggactcgggcactgtgcctttatggtgggagggagggcaagggtggtctggcaggtcagccagctggttggccccacatgtagctccctcgcctccctgccttcctcactggagacatccaggaagctgctggtgcccatagaggggtggctgggaaagggcagccccattcctcagccaggtaaacatgcaatcctgaaaagtgtttaatccaaatatttattttaggttcatgtcattgtatctcttaccaagtccaaagggtgatggggagcagggtgtggctgtttcagccctgcactgtttgtgggtgtgacccgcacttctagactcccagggcatgtggccacccctcaactgggaggtggtatgtttcagggctctttctctcttgctccctctccctcacctctatggtcccagcaggctttagcctcttcccctcgtttcctgggcttccagttcctgttgggtcgtagcctccacactattttctgctactctggggtcgtctcctagagatgaggagcaggaagctttggaccctactggggtagaagcatggggagagggcaggggattggcagagtgggttggtctgtgaccaaaaagttcatattctcagtcgggcatggtcatgcctataatcccagcactttgggaggctgaggcaggcagatcacctgaggttgggagttcgagaccagcctggtcaacatggcaaaaccctgtctctactgaaaatacaaaaattagctgggtgtggtggcacatgcctgtaatcccatccattcgggaggctgaggcacaagaatcgcttgacccgggaggcagaggttgcagtgagccaagatggcaccactgcactccagtctgggtgacaaagcgagactttgtgtgaaaaaacaaacaaacaaacaaacaactcggccaggtgtggtggctcacacctgtaatcctagcactttgggaggtcgaggcgggcagatcacaagatcagaagatcgagaccatcctggccaacatggtgaaaccccatctctactaaaaatacaaaaattagctgggcatggcggcatgtgcctgtaattccagctactcgggaggctgaggcaggagaatcgcttgaacccaggaggtggaggttgcagtgagccgagatcacaccactgcactccagcctggcgacagagttaggctccatctaaaaaaaaaaaaaaaaaagctcatattcttagttacctaccggcctgtttctcgtaacttgttattgtgaaagagccagctggcacttctgcaccttgtcctaggaggttttgggctccagaaatgtgtgtatgtgaggggccccttcccctaggtcatcgtcagtgtctagacctgttctcacctgttagcagcttcatgacacaccctgttgtgtgttcccagccctctgcagcgccctcacatgcttgtttgtgtgccacatctgccctcctctcttgcctgcaagctctaggggggcaggtgataggagttccattttagacataaggaggctgccatgcagaaggtcactgatgtgtaccagatcaccctggtgagttgtgatgggatcggaagtggtggcagggtcttctcactgcaggcatgggaagggtgcacgtgcgtatttcatgatcatgctctgagagtgacccagctgggaatgtttgctgctgctgatggactgattgagtccaagggctgaatttgcacacctgggtattctcacggccagcttgaaaaatagatttcctgggtatcccctgagaggtcctgttgatgtcaattttcaggccaggaaggtgtatcttttcccttctatgatgctcctccctcctatgattgttgagaataaagttctttcccatctgggatgtcaagctgtcccaggaggaaagaggaaacatcacttactccatcaggccaagcactttgctatggactgaacatttgtatccccccaaatccatatgttgaagcccattatccacaatgtgacgttattacaaggtgggtcctttgggaggtgactgcgtttggatgaggtcacaggggtggagcccccacgttgggactggtgccctgataaggggatgaagaaccctgagctttctctccgccctgtgagggctcccaccagaacctgactgtgctgcttacctgaccctggacttccagcctcgagaactgggagaaataaaagcctcgtgtttaagccacatagtctatagcgttcttgtcagagcagccccacaggactaagacacgcatagtatgttagaacttctggaagttgaggctgctttcaaatcagccctgggccattgctagggtgggactaggcctccaggcactgtgagcctcagcctgaggctctgtgggatttggaattgtcagccaatgtccactagatattcttcatcctctgggaatgagagacgggccacaataaggtagatggtggacttgtctcttccgatgtgtctggtggcttaactgaatttccctcttgctttcggaagagtcttagagtcaagtatcttcatttccagtataattcgctttaatactctctagtatgccaggcactgtgtggggtgcttaagctatgattgtgaataaggcccttttcctgctttcaagaaactggaggttccgatgcacgtggctaagtatattgtaggaagtgaactgctataaaactagacgtgctttgcccatatgtgagtaggaaagtaggcttaactctcagtgttgccaaagtataaagcgcatgccttgagggttctagggaggaaatgtaaacttgccatttttgtgttttgaggtggttctggaggtttaatatttagtgtactttcaccagggagggattggagctgccagacaactgatgaggttattacaatcatttagagaaaagacagtggggacctggagtctttggggtaggggatgtaaggaaagtaggaaatttgcaagattttcagaagaactgcctggccatggcaattgtatgagagtgggacgtgaagggaagatttaaggatgactgtggtctctagcctgggccactggaaaacggtggcactgttaaccgagacagggctctgggaatggagcgctggtgtggggagcaggtgggaggggcaaggagttcacagactatgatacaggtcaggatgggtgaggaataggctcagagggaatgagaagaaggagccctcggggagatggggagattacaggagtcaggatccacagcatgtagaaactatgttcatgagtactcagttaaaaaagggatgctctgtgttggaggaagtatgttgtcctttctcctcactgggatcttttgtactttttgttatctctttatgggtagtcagggaattgagttcataggaaatcaaaaccccaccagtgatcaagggaggagaaccttctggaagcacacaatgccctggccaaggcattgcagccataggcacccaactactacagggtggagttaaagaaaggctctgtccgtacaccagaaaagcattctgttttggctagactgtgctagagtctttaataagactccaaaaataacaactctgttataaccagcaggctttatcttagagagagaagaatccagttaagaatcgctgcttgatttttttccccattaaaaaaaaatagtttcaacttttatttgagatacaggggtacatgtgcaggtttgttgcctaggtattttgtgtgatgctgaggtttgaggtatgatggatcccattacccaggtactgagcatagttcccagtagttagttttttgacccatgcctccctcccttcctcctctagtagtccccaatgtctattgtggccatcttcatgctcagttcccacttataagtgaacatgctgcttgatttttgaaaacttaaattccctcttagactctcttaaatattgcagttacttatgcaccaacctaatagtttctgaaactctgagcaggctgcatggatacagaaccaaatcccacttggaacagtctagcaccttgttactcaaagtgtggtccctaagccagcagcattggcctcatgtgggagctagttaggattgtagaacccaatgaattagaatctacattttaacaagatccccactgagtcatacgcatattaaagtttgagaagtattgatttggcacagtggattttagatacagttttgcattggattcatttaggtaaaatgtgtcattaaaataacacagctttccaagcctcagccctggaaattctgatttagtcaggcaattctcttgggtaaccaggtttggaaactactggcttctaaagattccaaaatttctgtcgatagacaaatggcaaaaattttagtaaatggaaatctagtttgaactccacgtctgtttgctttacattcatgataatggccaaagcctcatggctttttgaaaaaaaaaaaaaaaaaaaaacaaacaaacaaaaaaacccatgtctagattgacattagacatgacttgtccccttcctctcaggacatcttgatgcatgatgctcaagaggacatgtgtttcccctggccccgtggcagggaccatacactggcaaaagttgaatgggcttggccaattcactgcccagtttgaaagcaactaaagtcagctgatgtttaccaagtgctctggggatgaaagtaattacccaagaaccaaacaatgtgatctccattagttgcatagtttgtctctgtagaagatcatagcttgaaggggcctttcagaactctcctccagctctcgctttagggatagagaaagagaatccatggagaggttgggacctggattccagctggtttcattcaagagggaaggatattttgttgtttggaaaatggatcacatatttgttgcctaatcagaggcgcaaaatgaacaaactttgtattccatgcttaatctcaagtgctggggaaagtgctgtaaacacagaaagatctggctcctagagattggccaggaccgtaagacacatggagtgcagatgccctaggaattcgacagcgagttctccaacgctgagatctttaattaaacaggtgtttgggaagtaggtcctgtgtagcttccagccttggctgggctcgtcttgctgaaaaatggcaccgacccagcccagcagcaggcctgaaactggcttcacttggaggtgtaggaatgtgccattgttgttttcttctttcttatcaagccccattagcttgagcaaggaaggaacaaaaatgggctgggaaaacatgttatttcactgggtaaaaatttactaccaaggaaatgatttttgccatatccaaaaaaggaagagtggaggccttggaaaggtgtgtcttccaagggctcttggaaagcttctcccagtgtcacccagtgagaatgtttccctttggctgatggccgttctcacacaagaactgagatattcagccgacgttaggtacacaggctcacaaagtcagaccttgcctgttcacagtattggagcaaagaaggcatgggaagaggcaagaatcagattgtgaaaaggttgatcatacatggccattaggcacacgtacctttatgcttttggatgcctacaattatagaatcatagatgggcccagagatgcctgggtgcagaggtggagatggagactccatgaaggaatgtaccctggctttccttacctcttgtccagatctcccgccatatgcctggggctcaagggggagaagtccctggctttggctgtagttgaatcacagaactaaccatgcttatagcccatgaaacccctgggctgtcatcctggtgtctttagtgaattctagaacagcatctgcaggaggcagagaccaaccttcttctatcttccacagctgtcagaaacagcacctccccggggaagggagctatgtgccaggcagtcaggctggcacctgtgctcctgttaattcatgaactctcacatctacctacgaggcaggctacatcagccctgttgcagaacacccaaggatccagtaaattgccctgccttatttagttaccaaatgtgggagcctggattcacacccagctctgtctgctcccaaagttcttattctttaacctgctagtcttttctggggagttctcagccctttggtgtatttttcttttaaactttggtgcttggagaatgacctagaaaatgttctccctatgggcatggggaaccattagtgttttgttttgttttgtacagtttttaaaggacattttatttctgttagaatttgtgttatgaaaacaaagtattttcaactttcaggaataaatgctgaactgtaaatacatatatgtatataatatgtgcattcaaatataacacatagctatcatacatatgcatgttatttatatttgaacatatttatgcatatttaatgtgatatattaagtctgttataactgcctatagagattttatttaataatctgtgagttaatactaagatcatacttggaaccattacttttatatgggatagaaaagtgggttgtgtgatgttttctgagaaccagcccactcccaaggggaggacataaaatgggcataaatcaacaatgtaatacccacgaagctgtctgagaactccatacagtgaaggagaggagtgccaatcaccactggcttcctctgcagagtcctgctccaaggactggaacggtcagcagatgtgtgggctgtggccctttcctgtgctgtccgtgagtcacaatggaaggttctgttcattttgttgtccccgagattgttggacagttgtattttgatgtgttgaggccagtttcttcatctggtgcctttgtaagatcttttctgtacttgaaggacattcttttactcctttaaaacacaccagcctgagggacatccctttattccccttgtctttgcatatctgcccacgtaaagcttactgtctggctggggaatgtgagacatagctaagggtatgaaatcctaaaagagtttcccaaatatgtaggccactgtcctggggcctgaaagccctttctgtctatggcctccttggaaggcatcgaggaggtgatattgatgggttttgatgactttcctaagtgagcagttgtttcagattgagaaggccactctgtggatgtctcaagggagaggtgccagtgcaggtgagactgcaaggtcaccagagctgtgctgcttgatgcagatgacgacttcttcctggcaggggcagtgctgggcttttccaggttctgggagagctggtgagcgctttcctccagttgccagggtgctggtcatctgggcagcagatagtcactgcctcacctgtggggagccaagctatggttgctgtggcagaatcctccaagtgcccaggcacccgactggtgtgacagcagccaggagggagcagggagatgagagaactcccagtaaagtctgcttctgggtaccatacagcgggagggaatatgcttgatgccagctcttccaaaggtcatggaggctggggaggacacacacacacacacacacgaacacacagccgctgtagagcataaagaatgaatgaatgggggccgggcacggtggcttatgcctgtagtcccagcactttgggaggccgatgcgggcagatcacgaggtcaggagatagagaccatcctggctaacatggtgaaaccccatctctactaaaaatacaaaaaaattagccgggcgtggtggtgggcacctgtagtcccagctactcgggaggctgaggcagaagagtggtgtgaacccgggaggcagagcttgcagtgagctgagattgcgccactgcagtccagcctgggcgacagagcgagattccgtcgcaaaaaaaaaaaaaaaaaaaaaaagaatgaatgaatgaatgagtgagcaagtgaatgaataaaggattgaatgcacccagcattcttttctcttaggggactcttcctgactattgcacaggaaaagaaagcagaccctgtttgcccatgaggatactgacccttgctcaggttgtcatagcttgtacttttccactgatgcggaaagggaggccctgccaaagaatgtccttggagtgattcaatgtatttttccttctgtgatttaagtcaaatgtatttaatgtaagaagttccgctgtgagctggaatgtgtgatgagtctttcagcctccccccgaggaagcccaccgtgtgaacacttccagttttagctccatcaggtgtgtaagctgacagtggttggcgtggtggtggctgtttttaaagtacacacacccaaatgggcttgtcagctagttggctggaaaaacctttctgggggctgcgagggattgatgtttgccgttcatgtgttcattcattcaatagttcttgaacattaccagggacacagcattacaccaggtgtgttttcaggctataaaggtgagagattccgccccccccgccaaaaaaaacttcagggacttattgacgtctcaaaatatagtttctattgacaattcattaaacaagttagtgaaagttaaaattttaattttaaaatctgtattttaaacaaaacaaatacaaaagtgtcgtataactgagttaattcttttattttttgagatggggtcttgctgtgttgcctaggctagaggtcagtggtgcagtcttggctcaccataggctcaacttcctgggctcaggtgatcctcccacctcagcttcctgagtagctgggactacaggtatgcgccaccacacccgattaattttttgtatttttagtagaaacagggttttgccatgttgcccaggctggtctcaaactcctggactcaagcaatcttacccaccttggcctcccaacgtgctgggattacaggcatgagccactgcgcctggctgagttaattctttagttcagtaaaagtgctggagtttttaaaagagtgaacttcaaggattttgatcttcggcctgaatacttcgcacacatgcccacgatggggccctttgtgcccttctgagtccagcctggcctgctggcatgcgtctggtttctctctgtaggacttggcaggcacagttgtgtgggatgcaaattacgcaagcacagaggcttgggaacttgctgccaccaagcctctccagtgattcttctcctgtgttggtcaccctcacccttcattcccctcaaggcaggaaaaagaacagaaattcctaaggcagtgttgttcccagcacacaattgccatccatcactccctgctgggaaaatgtaaatacgcaccagccgatagtggcactatttattgtcatagacttcactgtggatttgagcaggagcagcttctggccaagcattattcaccagctcccctgggaggctgtgctcggtgggcagagctgcatggaagggaggcaaaggggaggctggagtccttgcagctgagaacagggctgggtctttgccactgaggctgcacatgcttaacatcagggtggagtggaggctgccgtcatcttggcactaggttcttggaggtcgttcatgtttagaggagggaaagccacttccataggattcccagacagctgtcattttggggtagggtggggactgatcagcgttgttagtgttgggctgttgcaggtggatggtggatttgtagccatatcacctgaagccgagggaccactgctcacccagttgaacgttttactgaagctcacaaagccctatgctacacaaggcccttgccctcaaggagcttgcacttttgggtcttagacacccccatccccaccgtacgtattcaaagaagccaactgaatggatgatgatcaagtctgcaatctgcagtgtcaggaggcagacagcgtgggagtggggtcagtaaaaagcaacaaaagctcagccctccctcagcccagtctgccagctcccccctgaatctgcttggtcctgggtggcatgacctctgttagacctgcacggagtagacttagagtcaggcaggcagggaggcctggactcagctcttggcttggtgcttactagctctttccactcagttttcccatctgtaaaatggggattgtgagcccacctcacagggtgatgtgagagtaaatacaagtaacaaggtaggtgtcaggcacataacacaggctcagtgaattgcagctttcagtattacttccgactgcacttctccattcggtgaaggtggagaaaaggtgtagatgagcaaaccctgatgcaggaatgaagaggggagggaaggtgacccaccaaggtgcaggtgaaggcagggctgacaaggagaaaaggttttggggtcctctggaccaggcagatccaggaggcaccgtggatccttgtggagtaaattaatgtgtgaatatttaatgaaaagtctcttcctttaggtcaaagtgagagtgtggcatcgggaggtccatttcaggatcttgggcgctctcccctaaagtgcagtgcaggggagaaaggggaggaggatgtttcagtttcaacaaacagttttgagcactgactgtccacaccagatggcttgggaatggccatgaatatggctcgatatctgtgctctgaagctctaagttaagaagggaccgaggtggatgcaagtatcttcatgccaccagacagatggcagtgggctctagagcagcatagagagacttgctgtgagcagaggacagacagagattagccccaggaactatggagtggagcgaagactggagagcttcagaccgaaagattttcacgggtgaataccattaagcaactggactgccagcttctgttggcagggaactttttttttttttttttttttttttgagacagggtctcactctgtctcccaggttggagtgaagtcgtgcgatctcggctcactgcagcctccacctcctgggctcaaacgatcctcccagctcagtctcctgagtagctgggactacaggcgcatgccaccaggcccggctaatttttaatttttagtagagacggggtttcaccatgttgcctgagctcgtcttgaactcctgagctcagatgatccacccatctcagcctcccaaagtgctgggattacaggcgtgagccaccatgcccagctggggacatttcctttacttctgttttgttctcagtggtgtttatcatagtcctgtgcacacagtaggtacgcagcagacccctgtttaacatatgaatgaacaagcctaatacaaaatggctttctaaatcaagtaatggttattgtcaaggtaatgcaccttcaaagagcaatggcataggatggcagaaggattcctgaggataagggttcccttcttggccatttccctttgtggatttctggtgagcagactagctcagccttcagtagaggtcagtgtctcctagaggtgcccatcggggaagcactgccacctccttgggtgtaacctagtgaccttattaactgcctcccagccaagatgagccactggcacccctggtggctccagggctctagatggatgtgagtgacattctttggactatgtctgtattacagatgtggacgagtgtgcaacagattcccaccagtgcaaccccacccagatctgcatcaatactgaaggcgggtacacctgctcctgcaccgacggatattggcttctggaaggccagtgcttaggtaacagctctctgggggggtcacagggactcttggaagttaacggttgccaggggcattttgaggtatgggcatagctggctgcctgagggtagtaagcttttctttgctagggagggcgggaggggtggaaggctattgaactcacatgtgtaaccacccttgaaaatcaattgccatcatcgccatcttgtcatcattatagtttttgaatgtatttatttatttttgagacatagtcttactgtcccccaggctggagtgcaatggcgcaatttcggctcaccgcaacctccgcctcctgggtttgagtgattctcctgcctcagcctcccgagtagctaggatcataggcatgtgccaccacgcccagataatttttgtattttttgtacaaatggggcttttgccatgttggccaggctggtcttgaactcctgggctcaagtcatctgcccgcctcaaaagtgctgagattacaggtgtgagccaccacgcacggccttgaatggtttttttcggtttttttttttttttttttttttttgatatggtgtctccctctgttgcccaggctggagtgcagtggcacgatcttgactcattgcaatctctacctcctgggttcaagtgattctcctgcctcagcctcctgagtgagtagctggcgtttcagtcatgtgccaccatgcccagctaatatttgtattttttgtagaaacggggttttgccatgttggccaggctggtctcgaactcctgggctaaagtgatctgcctgcctcagcctcccaaagtgctgagattacaggtgtgagccaccatgcccagcctcaaatatattttttaagggctatggttttggatgtattttttaagtttgattttaccttgactttcttcctgtcttcacgaagtttatatccaggccaggaagtgacagaggtgaggatgattttgctttagttagaaataatgctaagagaagggaacactttcgcttagtcacagaaatgtggcaagtcttgaatgtggatcagtagatcctgatcttacatcagttcctttcaacaccctgtctttgcccttccccgccaccaaccaccacacccaccccaccggctatggccttccattttactcctgaggagtcagtcatcaccaattgagaactgcctttgcagttagcatctgctctctgatctttctgtttattttactggaaggttattttcctttcttcccctctagttttgggtttagccaagtgagtgaattcacagcaaactctagctgtcacttcaatttctaattctagggtgtgatttctatgctgtgttttctagaaaaggccctgccagtttaaattctctaagacaccattctgttgcctgaaagtcagtcctggaggagttgagaaacagatccaaacgaaatcatggaaacaaagaaaagctacctcttgccaagtttcttgattgaggctgagtaggtctgccctcaagccccgtccgaagcatccttgaggcctagattggcttgattctcctttccaggcttgcacatgggcgtctgtgaatatgacagtcactgtgcattcaaaccaacctctgctataatggaaaatttgatgctacttatttgaacataagcagatcagtgacagagagttatttgtacaggaacttaatatgtcgaatttcagagctggaaaggatgttgaatattatgtcatccaacttttatagcatcgcagactgagactcatagagaaagaacattttagacaaagtgagttgggtctaacttccaagtctcccgtgtctcagtctagtttttttttcccaccacaaggggcgctggagtggtagggggagaccgggctataccagccctgttacagaaaccctctgatgtgaggggtgccagcaactcggacattcctctacctgggagggttgttctcttcctgggagcatggagctgtggaaaggatgctcatggatgcctagcatggtaccatgtggcccagccactcatattcacatctgaaaggaagacgtcgcctaattatggctgaactcctgccctcccctggctaaactcacctttccctttcaaaatgcaagttccatagccacacactgtctgttctgtgtaccactgaagatgctgcttttgcagaaaaatgaggggtcaggggggctgccttttttccaaggtacccgtagtgaagggtaccctctccagcccctgctgcctgcctggccttggtgatgtgcccaactgcactctgggaagaagtcagggccagccactgtacagccaatgggccctctatgcaagagctgctctgcactcaggggcagtgcagtggccaggttagaagtagccgggacttagagacaaaacagaatcacaggacagggcacagaatctgagaagggctgaacaataggtaagggatcaagatggatctgggaggtggagtccttcctggcagtaggtagaaaccaggcacaaggactgaggctctaagccggcttccagagtcctggatggcccctggttccaaaggaacagggggaccagggaggaaacctggttagattgggggaggtggggataaggaccagttccagctacagtcagatcaactggtcacagcaggagcctgtattggtgccatctcagactctgccaggaggccggtgatttcattcactacccttaccccacaggaatgaattctccagcccattatcacatcagcttggggtgttgagaagtgctttcccaatgacatcaggctccccattgatggatacatattacagggaggtcacattgcccagctctgctcaaaggatccattcacccacagtgccgccgctttccctggcaaggccagctgtggcttggaagagatgtgtttatccagagttttatgttcactctggtgcaaggaggagattcagggtgaattccagtgccctcatgttactggattcatgggtctccagggtcatgctgcccagctcatcccagcctaactggctcttgttcctgacagctggacatattcattgttcatggagctggcaaggagcctattggagtgatgctatggattcttcttacgtgttaagaagaatcctgggcagtggagcctctatatggaatctttgagttgaatcttaacattggataaatcttaagagctgggtaatctcaaatcttagagctgggaaaaattggagagtccatcttggataaaccttagtgttgaatcttagagctgggtaaaattggagagctcattttgcccaacatcccaatcgaagcagaaatttcttctgcaacttttaggataggttcaggtatttatgggactgagatgggtcgaggaggggaaagattgtggggagattgagccttgtattcgagacagcatcaccatccgtgacactcagtaggcactgtcttggctcctgttcccatttgcttccgttcatgatcctgtttgggaagagcaaggcaatcatgccatgctagtgggggcatcattgagtgaggagacctgtctcactttgcttgcatttctgtttccagacattgatgaatgtcgctatggttactgccagcagctctgtgcgaatgttcctggatcctattcttgtacatgcaaccctggttttaccctcaatgaggatggaaggtcttgccaaggtatgtgacgtgcatgataacttggacatgatgtgagacactagctgcagccttcttcagcacctggcagcttatgtttgtgggaaatactgctgctacagtatattcccattccttgccactgcccgcccatccccattactacagaaacgtgagacctgaaccttgctatgcgaagcatctcaaaaagtgctctgaatatggctgagggtaggaccccaatcctccactggctgggagtgtacagtttcatggattcgcttcttttctgtgtctgctatccagaagtagccttgctggctttcttgcctaatcagaaatttggttgcatgtcctgtagcctaagttcagttcctgaggcctgaggagggttggtcagggtccctggccctccaagaatcataaaataaacacatccacgctaggcaggggtgtcgtgggcgattctgaggtctcttgctatacttttccctccaacctgtgccaggatggcctgttcctcagcaaagggtctggtggtggtggtaacatcccctgctactcagcgtgcccccacaaaaccagactgaaacaaaggcattttgtggttttcacatgatcatttgaaatactgataagtaagaaaaacaagttgcatgcctattgtggtttccatctgaaggtttcttctgctcaggaagtgaatgggggacttaagacccaaggaattagcgcaaatcctgctttggcccccgacttccccctcaaattccagctcccggcccaggcctccagcccctggcagctgcttggcccaggttggagttggaggcagtgctgcagacgcagaatgaggtctttgtctggagacctcaggctttgcagggcccatttccttgtttcattcacccttggagttctggctggcaggctcctggccattgagtttggaggctattaggtctcctttactttaattgtatctaaatcatcggtaaataggaaggcatcagtgttaaagagtttgaccctggattctttctaagtctctcctccaaagcttgttctgctaattgttccaagaattctggactgtgttcctcacgccaaaagaggtcattttcttctgagagtagacaccaggccaggaggttgaggaagcggataaacaagggcccttccttcccactggagcaggagggggcgcctggctcccttgctgctgtgataagcagcttagggcagatgcaggcttctctgtgccaaggcctgggattggaggtgccagccacaggctggcaccgtgcccccagtacctcctgaggcatagccatgcccaagccaaaaggtgcctgcgtctttcaggcctctgagggacaggtgtgtgacaaagagcagataatacacctggcagtgccaagtccacagcataataaagcagcaggcccggcacccaggcctgggtatgggcactcagccactgggatgctgcatcagcagggcccatgggcagcacagggcgtcgcatactccggtgagcttttgcaatcctgactcttcgtgtgtggaagagtgctgtacacgctagagcattgtcacgtctgttcatctcactgaacccaaataataaatagcctcgtgaggtcagcaggcaggtgtttgtggctctgcttcactgaggaaataaaggctcaaaaaggttaagcaacttggccaaagtcacacagccacgtggtagcagatctgagagtaaaaccaggggcccagacttcttgtccaacaggttggagtggggccctgtgtgccctcagcagattcagaagggcatttggaaagggctggcaggaaagggcagtgagaaccccaggggggcagaatcattttggtcgccctgctcttcagaagcagctgagagcggtgagggggtggaatgagttcattcacctccgagtggccagcgcctggccagaggctgaggccaccagccctaacacttgccggcactgtcctgtctgaacttgcactcagtggcttagcacagtggacattttcctaccccctcctgtccccggtggggaaaccccaacctcccacgggcactggtgggggccagtgtcttgctagaccctctctctacagctgttcatttatttgttttctccctgagagctccagagatgctaggaggcaggaactttgtggccatgggattagcctcccctgtaagaaaagcctctcagtctgctcaccgtgaaggcttttagctctgaaaacactgacatctcttttcagaggcctaagaggtttacatggacttgggaagaggatagaaaatctctcagttggaactttggccattggtgtatggagcattgtgggatggtgcttacaatgggtcaaccaatgccagtgggaaagaggctcttccctgccctccccgcacgatgagctgtgcagaatgaatcttggtttttgtggaaaaacccctgactcatgttccagttcccactgtgtgtccttgttagctggtggacttgggtacacctctcaatcttcaaaaacaattatatgtatatgtgtgtgtgtctgtgtgtgtgtgtatatatatatatatgtattttttttttttttttgagacagagtctagctctgtcaaccaggctggagtgcagtggcgtgatctcagctcactgcaacctctgcctctggggttcaagcgattcccttgtctcagcctcccaagtagctgtgattacaggcacctgttaccatgcctggctaatttttttgtatttttttagtagagacgggacttcaccatgttggtcaggctggtctcgaatgcctgatctcaggtaatccacctgccttggcctcccaaagtgctgggattgcaggtgtgagccactgcacccagcctataattttattttatttttttttgagacagggtctcactctgtcacccaggctggagtacagtagcatgatctcagctcactgcagcctcaatctcccaggctcaagtgattctccctcctcagcctcccgggtagctgggacctcaggcgtgtgccacatcacctggctaatttttaaattttttgaagagatggggtcccactatgttgcccaggttggtctcaaactcctgggctcaagcgatccacctgcctcagcctcccaaagtgctgggattacaggcatgagccactatgcctggtccttcaaaaatgcttaaacaatcttattgatgcatagtcagtgtataataaactgcaccatgattttattaattttgacatacgtgtacccgcatgaaaccaccaccaccacactcaagataatggatttcccattagtccttgtgtcccttggtggtcttctccttaacctacttaacctctaaagtgggccaatggtcctcgttgtaaggatcaagtgagtgcaggatccttccctaatgagcaaagttatttatgcataataaatatattattagaatcatcatggttatttgttaacctgaaacttccaagtcagtgagggtgaggggtgttcactgatggaatgcaaccggtgatggaaggagcaggtattgcctggaaattcctggttgggggggtgcgttggagcatagacttaccagcaggtgtatatgtgtatatgtttatatcatgtgtatacatatggtttccactttgcctgacttttgaccccagaagggacatgtggatggaggccccggtccttaagtgaacacttttggatctaagatcatgctcccaaaggtcctgggtggagagccttggtacctgggactctggtctcctggtggtggtagatttcgttgctggtgctttttctgcctagttattgtggctgttctgttgggaggacagtcagcaatgtgccttggctttccacagatgtgaacgagtgtgccaccgagaacccctgcgtgcaaacctgcgtcaacacctacggctctttcatctgccgctgtgacccaggatatgaacttgaggaagatggcgttcattgcagtggtaatgggctttcgcattggaaacttccacctgtacttggggcctgggcaggggttgaagggcaagggcttccttcataggtgtttcctctcatttcctggacacatgtccagtttgggacatcctccagggcagtggggtcagaatcacacagaacagagatgagtcacttcccaaaaggtgaggtggagtctcatcttccttgtcatctgacccttgatgcaaaaattaatggggctaccttctaggacagaggtggggttgaagagggagagcagtcacccgatttggcatgttggtttgagagctgtctgtcctcacccagcaccgactcaagtcttggggatatcacagaaagtacttacagagggcagtgacccaggaataatagcatgtcttatcgggtagggttggggggaacattgaatgaatgagaacatgtatggaagcacatatgttctgtgaacttctgaaatctctacaaataatcagtgcctcactccaggcctggcacccagggaacatgcaaaaaaaaatagttctcgaatcaatggataaatgattgaatgttgaatgaatgaaatcgtaataatttgttgtgagaacatagatatgatgggttagttgaccttttataaattccttccaagcccaaggaaataagattttctgcccacactagtttatggactctattataattttcttattaactccctctttttttcccctagaaagttaaattttttttcttagttagaaaaatattattggattgtaaactccttgagaatagggaccacctcttactcacatttatctctgtagcatcccacatagggccacacacaactccttttctttctttctctctctttccctttcttgccttgttttttgtaaaggttagattaaagtacactccatttcagccacttctggcatcatcagcagttgtgaatttgcaaagtctaaattaataatgcttcactgtgctttcaaaataagtgggccatacactagggcgtgaaaaatctttctgtcctgcagaatggaaagtttcctaatccgggttttattgtaacaggaactgacccaggtcatgaatggaacttgtgtgatagtctcactgacaactgaagtgttctggggacagcgtcccatgaaacagatgaacacctctccctagggccaggacagtcagagccacaagcaggaagttccagagagccttgggctgattaaatacaaggcccagaaacagaaataaaataccctcaggcatgaaaagccactttcttcctagatttcagttccctccgtggcactccttggggagttggggccaaggaactaagaagtgtggaaaatccaacattatgtggtgagatgatttgtttctccagaatcctccgttaatccacagacgtttattgccctactgcataggccatatggtagagtgaccctggaggacctgagttcaaattctagctctgccatttactatttttcttgaccaagtcactccctgagtctcagtttcatcctttattaaaaaaaatcaaccagccaaccaaccaaccaaccaaccaccctcatagagtggtcaaaaattaaataagttggcacggcccagagggtggcccagctccaggctggttccaggctggctggaagctgctgcttcccatgtcccagggaggatccaaggtaggcgggccactgagagacaaatattcctgcctaccccacaacactctggacttttctctttcaaggaggttttttttggacacagtggagttttagtcattacatgttaatttatcttccctaagtgtaggtgtaagagacttttggcttcttgagaagcttacatccttgccgatttggccaagattttcagttgactcattttgccccaaatggccaacttgtcctccatggtctccatgatgcacaccctcctgaagacttggtgtgaccccgggatatgtaggctttctagagcagactggcccaggataacagggtgatggagagagtctgtttctgcaccttcctacttaacccctttctgcacttctccatttccgcaggcactgttatcctcactgtgttatcacggctggggtggcctctccgtgtagccccagacccctcctagccttgtctctcagggatttgctaagctgagctgttcctggaaaccatggtgggttctcatgtggaggagtgaaagtggcctaatacatgctccctgccagaaactgggcttgtatttcagctttccactggagggtggagccacagccctaagcaaagtctgggaattgcagacccaaagataaaccgagtagggtctgttacagcccctccctgcccagtgggagttgggagtaggtgctacgctctccatctgccctggagctaaccctgcttgggtgcttgccccaacctcagggctccccagctccgctgatccctcagcacagttactcagggagacgttacagtgtcgtgtttctaagtgtaggatctagaggctgggttcaagtcccagctttcctccttactggttatctgtgaacttggtcaagtcagctaacctctgtaagtctcagtttttcttctgtaaaatatggagagtgatagcacctccttcatggggttgaggtgagaattaaataagaggaggcatgtaaagcatttaacccactgcttggcatatagggagcctcaggaattgacagacatcactactactctactgaaagtatgagtggaatctacaaacttggaaataaaataggacactcagttatgatgggctggagccagagacccggggctctacaaggcttctaggggaggcggggaggcacaaccaaatcagatattacctgagcacacgtgacttttcaaatcagcatcctaattctgctggctgataacccatcacctgaggacccctgagagagacaggaaggagtttttccttctgggatgtgagaggcacaaggcgtgtaacacccggaattatctgatggtggagaggcagcttcttttgcgttgacaccctctctgggtgactccagccaccagtggtctgtgagtgagagagtaatccgaggacatgtcacatggggaaactagtgaaagcaagtttttgggaaacaacaaatgcaagaacaacatgttttctttggcatgcttatcgaatgaggctcaaacaggggctctgttgccaaactctgtgtgtgatgaagagttggcttttctggaacgtctgcttctgcgtctgcatcaaccgccatagcccatgcggatgagttgtaaatcacatggacaggggctcccctccacgtcaggctggctggaagctgctgcttccattgtcccagggaggatccgaggtaggcgagccacaaagagaaaaattatatccctgcccatccctcaccactccggagttttctctttcaggcagtttttttgtttgtttttgtttttgtgtgtgtgtgtttttttttttttttttttttttttttacacagtgaagttttaatataattaaaatcctggccttttggatatgtcccttaattgtgactttaggaacaatattgttcctgaagttggggaaagaggtgattggaggggagttggcattgcgaaagttgccccttcagagggccctctagggccagggaatgtttttttgggaaacccccagaaaatcccagtgggcaaagaaatctcagccccttaggcaggtcagaggcggagggtggattcccctacatggtgaaataggtttataatgaatggaaggtgcagccgagtgagaggcagatgttgaaagctcgatggaggtggatttcagctccatgtaggaaataattttctgacaattagagctgtacaaatatcaatggttatcctcagtaggtagtgagctctccattgctagaagtgctggagaagtgaattgacagcttcttggcagtaaagccattgtatgtatcaagacagtgtgagagttggagtagatggccactaagctcccatccccatgtagactgggattacaaacagcaggtgtgacttgtcaccccagatatggacgagtgcagcttctctgagttcctctgccaacatgagtgtgtgaaccagcccggcacatacttctgctcctgccctccaggctacatcctgctggatgacaaccgaagctgccaaggtaaggctgtccggaggggcctggctggggtgtatgtgtgaggtggagctgcttcaggggctcatctggatatcctcacctggggaatcatgtgcagctttgggaaggtggcaggggtgggggtgtgagtgggtgctggtggctctcatagtggcagctctgggcaggatgcctggcctgttgtcttccttccctgtaacccgtcctttggccaggatattggccacttaaacttctgtaatgaactctgcagatgcagacggcagcctctaagcgtggctttctgcctccccaggcagatctctgaggctcctctgagaaccgctccagagctaagcaggacttttatggcctggccagagcccgggctttcttacgtggcccggagggcagtttggttagcctttctccaagtgatctcctagagcatggttgccagggagacctcatgcacctgactgctctgttcctgcaagggctgggaccccagactgtaaaaggggtgggccttctcctgtttgcctgcttagcctgggttccagccccatgctccacccactgaggggtcattgcagaagcaactgacccattctcagcctccttgaacctgccttatcccattgccaagcaagaattctccgtagtagtgccaggcaatagaaatatcatgtgagctacagatgtgagccatctatgtaattttacattttctattagccacattaaaagaggaaaaaaatgggtaaaattacttttactactatattttcttttctttctttcttttttttctttttgtgacagagtctcactctgttgcccaggctggagttcagtggtgtgatcttggcttactgcagcctctgcctcccgggttcaagcaattctcctgcctcagcctcccaagtagctgggactacaggcacatgccaccatgccgggctaatttttgtattttgtatttttagtacaggcgcatgccaccatgccaggctaatttctgtatttttgtattttaccatgttggccaggctggtcttgaactcctgtttttactactatgttttctttaatgcagtatatccaaaatattatttcagcatgtattcaatataaaaattattattgatgagatgttttacattctttttttaaattaaaaaaaattatatatataaataaataaaattaagagataagaccttgctttgttgcccaggccggtcttgaactcctggcttcaagtgatcctcctgcctcagcctcccaatgtaccgggattacagacgtaagccactgtgcctggctcacattatttcttggtactaagtcatcaaaatctggtgtgtattttctacttacagcacatctcaatttggatcagccacattccaagtactcagtagccacatatggcctgttgctgccatattggatagtacagctctgtagtaagatccagcctaccccacccccacgcgtctggcctggccaataatgccctgcctccgcttcttgtctcccctgcatttcagacatcaacgaatgtgagcacaggaaccacacgtgcaacctgcagcagacgtgctacaatttacaagggggcttcaaatgcatcgaccccatccgctgtgaggagccttatctgaggatcagtgataagtaagtcacggcgtccccctggggaatagaaacctgatgagggcctggctcaggaggttggaggtgtggtgtgaaagagagtgcaccagccaggaagtgaggggacctggcctactacctacgtcatgtgctcatgcgtgtgtgtgtgtgtgtgtgtgtgtgtgggtgtagaatagaacagagtagaatagatagaacagactggaatagaaaatatcagagtacattgcacatagcaagagtcaatattgttttttgaaacttatcttttagttttgtgtgctactgttttgcagtgcaaagtgtgttactgtaggttgtcaaaaagtttgcaaaacattccattccaagttatagggtctgaaacacatccctacatacaagaaagaactatttttcaaaatgtttgaccacaacacacagtaagaaacacatgcaaggctgggcacggtggctcatgactgtaatcgcagcactttgggaggctgaggtgggtggattgcctgagctcaagagtttgagagcagcctggccaacatggtgaaaccccatctctactaaaaataccaaaaaaattagctgggcctggtggcacgggcctgtagtcccagctactcaggaggctgaggcatgagaatcgcttgaacctgggaggaggagggtacaatgagctgagatcgtgccactgcagtccagtctgggtgacagagtgagactctgtctcaaaacacacacacacacacacacacacacacacacacacgcacgcacactcacacagagttctctatcactccgctactcatgccagagctatgcaaagattctctagaaagctaaccaagccgagagttgagtcagggttctagaatctcctcttccctctaatgactttgttctggatacatggggtctttcagaggttggcttctaaatgtaacactcataggactcacctggtgatctcgttaaagtgtgattcagtgggtttggggtggggcccaagattccgcctttctggcaagctcccaggtgaaatgaatgcttccaatctccctggactgctccgtgaatattgaggtgctggagagttgagtattgaggtgctggacagttgagtattgaggtgctggagagttctctcgttggtgctaatcaagtttctgacgtcatcttggtcaacattttactaaatcaccagacggcaaatattagagttgaggagagaattaaagtgaagacaacttccaaaaggtgaatgcagtaggacagtggctttctgttcctggcatagtaggagttccttttccttctcttttatcccttttttaaaccatctcagttcctccttggcctcctatattccaaatgttcacacatcgacttcccttgagcaacaccaaaccccgcatgggagacgaaaggatgaatcaggcacacccatcctgccctctcggaatacagcctctaagagaggaattcatggcttaccagtggtacccactttgataacaaattggcaaaagagaggataatgccgggacaggcggatcctttagggacatcttcacttgttgctaagagctgtgctactaagcaaccctttagaacagggctctttgacccccgacgtaaggcctgtttgtggcagagcagagctccaggctgctcttcccagcttctattcctggttctctctgggtttttccaggccacccctgtctgtggctggggagctgacccatttcagcttgcagcactgagctggagttactggtggagtctctggcatgacgctgacaatgctccgtgactccctcactccaggctccagtccagtcagactccggcagccccttccagctccttgtccagttcaggtgtcctgtgctcctgccagtctgaacaggacttgctcatgcctttacccgtgcccaggaatggccagcctcccttcttgtgtgcacatacttccggccatatggaaggcattcctttcatttccacatagccagtcctgccccatctttcagatttcagctcagatgccacctctcccagctgtttgtggtcctcttcagctgggagccatcactccctcctccaaacttcttttaggaaacaatgattttctatgctgcacatgatactttattgtggccattttggcactagagacattttgacttggctattttgatgcagccttaaaaaaatgaaacttgctctgccacccaggctggagcgcagtggtgcaatcacagctcattgaagcctcaaccttttgggctcaaacaatcgtcctgcctcagccttttaagtagctaggactatgggtgtgtgccagtgctcctggcatatatatgtatttggtaaagccagaggtcttgaactcctggactcaagtcatcctcctgcctcagcctttcaaagtgctgggattataggcatgagacaccatactctgctcagaatgaatggaaatttataaaaaggaagagtaggctggatggtttagatggaggagtccaaaggcctctctgaaaaatgacacttgggctggaatgggaaaatgagttgactttaactaaatagagagtggaagatcagaaggaacagcatgtgcaaaggcgagaaggcaagagtgcattgaaggcactggagatggttggatgtggactctcttttggaagtagaaccaacaggttttgtggatagattggaagttagtggcagaaacacagcaaggttgactcctagcgttggccaccaccgcgcgtctcaacagacatcttcatcctattgtgaaccctggcccctaggtggagtctcagggcagggtcagagacagaggaagggggtgttaggggtgaatcaaggggtgtctataacaggcattctttggtagtaaaagtcagtgattttatattagggcactctgttaatagttgctttgtattagagatatttgtgtctgtggtttatttctcctattagaaagtaaactatctgaggtcaggatcttattattcattgaatttccaaaatgtccaatgtcacatcttgtacatagttctaactcttgcttatcaattatcgaatgacaagatttgattatattcgattcagtaacattccatgcagactgggctgagcacaatagagaatgtacaaggatccccaagacctgttaatccagtttcttactttaaaaatttctttctttcttcctttttttttgttttgtttttttgagacagggtcttgctctgccgcccaggctggagtggcatatttggcctacgtggcaaatgtaaagtatcttggagaatgttctaatgttctgaaaaccagagatctaaggtttgtattctatttagtagccagaacatctggttggtgagaaaagtccattctctaggaaacagagctcgcctacatgctggagagattttagactcaagccaggagcagagacattctacagttatggcatttggatgctaaaaatggggtggcctcattttcagtgttttaagagaggaagtaggcacagccagcacctggaatggatttcttgagttctcacgtgatttccctttccacagccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcgggtaagagggagtggggagtggggacgccatctgtaacagtggccttgtgctgtctctcctaggaacatgctgtatgcaagcaggtaagagtggggctgggggacaggtaggcagagagaagagtggagggtgtggttcaaggtcctggtttccaccactttctgtgtagtcttgcaaaagatgcttctcctcctgagcctcaggatcctcatctgtgaaatgggaagttaggccaagatgcaatcttaggtctcttttctcctaatattctgttggagaggcattcacgtctccacttttcaaccaacccatgtgacaagtatttcttaagtacctcctatgcaggccaggcacgggggctgatgcctgtaatcccagcactttgagaggccaaggtggacagattgtctgagctcaggagctcaagaccagcttgggcaacatggcaaaactctgtctctacaaaaaaaaaagttagccggtcatggtggcaggcacctgtagtctcagctacctggggcagtgtggcggggaggtggtgtgagatgggaggattgcttgagcccaggaggtcgaagttgcagtgagctgagatcacaccactgtactccaatctgggcaacagagcgagaccccatctctgaaaaacaataaaaacttggtgacttaaggcaaaggaaatttattctctcatagttctggaagccaggagtctgaaatcagtttcactgagctgaaatccaggtgtcagcagggctgtgctccctctggaggctctagaggagaatccgttccatatctcttccagcttccgggggccgccagcacttcttgactgtggctgcatcactccaatatctgcctctgtggtcacgctgcctcctcttcctcctctgtgtgtatcaaatctccctttgtctccttcttatattaacacctgcgagtagatttagggcccattcaaacaatccagataatctctctgtccagattcttaatcacatctgcaaaaacccttttccttataacggaacgggttccaaggatttaggacttgcatctttttgggggctactacccagcatactgcacccaggaatctgcatttctaacagatgctgctgtgatcttccagggtcactgtggggagccatattgaaaaggtccatgggcgtttatatgctttcattagagactgggccctatgaagtcatgggccacaaggcaggaagacagaaatcttcccgataaggctggctttccgagggtccatgctgtctgaagctgcgggaccctccccgggaaaccactcagtcattctaatgtgagctctggagccatgtcttctacagtttaacaatttcacaattgtgtgatgtgacctaacacctctggacctctagatgagtgtttactttaggattagatgagattatccacttagtgccctatctggaatacagtttttatcaaagaagtggagtttggtggtgggggtgaaacagtcaatgactttttctttttctcacgctgttggatcaaacctgtgagcacctgggttacatctcacgtcaattccctaggattcacaggcatgttccatttctattggattgtctcattctctcacgtcaaaagtctgtactagtttaaatggaaacttcaacctctctgtctcttacccactgtgaagtttctccctgtctcctagttcagagcaggcaaggggtgtggttggcctctgccctgtcctcttgtcaccctcccggtaatggtagtgctggccctggctcctccagggctggcaggggaggagcaggtggtagaaagggtaaggctggaagagtgaggctcctccccgattgtagccattgtaaccaggcattggtattccctcaggagcagagcccccaaagctgttgctctcacagggtgcttttgtgggtcttttggagatttgcctgaggacttcacactgaccagtccctgatatgggcagtagggcctgtggttggtcacctgctactccaaacctctcagcccctaattctggggctatgtctcatacagatgtgccgtggtggtagtgaggtggagggtatcactgcatcctggcagcagaccttacacaagggcctttcaggatgtcaacatcagctccttgcattccccgttcctctctatggtgtggggcagctcagggctcacatctccagacttctcctggagacagtctggtaccactttctgcatccttgaacttcaggggcctgcatctctaaacagtttttctttttttgaaaacccctcttgattgagatggaggctagtaagtgtgtttaataaaatatatgtagagttgggcacaggggctcatgcctgtaatcccagctactctggaggctgaagtgggaggatccctggagcccgggagttcaagtccagcctgggcaacatagtgagaccctgtctctacaaaaaaagattaaaaaattagccaggtgtggtggcatgacctgtaaccacagccactctggaggctgagatgagaagataacttgaatccaggagttcaaggctgcagtgagctatgattgcaccactgcactccagcctgggtggcagagcgagaccctgtctctaaaaacaaaaacaaacaaacaaaaaagtatgtatgtaggctggagggggtgatggaatgagggaaacatctggctttggatcacagctttgtaagtcctgtataaccccaataactccacacacagcatcagcagcaagccgtgtatagtgcctgtatgtgccagacactattctaagtgctttctatacagtaaccctttaatcttcacaagaatcctatgatataggatggttttatcgtccagattttacagatgagagcactgaggcacagagctaagcaacccgcccgactagtctcacaactaataagcaccagggcaggatttgaacctaagcagcctggcaccaaaaatctgtgctgttatacttttcttcagaatggggaggtatgctttacctactcttccagctttggggtctcagatgaaatggagatcacaagaaaagtctaacatccagttacaatagaaagtattccagaaatagcagttatgattgtatagatactgttgtggccactgctactgttgctgctactgctgcaaggaggctgggagctgctgggccatggagagcttgggaatgctacccaggggactggagcatcgtgtgggaggtggggctggatggccatccaggctctcacaccctgagattcattgatttgattataaccacatgggaggagcttcatctcaccccgcaggcaaaccacacacacacacttgcatgcacacatgcacacacttatgcccacatgcgtacgtgtacacacacacacaagcccattcataagccttattggctgcctgtctctcactgagccctagaaagaggactgatgattggctttggccaggtggcttgggggtcataattagggccagaagaaggagcaaggtcatggggttcagactgtgccaaagtgcacttactccatgacacacgtggatcaagtgacagggcccatggaagctggcctgctacagcgtggctgcttgccacaggtcagaccatgccatcccacaagttgattagaataaacctgagtgtgtttgggatcagggccaagaagacacacagctggtgggctgttggcagccgactcccagcgtggtcaagtccactggcgttcagtcattcgtgtgcattcttccgttaccagcgtgcattcagcaccactgcatatgaggcttcaagtcaggcactgagcgttgagaaacaaacaggatgtggtctctgccctggaggaacccacacacaccttagcggagagggggaaaacaacctagcaaacacaacacaaagtggcgattctcaagtcaagtcaagacccatgggatggtgagtaaatggagaggtacagagaccttatcagagagtgtagtggttagaagcatgatttttggagccataaagtctagtaccatgcagtagtttggtggccttatgtagtatccctaacctacttagagcatagggttgtgaagattaattaagaggtgtaggaaaggttgtagccagatgcctggcatcataaccaccaccgtcatcactgtcgccaccatcctcctcctcctcatcttttcgcaccaccaagcctactaatgcccacgggctctcaggggtttatttcattaatgccctggctctgccctaaaagccgaatgtggaggtggctgtcctcagctcttgtggcaggtacttgagctcttccaggtgcttgtgggtagggtggacccaggtggaggccggactcaccagcttctgcagttacttccaaatgggagagtctaggatttcaaatgggatagttgaggattctttcgtactcaggagacatttaccaggagagcccaaaggaacaacttggaagtttgcacttgcccccttctcccttccagaccttgggctctgcagatctccctctggagggctgtccctagctcagggttctcaactcttggtctttgttcacgcagtgaaagctggtgagatatttgtatatgtaaaggctgcaggcatttccttgtgtggctttaccctctgaagccctggcccagggctcaggtttcgtaagggctgacaaggaagtccaagaaatctgcgtgaggaggtgccaataacgtggatgctgacgggaacaggaggaaccagtgccaagaggaaattgtgtggctgtcaggctgccgatagcctcatggataggggaggtcccagcgcctggcctgcacctgtctgccagccccacccttgtcttacttgtggtggctcttggggatgttcagaactttatggggcgccctccttttatggagacagataaaacatctagtgtagctttaaaccagctaggttcctttattttgcagagactgttgcttgcagcttctgggcacagggctgggctctgcagtgtatgggaagtgattgtccagcccatcccttttcttcttcacactgtttcctctaacagtgccaatatctgtcccttgcactgaccgcgagcatctctcattaggtgggtgctaggaagaagtgaaacacacatcagcctcttctgatacctgctgtgcagtgaaaaaagcctggggcttggggtcagaaatacctgaatggaagcccttggttctgcccaagactagctgggtaaccctaagcaattatttaacctcatgggacctcagtttgcttacttataaaacggggaagtaatgagtcatacctttcatacagcacttagacaaggacagccagggcccccccacctgggtcctgtgcttttagatcaatatttctcaatacttaatgtgcacacaaagccctggggattgtgttaagccacagattctggctcagtagatcctagccctgagattctgcatttataagaagctccctggtgatgcccatgctgctggtccagggaccacactttgagtggcaaggcctttcagggttttatgagaatttttttttttttttttagctggagtctcgccgttgtccagggtggagtatagtggtgcgatctctattcactgcaacctctgccccccaggttcaagcaattcttgtgcctcagcctcccaagtagctgggattacaggcacctgccaacatgccctgctaatttttctagttttagtagagatggggtttcaccatatcagccaggctggtctccaactcctggcctcaagtgatccgcccacctcggcctcccaaatgctgggattacagttgtgagccatggtgcctggccattttatgaggattaaataagcagatgtacataaacatggttggaagagtgcctcacacatgatgggtgctcagttgatgtcattcctctctgccttcctccttgaaagttttagaaaaagactcagtggaggagagagttcacgcgaaattattaggaccacagtgatcaggttacagaatggtgaagctggagatgactctagggtgcctagaggggggttcttaaattccacctttcccaggcatcacctaaaaatatactgacatagaaaatcttggaatgggcccctggaattgttagtttaacaaaaaaagttccagtagcctttgatgcctttttttttttttttttttaaattactgatctggtccaaaccctcattttatttttcctcaaaaacgttttttaaaacttttattccactttcaagagtacatgtgcatgttggttgtatagataaattactgtgtcgtaggagtttggtgtatatatgatgtcatcacccaggtaataagcatagtacccagtaggtagtttttcaatcccctccctcctcctgcctcccaccctgaagcaggccctggtgcctgtttttcccttctttgtgtccatgtgtatgtactcaatgccaaaccctcatttgagagatgagccccagaggggtgaagtgacagccctaagccatgcagaagtttcaatcaatgattcgttcatcattcaatatatgttttctgaacaccttctgtgttcaaggcaccatgctggcttctagggggactcagtggtgaaaagcctgaccccagtacctgttcttacagaactcatagcctagtgggagcctagatatcagacacggatcaggtagacagtatggacaatcatacatggtcataaatgctttccatcctgtacaaagtaaaggctgcagcgtcagaggtcgcagggggacctgacttagattggggaaccagagaaggctcctcttaggaagtgacctttcagatgagacctgaagggtttgcagaaaagaaccaggtggagagtgggcaaagccagggaaagagcatggcacagttgaggcaccgagggggtgccagtttgactgacggaggcaagggagcgcccaggtggggctgcagggccaccatgcaggccttttctcactggtgttccccggttctgtccatagcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagagagcttgtgtttggttcattttgacatcatagacgagtcagcctttggggttctagttctgtttaaacctgtttattgtgcgctggcttagaaagctctccagagagctagggcattatctgtgactctggcaaattgatgggaggggggcggtggggcagagaaataggggtcgtggggaagttagggggaggcatcatccctgagtcctgtttcatctgattagaaaacaaccaacaatccttctcttacgtagattatttccggtgctcctgcagaacaggaatgtattcaagttactttaaaccagtggccttcaaccctggctgcatagacggataaccagtagaactttggaggaaagattgattccccgggacatgcccccagacactctgatgtcattgggcttaggtagggcccggccatcaggatttttgaaaacttgactacgtagccagagttgagaatgtattgttataaaccctagaaagagaggtggacagatggggctggagccctagctgccttgccctcaatgtcttttctgctcattgtaggatacattattcttttcctggtcagggcctctggacatccttcaagtcttagaaccctgtgcaggggccaagagagtcaacattgcaagtcacaggagaacaggttgggatggctgtctttatgtgccatcccaggaatcaacccaaggcttcaggaaaaaagtgcactccctgatagctgaggtggagtctacagatccatctgagggtgctcccatcctacctgttggtgaggtattcattaaggacccccacagtgcctatcaggagttgtgtcctggacccctagtcttagtaggcattccacagatccttgtgatatggacaggagacagggaaatactgggtagaagagggtggttccctggcaaaggccccaccctcaagcctgggtacccatggccctaaatgaggacagccattcctgttttcatccctaaaaagttgccttttggcctgccatgtcccctatcctgtacccatataaaccctgaaccccaggctccaggctccagaagcagacggggagacaagaagatgagcagacatgaatggcagaaaagcacggcaaagaaggagagaagagaaggaacattgggaggaattcgactggagacgatctgaaaactggccactggatggccaaactccaggggaagatcatcttcccactccatcccctgtccagctccccatccatcctacttagagccacctccaccactcaataaaacccctgcattcatcctgcaaatccatgtgtgacctgatccctccgggatgctggacaagagctcgggatacaggaaactgtcacactggccctctgccctggcaaaaagggagagggtccactaagctggttaacgcttaagctgtccacggatggcaaggctgaaagactgcactgtttcagtgcctactcgggctttggaagtcacagacaccgaccccgggatgctgtcatggggctggggcccaaaagtgctcaccctggttcctgcacctgcctgtctgcgtgctccccttcccataaggggttttagcttggggtggctgaagagagagccacacccctgttgcacatcctgtgagggggccagggaattctcctgttccacttagtagtatcttaggccttcagtggaaggaaacagcatgttccacgccctgtagcatccaagaagctgcaagtcctccctcctcaccccaagagcatttctcacacccacaccacacacctcactttgctgttggctgtggttatttttttctctaactaagcacatctaaaccatgcctagttgtggttcttcagtcagggtcaagtggtgttagcaatcacatcagcaccaaatggctcaggatgctctggtttcaaagcttataaaacagagggtgattcccttgggactcactcagctcggctccgaaaagcaaaggccagaaggcagcagtgagcctgggtccctgctgtgtagggagactcaggggctgggaagaaggatggaatcagaaatgctgaaggtttacgtgagctttgcaccgagcgcctccgaaccactgcctctgggctcaacagaacacaggggtaagtctccatgaacttctcaaaaagaaaactgggaagctttctgtcttgatgatttgaggacccactggtttcagaggtgccacatttggaaccagatccgagtctttaaggtttgtgttttatttgttcatgtcaaaatgtggcttcctgcttctaagaaaagaaactcagagaggctcataaaagcagcctccaagggcttcttggacctcaaattgcgctttcaaaatgtggtctgatgggttcagtgtaaatgcaccagaggcatgtgggatccatttaccttaaaatacacttgggcctaaaaattaagagaaaaacagtccagggcaaagtgtatactgcaaagtcaagctccaaacatttgggaaacagttctagaggctgctggaaccccaaatgctacttgctttacctaccccttgggaatcatcaaatgttattttttgtacaagactggggatgagcctgctctctgatcccagtgctgtgctctgctgtgcagttctaatggggcaggctgtttcctggaccctgagatctccaggctccctgtgcctattccttgtcagctttgccccatccaggagctgggctgagcttgtcaagtgacctctgctttgtaccactccatcaggtcctgaagaatgaagggtaccaaggtggaaggggcgcaggattaagagtagggacgcctgcaaaagctctcgtgttaccacctcatcttccaactttcatgtgggtgaaaacgttcattctaaataattgcttctaattctgaagttttgtgattccttgaaatgtactttggggatgacagccagcatttccatttcactgcaatttcagagttttgcagtggtttgccaatcataacactttctaattggcacaaaatccacctacctgttgcctctcaggcttgggtaacatacttcagacactttcttaggtaagtcttggcccttggggtgttatttgcccagatggtaaaaacatttaagtaggtctgattatttcattttcagtggtttcaacgcatttttgtggcctgggtggttactgtaatgtgcccaagttgttcattctgagccaacggggtcacccacagagagaagacttgacaaaggaactctcctctactcccctcttgccagatgaaatattgtttgtaaaaggtctttgtcttgagaggatcacatactttggttaagaatccactttggttaagccggttgctggattcagagacatgaacaggatagacagtccaccgataactttataataacacctttttaataacacctttaataactttttaataactttaaaagttattaaaactttataaaaagttaatctaaaactttaataactttttaataacacctttagccaggggtttatgcagcatacacgacaaaactggaatataatgtggtaggtgcagtagcagggtccacaaaattattttagttagattttaaaaattattaagacatctgttttatacaagaaaaattcttatgaaaatttatagacatgtgtttgaaatttagaataagttgcctctgcttagaattattaagtattttgaaaggaaacactaataaatgctagataaactttttctttttgatacaatttgtgtttactttaaatgcaatatttttttatctgaaaaaaaacgtgagcacttagcaaatctcttcattattttggaattggccaatgcttataaactacaaacaaatatacagattgttccttgtgctgatatttttgttttcaaatttcttagtcctgttacttaacaaatggctgatatctttgttggaatccctgaacatagctaaaagatgtttttttaaaaaaaaaaaaaaaaaaaaaccaagaggctccaagacaaaggagtgcacagaggcaaaatttatcactttggtagcttttgcggggatgaaagcctccagttagaatgtttgacttactaatggttcttaataatgaatcttagccagcagccatcagagaaataaatcattaaagtgagaaaataggtgtcaacacaggagtgatctactgaattgccattttggtgttctttcagaggggaactgcatgttgacaggcagtgactttttcaggaatttgggatattcttgagcaataatgtaaagatgaaggcagggggctgggcacaggggctcatgcctgtaatctgggaggccgaagtgggcagatcacttgaggccaggagttcaagaccagcctggtcgacatggtgaaacccgtctctactaaaaatacaaaaattaggtgggagtggtggcacacacctataatcccagctactcagagactgaggcaggagaattgcttgaacccaggaggcagaggttgcagtgagctgagattgcaccattgcatttcagcctgggcaacagagcgagagtctgtctcaaaaaaaaaaaaaaaaaaaaagatgaaggcagggtaaattgtacacacatacaaatacagtgccattatgatacctgtttattaggatttgagaaattaattaacattgatttaaggccacagagtcattggatcacttgattctgtttaaaagaagttttcgtttgggtaggattgttttggtttcaacctgttccttttttctaagtcttcgtttccaaccttctactcagaatgaatttgacattgcaaaactggcttgtatcacgatagctactatgctttaaaatagggtaggtgctttggcatctttggagttttaacgtatgaaccattcataatttatccctaaagcgagtgtggattgttttatttgtgaacgttctacatcccctgatctgaaaacttaccaaaaaagccaacattgagatgaagcagggaccccttttaggggcctccttccccctactcccctacaagcatggaaataaagcgaaatcttgagttcctgcaagggaaattccaggcacccagctagccctgagaagtaaggagcaacttggtaaacaagaaggtaatagtagcttaaaacaatagccagggaagttagagttgcgagatgtttggttccctccagagactaaaggtaacatcttaacatatatccctgagttgtttttcagaaacccagacccccaccaaatggatcccctggcatgcagacctcaggtaagggagaactgaggactgaattctgaggactgaattctgacctctgttctttattctgggtttttttctttttttttgccagggtctggctctgttgcccaggttggagtgtagtggtgtaatcatagcttactgcagcctcgacctcctgtcctgtgatcctcccatctcagcctttcgaggagctgggactacagctacgtgccaacatgtcaggctttttttttttttttttttgtagagatggagtctggggtctcgcttttttgcccaggctgatcttgagctcctggcgtcaagtgatcctttcaccttggcctcctaaagtgctaggattgcagctgtgatccaccatgcccagcctccattctttgttctaaactttttcctgaagggcctggaggaagtcacacccacaggccagaccccacattcttttctgctgaacccaagtcttttgacaaagcttcccttctttaaccaattgcaaatcaaaaaatctttgaatctacctatgactttgtaagccccccacttcaagctatctcacctttttaggccaaaccagtatataacctccatatatcgatttacaattttgcttgtaacttccactttcctgaagtttacccctgcctttagaaacccttgcttataagccattggggaggtcaggtcttaggcgtgagctgcccaattctccttgcttggtgtcttgctaatcaatccccttccttctcccactataaaactttggtatgaacgtttggccttactgcgctgggcaagcccactccagtttggtttggtaatgtcactgaaaccaagctatgatatttgtagataccttagatctttatggtgatgctgtaacctcatagttttgttttgtcttattttgttttgttctagttccacatttaaaaagatctcatggaggtttccgccccaaggctggcatttccacacagccagtctttctaagccagtctttccacaccagtctttctaagaagcagccctatgggccagtaacagctacatttttgttgagcaaaggcactattaaaatcatcatctacatctttcagtaaaaccataattagtcaaggagatcctttcaactcagaagtcatacagagaggtagactcctttgcttctggcttttgttgttgttgttgttctgttggaactttggaatgtgttatcttgttagggccttcaatgagattaaagaaaagaatccgggacatcatttttcaccataaaagctgggacttttcatcagtaggtggtgaagagttcccaggtgtactccaagaagttttggaacaataaggcacaccaaaaagaagcaggctgcctcatttggagtgactgcagggatggggcaggccgcagggaggagaggaagtggctccttccagcaaatgctgagccaagttgccttgtgctcctcacacttgatctgcagcagcaggaggcttccatcctaggaaattgcctcgaggctgctcttgatcttaattttcaccagatttccctcagccccactccgctcctttgctggttcaacaaagaccaacaaacctgttgacggctgaggtgaaaaccaagaggaaggcagatatgggtctgattctctttctcttcctcttcctcgcctgctcaaactctgaatccatgctttacttctttttctctttcttttttttttttgagacagagtcttactctgtcacccaggctggagtgcagtggtgtgatctcagctcactgcaacctccatctcctgggcttaagcgatcctaccatctcagcatcccaagtagctgggaccacatgtgcccgccaccacgcctggctgatttttttgtatttttggtagagatggggtttcgccatgttgcccaggctggtctcaatctcctgagctcaagtgatctgcccgcctcagcctcccaaagtgctgggattacaggtgtgagccaccatgcccagcctataatttaaattaagaccaattgattaaatgagttaaaattacaaaattgagttgctgagtcagatgcaatgcatatatatacacacacacatatacacacatatacatatataaacatatatatacatatatatatatatattttccaacgacatggtttcactctgtcacccaggctgcagtgcagtggcacaatattgcctcactgcaacttccaccttccaggctcaagcgatccttctgcctcagcttcccaagtagctgggattacaaacacccgccatcaggcctggctagtaaaaataggatttcaccatgttggccagtctggtctcgaactcctgacctcaggtgatccacacaccttggcctcccaaagtgctgggattacaggcatcagccatcatgtccagctcctgtttacttctgcataagagctggtgacccctttgcttccctccacttcctcctcttgtttcttcccctgcctctcttctctctcttctttctttctctgcactggcccaccttcccctccgtctgttctccatcccaaagttggaaggcagtagtcagggttaggtcctgtccagtgaaagcaaagctgggtccaagggacaaagcacaaagctttttatgcattattacttcttctgccttaaattcctcttttcttctctccttagcacacagaagcagtctctagaacaactcttcctgagcaaagccatagctttttgttgttgttgttacttgccctcttcctgttccggctttaaaaaagaaagtatctgtatcaacttatgtgaacatggtactttcttgtggctgttcttctgaggattcattctctggtctttctgatttccagtctctccatcctagaatcaatttccttcattccagtaccccttgtcggagatccaggctacctccactcattcccaaacatggacttcaaaacatctttccagcactccttttgtcccactccattatggtatccagcggcttgacatgatgcttctgttcttcatgtaatctacagcagagaggctgggaaaaactgaagtttctttaaatacaggacagtgcagtctccagaggccagagcctctttgccagtcacaaagaacccttaattgccttgtaaaatgtagtccagccctcttcacagattcgcagattacagagttattcatccaaacaatttccacgtactgcatagagggtttcatggacagtagccttgattcagaccaacctgtatctctgcaaccctcactacagaccactttttcacagtggagttgctatttggctatggcttaaaggatgacccagaattcctcaagcatagaaagaggggaagggcagtaagaagaccagtgtggttggaacagaggatacaaggatgtgtgtgtgtatgtcaggaagggataaaagttgaggctagattattcacaagactattcacctagttgagtttggacttcatattgtgcaggtcagcatttcacagaagactagcccatgaagatgctaatcaatgctccaagatcaaggagctcacttgtttaataagttggggatttgaatgctgaatcccctttttaaagagtcacagttgattttagaaaactgaaggctctgagaagtcctgcaatgaaaagaaaacctgcttaattttgtataaaggttaatccaactttttttttttttttgcaaggaaatgatttccccccttccccagccccccataacaaaaattaacatctccaggaacaattttccttggagtctggaattgctgctgtctgctatgggaagctgtggtgaggttttaattttgttttgatttttaattagggaagacacatcatcttgttttctactttggaaatggtgtatggagggaggggagatgagaattaagaaaaataattgcagttgttcacataagagacattatttctaaagcgatctttctaaagagtaagactgactaggtccttagttagaaccctactgacattccctctgcccacaggttaagattcaaactcctgaataggattgacaaaaccttccgtgatctggttcctgcctgctgctccagttccagctcccaccactttcccctcctttagaccaaattcttggagaaacaaacacatccccaacaaaccagaatggcttatgtactccctccagctgctcctgtctgagctcttctcattggctggaatgcagttcttctctttgcccatttggcaaatgcctattcatctttccacagagatcagcctctctaggaactttccagagccatccctgacctctgtggtctgtgcagcccaccaagcccccacccctgtgtagagggagtcacttctgctgtattaccagtgcccctgtggtgtagtttccacctggggttctaaatgcaaactcctgcatgatactatttgtgtgttgttcataatgtagacttacagcctagcacagtgcctggcccatagtaggtggtcagtgtcaataggttgagtagaatgtgatgatgggaaaatgcagagaaggggaaagcttcaggagaagtggaatgggtggaatcaataggtcttggtgattgatcgggtacggaggc

SEQ ID NO: 137 - DNA, 2236 bp, Homo sapiens
cgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcaactgtgaacagcttgctgtcacttcttcacctcttccactccttctctcactgtgttactgctttgcaaagacccgg

SEQ ID NO: 138 - protein, 446 aa, Homo sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMWIKGPREIQLDLEMITVNTVINFRGSSVIRLRIYVSQYPF

SEQ ID NO: 139 - DNA, 2696 bp, Homo sapiens
cgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 140 - protein, 446 aa, Homo sapiens; identical to SEQ ID NO: 138

SEQ ID NO: 141 - DNA, 89824 bp, Mus musculus
  misc_feature (1)...(89824): n = A,T,C or G
ctttcaagtagctatattttggctgacagttttaagaatactgaactttccccctcttgaatagcaactcatctggcattgagatcaaattttccaagaaaaaaaaaagcagaatagcaaatagacatgtttccttaatcatatagcaggtatcctgaaaaaaaaaaaatctaaagtgtatatgagcaatgcttccctttccttgggctctttattctttttttaaatatttttattacatattttcctcaattacatttccaatgctatcccaaaaatcccccataccctcccccccacttccctacccacccattcccattttttttttggccctggcgttcctctgtactggggcatataaagtttgagtgtccaatgggcctctctttgcagtgatggccgactaggccatcttttgatacatatgtagctagagtcaagagctccagggtactagttagttcataatgttgttccacctatagggttgcagacccctttagctccttggatactttctctagctcctccattgggagccctgtgatccatccaatagctgactgtgagcatccacttctgtgtttgctaggcccaggcatagtctcacaagagacagctacatctgggtcctttcaacaaaatctttattcttttagacattatcttcttctttaattactcaaaggtatcagtcattagttgagcaaatgcatttgttcattaataaaacaaatatttattgcccattaattcagtgtcaggctctatctcaggaactatgaacgaaagaagttaatgacatatgttcgttatatttagagatttcccgtaggagggtgaaatttgtgttactgataatgtaacataataaatagaaacctgttcaaaccacctcatgagaaggcttaagaggacacaggcacatttcatggatctcccacatagctgggggaaaaaaaaggaaatagaagacacagaactcagactcgatctctgtctttctctcagaagaacccaggagagccaagagtcaagtagtactggaggagatgtggggagagtgatgtaaatatagtacacacatatggaatttaaaataaacttaacttcttgaaagcttctatgatgagggtttaaagatgaagacatgtataggaaaagaacttagagggtagtttatttccatgtccactaacaaatgttgttagggtctcccaaggtctaagatctatccagcaatggcttttgtttttgttcctggtttctattcctctccagatactagttgttccttgttaaccaggctttaaatccaatcagaaagattggtcactcccataacatccatgccactaacgcaccagtgggcatatctcaccaggccagtcactactgtactttccagtattcacagatctttaaggctgttaatgaacttctcctggccccagcaacatgcatagaacctttcagcactatgaaagtgtgccagcttccaggggatgatgcttccgggtcaataccagtttggtatcttcgtgtcctgtgactcagataagtggtgtttccagccatatggtattaccatcaagttgtagaagataagcaagaagaacagcagtagccagtaatgtttgaagtgtctacagcatcccattgaacaactactcaaataagtacaggtgtttcaattgatagcttacaatatgtggagaggcactttatcgtcaccataggttacttccttttaagtcccatttataatgtatatgtatgcattttagtgagcttctacagtagcttttcacatggcatttcccacaggtctttagcattaattatccttaatgtagcactccctcctctgtttgccctcctatcttaaatgccattgaacccttgtagtctcttcctccttttctctttataccacctacattctgtttccttttccctgacattacttccccacagtttcctgccttgcatgggcactccaagggaagcacacatatctaaagattcaaagccaacatgcacatgtcagagagaacataaatcatttgtctttcaggatctgggttactttgctgaaaattcaattcccaactccttccatttactggaaaattttgtaatgtcatttttcttttttttactgacagctgaataatattccattgtgtcatgaagctcatcttcattgctcgttgatcatttatggacatctaggttgttgggattcctggctattatgaatagaacagcaatgaatattgactattttgggaataggcccaggcatggtctggatagatcccatgatagatctaattctgactttttttttaatggtgtttctatggtgcgtttctttgtggctatacaagggtccactctcaccagcagtataagtactgctctttcttgcagcacttggtgattaacacaaagactcctgaaaaagatgcagagagtgagagactttggagaactaaatgttatgccttgattatctgctcccttcaaggatctgagttacatgcagaagaatagacagagcgattgtaagagcctgaggttgtagtaatgttaccatcacaactaaacagtgtcttccaaacacatcagggatgatatgcacacgaattcaccgagattgtgacagcgtgcacaaaacttgactgaattagtgcaaactagagaaatcccagaacacagaaatggaagtaggcatagagtccactcctaaccaagaagttatttgcaacagatacctgcatggagaggggaaaaaaatcctttttctccacttaaatgtctttagcaatcatagcaaccacattacagggaaagccccatgcccacaagtagttggttaacacaaatgaacttcatattgcttgtgtgtacacacctgtgtgtgtgtctgggttttgttttagtatttttgtcttattgaattttggtttgtttgtttgttatttgttgagagatatggaaagggtggaagagggaggcagagaatgaagtcgggtggataatgaggtagagaagacttgagagaagatgggggagggcaaaatatgattataatagattgtgtggagaaaagctaaatagttacatgtaggggatctctgcaaataccatggtcagcagagtttgagccttgagaggctataagactatccagttcaacaggactcagtaagtaaatatcaagtgttggttcaaatttctggagtctgacctcaggtagtttatgttaggcacatttaagcacagcacaattttggaaaaaaagtttcctgatgacaattgactcaatcctgtgtttataaccagacaagattcgaccgaaactcctttcaaggttcatatgaccatttccataaagatgggttctattgactgaaaaacaatcctcaaaataagagtctaggaaaaatgattgagataaatataaagtctggggaagacagatgtggcctagccatacaaatagagcagaggcaacgaggctgccaaccatctctgctccatttgtaaagtacatgtgacatctaccataggatgggttctgtcaactgaaaaactgttcacgataaggaggagctacagagaaagagtcaggataaacttaagagtttgatggagtcagatatggcctggtcctacagatagcacaggtaatcaggtttttaactacatccattcccagcctttgggtggaaaacaggttatacatctctttcaccaaagagacaagcctgtatgtttaacattgctggattctccggtgcttctctgtgatcaccagagctgtgtgccatctataattatcctttttgcaaattaatggttgaagactttccttcagtaacatgacttccactagcattgagtaggtacctaagtttacagtatcgagcatggtatttctcttgttgactaggtcttaagctcactgggagagctgttggttagcaccagagtatgtcacgacttcagccttaggattattgtaccatgctggtcattgatgaaattcataggtatcatagctaggtaggacagttggttgccctcctcttttggaaacttgtatgacaccttctggtaacatgaagtttagtccttaggaagagtgcattcaagtcagttctggccagtataactccctaacgataatctataaacatttgccttcttacctacagataagtaaggtcctcacctctcaggaaggaaacttctctttgccacacatggagaccactatagagaatcacaaccaatcaaaatgcacagtagtggagccaagtcccaatggttacatctatgaaacacgcccaagcctaagtctcagagaacactgcagaagaggaagcagaaagattgtaagatggaaaagatcaaggggtttgctctgagattgggtctcctagtaacatcagaaggaacagccataaaatctcatcaacatgattgctgaaacatgagctggataatcgtgacactactgaacatcccacaatgtatgagaaaagcccagaggcctccaccccacacaaagaactgtaggcaactggggaaggctgggaagggagaggtggctttccccagggaagaccacagcaactgcttatccagtgccaagtcggtctgtcttaaaacataccttcaggtagcattatacagacttaaagggatatatatatatatatatatatatatatatatatatatatattcactttttcaaaaactcagatataagactccaggcatatgtgtgggccctcaattctattccatcaatcaatcaatatgagtgtatttaagctagtctcatgttgtttttactacaacagctctgtggtataatttgcactcagggatagggagaccataagtagcatttttattattcaggataattttggccattctcagccattttattttcacatgaattttgaggttattttttcaatttctgtgaataattaccttgtatttctggtggggatttcattgaatccatacattgcttttggtgagatggtcaatttcatgatattaattctaccagtacatgagtatggtaggacttcccatcttctggtataattttcagtttctttcttccatgttttaaagttttcattgttcaagtccttcattttctctgttaaattaattacaagacttttccccctgggactatttgaatggaattgcttccctgatttacttctcagtatgtgtgtcgtttgcgtacaagaaagctactggttttgtattctgatactttgctgagtatgtttatcagctatatgtgaattccaatagactccttgggatcttttatcatatcatttagaaataacagtattttgacttctttctttcttatttatatcccctttatttcctttcccccccccccatgattcctttaggtaataattcaagcattgtattgaacaggagtagagaaactatttctgattttggtggaaatgccttgagcttttcttcattttccatgattttagcagtggggttattgtatattgacttttctgtattaagatacatcctctgtgtccctagattctcctgtgcttttatcattagggagtttggatttttgtttaaggtcttttctgaatctaataagatgatcgtgtcatttctgtactcgagtctatttctgttccaccttagttcttgagaaaggattcctcactgaatttgaagctcaccatttttactagcctggctggccactgagcccttgggatctgcctgtgtctcccttccaaccctggacttacagatttatgctgccacactctatttgtgtgtgggtgctgtagctccaacctcatatccttgagtttgcctactgagctcatatccaaagttttataacaagcaagctcacatctctgaaagacaattgtaatggcaagtataaagtgcagagagaagacaaaaatggaggaagtacagaaattatgagaagactgttgtcttaggtattgtcctgttggggtgaagagatactatgaccacagcaacttagaaaataaaacatttaattgggagcttgtttatagttcagcggtttagtccattactgtcgtggtctggagcaggatggcaggtagacaggaagacattgtgttggagcagtagtcaagagctacatcctgaagaggcagcagacacacagagagaaacacttgacttttgaaacctgaaagcctaccccaatgacacacttcccacaccaacaaggcaacacctcctaatccttctaacctcagacagtttccactccctggtgactaagcactcagatatatgagcctgtgggggccatattgattcaaactgtcatctgataagaaatcttacaagcaacagggctcatggcacagggtgtacagagctggtttggtaataaggtgtcctagtggtagccctgaggaagagaaggagagaggtttctagaatggtggttgtattgtatgaaataagcaaggtgacttagaagagaaaggatgtcagaaaggaacatggggaactgcttctggctcctctctccctcatccaacaaattctggtccagctttgagagaagagaagacctaggaaagcctcttccatccaccatcagtttcagatccaaagacccgtccaagtgctcagtgacggcaaaattacgttcacaataatactgagcggtcagtcgcctttgccactgacatcataagacaaatattgagtgatggtaatcagcgtggagggaagcaagggaccagtgaacttcaatgctgcagaatatgaagaggccttgatgtgtgttcagatttcttaactagttttaaagaaactgagtttcctttttctaatcctccatccgcaatggaacctccctgccaagatgaagatttcacacaaaaccttttactgggaagatcgttggtctcaagactgaagtctctgacactacacaatatggaaagggcaagatccaggatatggaagggatcccccctgatgagcaaaggctggtctttgctggtaaccagctgggagatgggtgtacatcagactgcactcaaaaggaactcaccctgcattctgtgctgagatttcctgagtcttacaccagtcctaggaagaataagcagcagacaaagaggggtaaactgaaatgctggagaatggacgaaaatggcaaacatgatcacctttatcaagagcatcctttgatgagtgtggagctggggtttttatggccgtccacattgacagacgttactgtggcaagcattctctgtttaactgctccaacaaaccaggaaccaagtgatagtgtatgagttagcaagaagtcaagaactaaggaccattggggggaaaatactgcttattaaatttttatacaattttagaggattatgtaaaatcatcacaggtttagagactatatagttctgtgttacaatacattaagccttatgatttaactcaaaggacatgcaacaacagggtcacatgctgagccagatatgagaattaacatgtctttttaaaaagacagatattagaataattaacaaaaatatagagcaatgccattcttttgatttacaatgaaaaaatattttcttaaatatatgacatttctgcaaatatgtaatagtttctggtattaaaaattaatacacaaatatctgaaaattctctgttttaatattttatatggtaaatgtaatttttaaaagttctttaatagtttgaatggcataaaaaggacctgaggctacagtgggaaagcccagcccttgcctatttcctgacggggatgtggtttccaaactaactaacccaggcaaggtatgtgttaggtaagactgccaaaattattttctttcagctccttcatgctagttaaatattgtaacccacaaatttgctctttgtttcctaacatttttgcctgctctgaaagaaactctacagccccttatctgacctgtgtccaatagcagtatggtgctcatttatcctgttctaagagcaacacgcccccaaaagatatgcttccttctcaccaactcagtcaaaacacattacgaagagccaccctgcttcccaaacaagagtctgctgcaaacagaactcacatttcagtgagtcagaagggaacaggcagatagtcatctccttgaaacctggcaggcttcctaccaggagtctgagctgcccggctgtgtgtcagggttagtgagcagtcacctcagagctctctggtcttactaagcactcagagcaccgaaggtcagaagtgtcttttagggtgtataagtaaagaaatagtgggtgagtgaggcagcctgggggctatgaggttcgagggtgctgaatataggacattaatcataagttctagcggccggtgagctccaacttggtaccgtcatgagtctagctggtcatccagtctagcctatttggcaagatccaatccggtgatagactatcgcaacacaaaaggtggatggttgtagggaataacacttaggtttgtcccctggcgggcatacatgtgtgtctacacaaacacacacatcagcacacataaacctgcacacatatgcacacacacaaagaagtagaggttccagttctacctaccgttttataaataggtttaaagcgtttggcttttcccaagtggctacgtctgtcccacctggaagttgctcgcttgctctatggacctggggagtcccttcttgctcagaggcctgctcccaagagattttgaatgagcaatagccattagacaagcaattctttattttacaaaaccttttgagtgcttcagaaagtaggcactggaataattctagcctcatcaatgggcaggaacctgcggctgagcttctacggatattgggtttaaagacgattaaaagtgcatgttctatttcttggattcaaaagtgaaagacccagatgaatgctgtctttccagaatcggaaagtttgggaaatggcaaggcacgagctcaggaggagagattctcaacccgtgggttgcgaccccccttccatcggtgtaccctaagatattgggaaacacagatgttacataacaattcagaatcagagaagtagcaacgataataattttaaacgataataatgttgaggtcaccacaacataaagaactgtgttgaagggtcgcggcactagaaaggttgagacccactgcatttgagcccctgtcaactcttctcacctgtcctgaaataaatcaggtaaactcagtgatccaactcctcatcgtctcagaaatgaacaatccccacccccctctctctccctcacacccctctgtggtgcaaaaatagtacctcagggataatcatagcttgagagcagctctttctgatgacttagtgtcgaacctggtcattccgagcttatttctgtccctttctccacccactcaggaaaagcagagaagggcacacactgttcaggtcccctggctcttcttctgagttattgagggctatggcttgatacaactgcgttggggggtggagggaactgcctaggagttagtttcctgtggacagaggacgaagagatgttggttgtgggtggatcctgagctcttgggtctggtgagctagaacagtttggtacaggtaggaaaaagccaccgggctggagtcgcgtccgcactgtctgtaagatgccgagggctccgtgggcgtccatggatcttgactcctttttcagagcgctggaggagccacagacgctgaggggctgggctccgtggggcgtggcaggacagatccggagtttgcccaggctggaggggcaggcaggggcggttcctagctcagaagctgcaagcaacttttccttgctctcattcaggctggagagaactcctccgtacagtttctggaaagtctagcctctgggagccctggatcgaggatactgtgtgcacccccagagcactttagattccccagcgcagacccaagatgggaccgggacaggcagggggcgcgctcctgctgcggctgctaatgctagttcaaggtaagtctgaactccactgcgcgtccgcgtccgaggctggagagacccgctttggtcctagaagaccagggagggatcgagtgctgctctggagctggcgatgtctgctctgcatctatgtggactcgggatccaggcttcgtggagccacttgaacaaacaggacagacagacagacacagacacacagacacacacacacacacacacacacacacacacacacacacacaccccacatcctcattaagacgtgtttcacccgatcaagcatccttcaaagtcatctttctaagaggtttgggtttagagatgttctcacacccacagatttggagcgtttgtgggtggccagcagaccacgcatccagcctcccagcttcccgcggatccccagcaggtgctgaactagctctgaaccaggaaccggggatccagctctgggctgcagcatgcagctctcaaagggtggctttgcaggaaactttgatgtgtatttttcaccccgcgcgcacaatgccccctattcttatttcaggaaggagcactggtgtttctttccataggaggaagaaaagccaatcaactaggcagagggggcactcttccttccctcctgccttccttttattgttgtaatgtccttcaaagaaagtaaatttaggctggttctctccactctcttgatccacaaggcaaggggattagctgagactggtgccaggctgcctgacctgacttcctttgcattaagtaaggaaggagagtggggaaggcaggctgctgagaggctcaggagaactttctctccacctttatccacagcctggtcatgcccaagatgaaggattttaaggtagttgaggggagatgggaggggacggtgtgtgtgtgggggggattgcattaaacagctaacaaaatagcaaagtggtcactggatgtcacttaatttttacaaagaaggaaagtattccttttttttttttttttttttctagacagggtttctctgtctagccctggttgtcctggaactcactttgtagaccaggctggcctcgaactcagaaatccgcctgcctttgccccccaagtgctgggattaaaggtgtgcgccaccacgccccagcagaaagcattccttaatctgtgcttctctgaggttcatctttctttaaggttgaggaaaactagtccaggttcgccttgtggaattttttgtctgttggagaagagagaaatatgtccctatcccgattctgtcgcagacacagagcactgctaattgttgggacgctaacctgtgcccccatgcctcacacatgttctgccctagagaaacacagttgatctgaggggccatcgggtctaatctaggggtttaagacagttggattggattctgaccttcagactctggaactctctctctcctaagaggaactagaaacccaaaccctggcttttcatctctttttaattgtcggtattattaaaaggagccatcgaagcacagcaccattttctgatctttgaaatgttgaggcttgttctgggaggagcccttgagaaggacctgggtggaatgtgttgccgaaaggcatgaagtcaggtacccagttttcttctgcagttagttaattgggatgattcaatgtcagaaagcagacaggatttatatgacacctgtataaaatgactccacgtgtttatttctctctttctggttcagttgtttgtatatctaaggaccacattttctctttattttaatcatctaattaaataaaatcatacaatcaagttttgccatttaagagagcagtggagattcataagtgggcaacataattttggatattttgggtatctaaggttgagatgcagctgaaagttctaggtccctggtactttaaactttcattttatcctccctatatgaacattttgaacatagcactaaacagacacacttattattatttatagatcacagacatgcacaattgtgatgcaaatatatacagaagttaaaatgtaaaggcaagcataaatgtgtgtctctacaccttacattctccacagcacacgggcagacaacactagacgcaaactcattttggatcttattttagcacttagattcaaatctctttttcccataatcccctcacgagtggataagaggaacaagcactcagttttgttccatacatatcccttttcattgttcacgggcaggccaagggtggagaacagagatcatgtgacacctaggaaatatgtaagttaagtgcacatacagagaagaaaccaactgtacccttaacatggatggagtcacacactctccagctggctcatgggccaaggaattctccatgaggattctcaatcagagcttcttaactgccctctgagaggtcgaccctcttcctcgtaatagcctccttcatctgtaaactaatcagtagattccgctcgtggtaaatgtcttccttttgacttttgctttcctttataaaaccccactcccctggtttgtgttctctttctctctcctctttgccatctctccatctcagaggctccttgtctacctattaattaataaatagtgttggcaaagttctgtccaagttttcagtctcaccctcacacttacggttctgccagtttttcctacccatctatgcaacgtctgccaccacccaggtcaatccctcattctctcctatcagaacacctgtaactttgaacctggccttcccattttgtttcttgtctttctagttgattgttcttattgctacctttctttttattatttatttatttatttatttatttatttattagatattttctttatatacatttcaaatgctatcccgaaatttccctataccctccctctgccctgctcccatacacactcactcccactttttggccctggcattcccctgtactggggcatataaagtttgcaataccaagggacctctcttcccagcaatggccgactaggccatcttctgctacatatgcagctagagacacgagctctggaggttctggttagttcatattgttgttccacctatagggttgcagaccccttcagctccttgggtgctttctctagcttctccattgggggctctgtgttccatcctatagatgacagttagcatccacttgttcgtagcagccttatttataatagccagaagctggaaagaacccatatgtccctcaacagaagaatggatacagaaaatgtggtacatttacacaatggagtactagtcagctattaaaaacaatgaatttatgaaattcttgggcaagtggatgtatctggagggcatcatcctgagtgaggtaacccaatcacaaaagaagtcattagatatgccctcactaataagtggatattagcccagaaacatagaacacccaagatacaattttcaaaacacaagaaaatcaagaagaaggaagagcaatgggtggatacttcattcctccttagaatagggaacaaaatacccatgaaaggagttacagagacaaagtttggagctaagacgaaaggatggagtatccagagactacaccacccagggatctgtcccataatcagccaccaaacccagacattattgcatatgccagaaagattttgctgaagggaccctgttattgctaccttcctaaagcagtaatctgcgttatcaatccacactcttacttcaaacacttgctgtttcctgccacatctaatatagggtaaagtccacatttctaggcattcataaaagtcctctcctgtctggctgtgctttctctaccaaccgttccaccctactgttcaatcctacatacaagtacacacaggaactccatacatgcatgggatgtacacgtttcaaaccttctagacacacacatgcaccatcctatgtctaagcacaatggacaaagtttatattaaactgttcccagactatcttctggctagcctcactaggctgttacttttcttccctttctctcatctttttgtgatctgctagttctccaatcctagaagagtcaaccccaaacataattataaactagaacagtttttattccgtagcccaagaagaaagcatggggtaatctttaaattctatgaaccaatccaggctcctctttacttcagtttctcagtggtttcaggttaccctttgacaaattagctttcttcctccattgctgagcggtaccacctgacccatctcaataggactctgtgctggctcctgagcctgtttgagatgtgtggatttggtctcaggactccatattaaaaaaggaaatctttatgcatctcagatgttcattcgggtttataagctagtgcattaacactatcattgtctcctcccattctccaaaatttcaatgttgcctgtcttatgaaatgactgccaagataggcagccaatgaccacatcagtttcaatacattccttctaagtggcaaatgctctcttccttcatgtgctaacatcctgggcagatgaagagggagaagcgtgcttgtgtacagatgagctcctcccggtgggattctagacactcagcaaaagaataatacatgccaagatacaaaaactgaaaactttcagagataatggggaaatgttagaggctgaaaatatctcagcatcatatcaatataaccaccagtgtcacaagcttcagtctttaccaccaagactgcttagcttaatacttagactcaggacaatgcaaaagatgacgaaccgtgggatgttttcctgttaattgcaaatcgaagagttgtgaagagttgctgtctgtttcttccagttgttatcatgactagagtaagccttcccatgcaagcagagaaaaaaatggctcacaatagttaagagtctgacagatgccataagtccagagaaaatagattttgcagatgacagtgattcccagtccctctttgatgacgcacagaagctctgccaatccggcagcatacagtaaattccatgagccaacatgtgaccagagattcctttgctaaaggcgtgtggcagacacagtatcaagtcagagaaagcatgacacatgatacagagaggtctatctgtatatgagtccaaacatggagaaaggaagttcccttggccctaaaatatatatacctggcttcaacccatcattcctcttatatttatcaaattagtgccctcttctgcacaagctggagattgagggtatgaggagattatgcatatggggcaatctactaggaggcttccaggaaaagaatcttcatttttcagacaatatgattttgtcacatttggaaccaggttcagagaggccgagcagtcttgtaagcatgatgccaaccagctactgaaagataaaaacaggtaaaccataggtagcaccgaagaaagatggagagaaaattagcgcctggaatcatctttgagtttctaaattatccaaaggaaatactaaccttcctctcaatttctttaaaaatgtttatataatttaaaacttagttatgttttatatagttgagaattataaagtcttcctatggcatgataaatatcatgtttgcatatggttcatgaatgttaccaaacaaaaatgttgagtttggagaaggaaatatcatggggacagtaaaaatcaagtctccaggaagacaggggtcattagagtttagctcttccatggaggactgtgcaggtcatggagtctagtccaacattttacctggatggaagcagtattatggcaacatacagcatgcagcaaggttcctagatgcactgttcccagaggtaacacacagcttctgccaatggaggacctatgtctaattcctagatcacaaaggaacactgacacagaacattcaagctcatggtgttgacagagaatgaaaggtgagaggtaagccatcctctggctttaaggctttccaactatggcggactcagtgtcttaccttgagggtggggaaggccctgaagctatccaagcagggaagtgataagctcagaattgctcactgccatatcaccataggacaaggaggaggatagagggatagagaccaggcagacagcaccatgtgcatctaggagagaatcaggttaagtgctagtttaccacaccaggagagagagagatgaaatgtaaatgtaaatgtaaatgctatgaaggaagaaaagaagacaggatttggtaatggacttaattttgtcactcaggggaggggggataaagcagatgtttagatttctgttacgtaaaatgaatgcaatgtatagtcatttattgaggcaaggagtgctaaaagaagcaagttgtaggaaagagattatcagtttggtgcaactgaggtgatgacatctaggggtaccctctagttagtccacagtgttgtgttgtggccttgcgatcagtccagtgagtgaggtgtgcacagagatgagaggtaccacaactggaggcagcccagccgggcacgtggtgttgctgagttaagcaaggagagaagaataggtctcgagcaatgacttgggaagtaccttgaagggttaaatgagaaacaaatgagagagagagagagagagagagagagagagagagagagagagagagagagagagagagagagagagagagaatgatgccacttggaaacacagcagaaaatctaatctgtaggaagtgagacaccacagaaggacttggaaaaggagacaactttgcagaagtcacatgagtgtggctgcctgggtaatggcagtctccagtctctgcagtggataagtggaagtgaggagtaagtgtctggatgtcctgtagacagtgaggaacacttggcagaaaagggaagaagaacagagagagtggtaagacaggaaacgttcctttcagcatctaaaccagtgggtctcaaccttcctagtgctgtgaccctttagtacagtccctcatgttgtggtgaccccaaccataaaatcattcccattgctacttcatcactgtaactttgctaccattgtgacttgtaaatatttttacacatagaggtttgccaaaggggtcatgacccacagggtgagatctactgatctaagcaaagatggaaacacttggatataaactatgacaactggatctcaaaatttatgttcagaatcctgcagagtacatgtacaatttttccaaaatcatgttttggcatctgtgggtttcagacatccagaaccaaagagtgaatgggaacagctttagtgtctataaaaggatcttagaggtaggaaaggaggaagacaggggaaagtggtatttctttttaacatgtgtgtgtgtgtgtgtgtgtgatttgcgtatgtgtgtacatgacaagtatgtgtgctcttgcctatgggcatgcgtgtggaggactggcgtgtgcgttgtgtgtcttttgctattgttttccgcctgaaaccttttgaacaaggtctctcccgcatctggagcttcctgtttcaaccagagcacctagccagcaaccgcccggggcctgcctgtctctgtttcccatttccacctaagttatggatatagagatgtccaccaccatgcccagctccctttacatgtattctgggaactcagaataaggtccttgtcttatgaagcaggcactttatctgtagagccatctcccctgccctgcactttatctatagagccatctcctctgccctgttgttagtattgtgagagttataatttctgcagattgcatatattcaaggtttattctatgcctgatggttcctgcacagaaatggtatgtcccctatgatgtacacacttaacctgaagtctcttccagccttttcagttcagagaatactgtggctgccaatcattttaagtatattgcagctttctctggagattggtctgcttgcatggcccaaatagttaaaagaagctgtaggcagactcctgccttatcataccatgttctaaacctacaactgcaattttctttttttgcttctgttagttcacaatgaatggggacagttttaactcctgaagctgtctgtgtaaaaatgaagttaatgtttaaacagagcgaggcgaataaaagcacattagaggctgtgctgtcagcgtctgagattatttcgttgtttgttcaaaagcatgaggaaagccagtgccccagtggccaccttggacactggcagctgtcattcaccgagaggtggcctttgtttgtctttgtgcagacctgagcacatttccatggataccatgtagccatgcagattgaactgtagctggagtctagccagagcagccagacagctctatccgactctttcccagtcacattcaggtcctttaagccagagcgtcttggatgctcggtggaataaagactgttttgaattttgtagccctttctaaatctcgctgtgagggcttggtgcatgatgcagatattttacattaattgattcagttttctaggtgtttgttagtgtagttccctggcagggatgaaggcaaaagaaaagtttagcctggaaattataagacttacctgattttttttttacttttagaataaaaaagtagtatatagtcctgatgaaaacatagtacaggattgaaaaagatctatggaaatatcatagtaattaaactataggaattcctttattactacaatgcttaatgtttgtccccaaatgatcaggctataacagtatcattgggatattatttaacagtattgtttgggaaagggttgaggacttaagacactattagtgccatacagtcctatgattgcttgcttgctttccctctttctttcttttccttccttccttccttccttccttacttacatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttcccttcccttcccctcccccccccctctgctattcagatgtcctcaagctctagactcctattttgcaattcatctaattctctttcactgaagtactcaggacacattgccatccctcatgtaatttagtgccacatctcacgcagattcttccagttgctgtcacgtgatacatctgatccctgttagcgctgataacctgtaagctttaggatgacaaggcacccgtgaatcagaggggagttgtgggagtcagttcagttccctccttccaccatgtgggttctgagtgcggaactcaggttgccgggcttggcaccaagagtcttagcctgcggacattgctgctggccttgttgacatcctgtttgtgaaacacaaatgaatataagaaccactgtagagctgactatctttgtgttgatgtacaggatgtcatcacccagttacgtgtgatccaaagacagtcttccacttggtggattttattctcagtgatgtgtactggtgacattcttggtgtgaacttagtggtgtattatgtgttctggtgacattcttggtgtcgattgctttcattttattttaaatataacttcgaagaaggtcccttaattcatggtcataaagatactctcctgcattctgttaaacaatatttatttggtattttcatatagacttacattttcctgtagtacatgaaataggagtttaaaaaaacaaacaaacaagcaagcaatagtcttagccacatttattcattctgcatgcacacacaagctcacacattctctcacacacagaaacacatacacaaacacacagacacatacacatatatactaaaattattgtgtatttattccttcattctagcaccctgtaattctctttagttttagttgttcaggtatggattattccattcccaaatgttttttgtttgtttgtttggttggttggttggttggtttggattttttgcttgtttttgttttccttttatcatccttttcttgccatactgagccaagcatggcctctaatacagtaacaaatactaagttacaaatactgtgttaaatattaaaaagaaaagggaagagaagattgcttactatgagaggatttcagcctctcagagtccagggtgatgtttactgtgggctattcacacatattctttcatcattggattctttttccctgctactttgccaaggtagttatttaaattgacaaatgatttgattttataaatatatttctgcatcttggtgataatataaatttccttctaaaatccattaacatggcaatttagaccgtttgctttttagatatgaggaaagccttgtattagtgaactgtctccatcctgatcagcattgttaatgtgtttttggattacagctcatgattgagattagtcttctattagatttttatgcactcctctttcggattttgatgtcaagactgaactattgccataaactggaatccatttcctctgttttgaatctctcaaaaataaaattctgtgagtttataagatggctcacttgctgcccaaggatcttgagttccatccccagcacccacagaaagccatatgtggtgacttgcagctgtaacttcaagcactcctattgggacattgtaagtgggaaacagaatgttctggaagctctaaggctggctagcttggaatagagagagcaacagaaacaacaaggtagatcctgtgtcttcaggggaaaggagaaaaccaacttctgaatgttgtcctcaactcccacattcctactgtgtcctgacacatgtgcatgcagacacacatggacaagtgcacatagaccacaattctataaaaaaaaagttgtgtaaatttagcttatttttctcatattctttttaaaatgtgtgtgtgtgtgtgtgtgtgtgtgtgtgtgtgtgtgtacaccctgaaggccagggttgtgatccaccttatagcctgggaactgagttcaggttctctggaagagcagcaagtgttcttaactgtggagccatgacacaagccaccttttaatcgtcttgataagaagctctgggaaaattgtttctctttacatttttagtgtgtaaatttaaataacaatgtagatattagaactagttttagaacgtttaatatttatctaccttttgccatataattttttttctttccactatgtcagactttaagtaaaaataaattcataaagtatgttaattttgttggttgtcatttgataaggagtttggctagttggttattagcaaaaagaaggttgtcattattattattattattccaatcttaattattgacttcaactctcaaatgtcttagttacttttcttttgctatgacaaaactccacggccaaggcaacttacagaagagtttgttgagggtttacagtgagtgtatgaccgttatgacagggcacatggcgacctgtaggcaggcaggcatggcagcagagcaatagctgagagcttacatcttcatccacaagcacaaagtagagaggatgagagagatcactgggaattacatgttcttttgaaacctcaaaatccgccaccaatggcacaccttctgcaacaaggccacacctccaaatccttcccaaacagttccatcaactcaggaccaagcattcaaatatatgaacctatgggagccagtctcatttaaacctccacaacatttcatactacacagaaaattatatccatataatttacagagtatggctaaagatgcttcatcagaattcaagatgccttacagaagtcagagacaaagcgctggcaaatacacacataggatcttcgtgggaggttagtgtgatggtttgtatattcttgggccagggagtggtgtggccttgttggaataggtgtgacctggttggagtaggtgtgtcactgtgggtgtgggcttaagatcctcaccctagttgcctggaagtcagtcttccactagtagcctgtggatgaagacatagaactctcagctctgccagtgccatgcctgcctggatactgccatgctcccaccttgatgataatggactgaacctctgaacctgtaagccagccccaatgaaatgttttttataagacttgccttggtcatggtgtctgttcacagcagtaaaaccctaaccaagacaattaggtagtgaacccttttggagaagtgctgaagaggttgctgcagaaccaagcttcagggtcacaggtttgaatcaaatgctagggttgagttgacctgtagaagtgaggtacagaatgtggaggccacagagctgagctgtagagccaaatccagctggataaatattttattctccttatatttacaagttgctcctatttataaacttgttcacataaacttttaagtggacaggaatgactttcatcacctcggcttttaattagtgtaatatctgccgtatctactcattgctgctcttcttcctgatcagtcccatcaggagattataaaatttatagctatgtcaaattatgtcaaagaagaaatgttctgtttcacttactatttccatgttatatttacgtgcatttcattaacttgaggtctcgttttcatagttttccttattttttcctcatgaaattaaaatatttcttcagccccattttctttcattctctctttctttgacatcagtcaccacacataaaattgatgttccgtttctcacaatcttttatttgcaaacttgccagatgttcctttaaagtgtcttctgccatccatatttcaatacctctcagggacatctgaaactacagctattacaaaaccttttgtgtattgttttctcttctatatacatatgtatggtggttttatttataaattaagcaccactatggtggtatacacctgaaatctccaacacttaggaagagagagagagttccaagtcaccctctacatgatgtattgagacaataatatcttcttgcaaacagagaagaaatgagcacagaaaatactaatactttaagatcagtacctaataatagaaaggaacttttataacagtgctatactaaggttgcatgaacgtggtctcccaaatatcttatagcatctctacaccttttcctttgacatgatgcaaggtctatgtgatgggcaatgtgagatgactaataaacagactgtgatatggcatctggctgcagggtgacctgaacacagcctctgcaagaccatgaaagacacgaacgagatggcaacagagtggctagcaggcaagtagcttgtctatgctggggagagggataatttatatttttggagcacagaggaggagaactcattgagctacttagactagcatgcaagttaagaatcacacgctgtttctaaaaattcccattgggaatgtgaaactgtgaaagagaaactacagaagagggtgagctgctatatttagaacccccaaatcaatagtagaggaggacaggaacatggaagcaaaacattgggtttccccaggcaattttcccaactgagtcagcagggaagcattctgcctttttgtctcagctctcctagcatacacagtacacactattctttcatatgtaatatgcatatgtgtatatatgtatatatatatacatatacacaaatgtacacatacacacacatacctctgtgtgtgtgtgtgtgtgtgtgtgtgtgtgtgtgtgtgtgtgtgtgtgtgtgtatctttggcttttagctgactttgctgttttaccactgcctccagacgcagtgctgaagttttattgaaggctaagtgtgaaagagttaatgctacatcttaaggaaaaaaaatctgtatgttaagcattcttccttcagttatgaatcagtatatcctgccttctccaggctagctattgtccctttgttggatatttaggttgcttcctgtggaaattccttcaaacctgctgtgtataatggagttataaagtcattatacacattttttcctcctgtttcctcttggatgatttcccaaagcagcagtacattgccaaaggtggtgtgtgtttgttcatgtgtgttgtgtgtgtgtgtgtgtgtgtggtgtgtgtatgtgtgtctatatgcgtgtctgtatctgtgagtttgtgtgtgtggtgtgttgatgtatctatgtatgtgtacagtggtgtgtgtgtgtgtgtgtatgtgtatgtagggtgtgtgtatgggatgtgtatgtggtatgtatgtaatgaaatgtgtgtggtatgtgggtatgaaatgggggggggggagggtgtctccctgtgtctctgtgtatgtgtgttagctcttgtcccattttcagcagcatagccatctgcgatgtagaaatgtatcagcttccccaacattatctttttcatcttcttttgtaattggttagatatggagtggtcccttcatcctctttactcacacagagtcactgcctctatgttacagtcttggaagtgtattttgtgaaaaaaaatgtatatatatatatatatatatatatatatatatatatatatatattcaggtcaaagaacttagagctagtgtcctctgatgtgggcccaaaagaaatctcaaaagctcatctagttcacacacacacacacacacacacacacacacacacacgcacaggagtccaacctgcaatgttctctatgtgttttcaagatgcctcttgattgccctctgaaattttccttgaaagtaaaacttctattttggcacacacagtcccaacagctgtcactcaaagaggatacatcacacttttgtggcttagaaaccttgagcagggagggaagagattctgttcgccgcagtgattcactatggtgaacagtctataggttgcactggtttgccatactgtgcagagtcacccaaagccagggtcctatcagcttaacgatcatttattatctcatagttcttggcttgggattttaaggggtgtcttgactggagattctggccatttgctgctgtcagaagacaagcagctttctcttcctgtggggcatccatttgtctctacggcaaagcacctactaagtaacctgcctttatgtgtggtgacttctctcagaaacatactgggaaggaagttgggagacatgggtcggtggtgtggagaacattctgctcacagagagggtctgaattcggctcccagccaccacatagggtgactcacaggctcataaccagatgtaactctggagacccaatccaaggacaccagatacctctgacctccaaggacaccttcactgatgtgtataaagctacacagaggcacacgtatccacacaatttaaagtaatagagactttaagagatgctgcgagcaatttgtggccttcactgcctttgacttggaaaccacaccactgcctctattcatccaagcaacgagcaagtgccatttcacaccaggggaaggaggatgagactctgcccccccccccccatgaatgagtatcaaaatatttcaccgatgaaacgtaaacaacttaacgttgcttacgagacctcactcactgtttagactacagttcagacaccagctttgctggcatttggggcctgatgattcttctaggctgggggtgggggtggggcttggggtgggagtggggggaatgagaagtgcaggatactgtgtagtgtgcctggcctccacccactagatagagcagccccagtgtgacaatcaaaaatatatcagacgttaccaaatgtcccccgaggggaagccactgaagaagagaagcctgcggtgagagcatttcctggtcatggccacacagaactgagctgtgaagagtaagttccaggctgtcactgtaggtggctttagatcaatcacaagcacattgtcttgtgtgttgttcattcacaaggaggattgagtgtaatttttataaaggggtgaatattttgtatattgtgaatccatagctgggcattcattattattgttgctgttattcttaatttatttattgaattatttgttcattagtttttattatcattcatttacttagtaggggaacattaaaataatggtaggcttatcatatttcacttgagtgtccaacactggggagctggaagagcggaggcagtctctccctctcatatgctaagattattggatgtgacactctcccggtgcatttttctttcttgatgaaagccaagaacaggttatactgctacattcatgagcagttgaaggaataatttcccacttgtaacttgtattctttttgtgtgtgcattgtacaagcattccacatcttagttgtccatgccccatgctcatctccaatagactgtaacttaacttggttgcgtttgtgagaagaaagtgtactgtctacctgccttgtgacccttctcatcctgaagacaatgcaactgaaaaccggacttcctgccgttgtgtgtgtgtagatcttatgtgacctatgacctttaccgatgatagctatgtgtactctggataatgattacctgcacttggaattgaagtctgtttgctcaattccatagtagggtctgcatcacccacttcctgccagtgtggcttcctgagaaggttcacagaatgacactattttcctgggttttatggtattcttcttctgtgtgtcagcaaaatatcagccacatatcatctggccactcatgaggcagcagttctagaaaattaaatgcaaattagttcaggatatgctcttctgtccttggggggaagtgagtgtgtccaaccaaggagtatggtttgtgaaatttcccaagaagtgtgtgctagcctctgcgtgcgcagtgataccaagagtaaaaacagtgagaaactggcttgctttcctaggtgtgtatcacacgttaggcacttagttgagagttccttgtgcattatctgatgtacaggagactcacgtgttgacccagtttacagtgagaaagcagcagctgtcataggctaaaaagcttgatcacaaggctgctcaaaccccacaggcacagctcctggatcccatagtgtaccatcatctttgctccattagtggattttatttttcactttaaaaaaaattaacttttacctatggcataattctgccatgctaccaccatcaatgtgaacaatcttcttttgggggggtcttctgaaactacataagaagaagtcagatatgctacagcatattcttaacctgcgggtcactaccgctttgggggttgcatatcagatagtctgcccatcagatatttatgtcacaattcataacagtagcacagctatagttatgaagtagcaacaaaataattttatggttgggggggtcacaacaccatgattattaaagggtcacagctttaggaaggttgagaaccactgttccatagaattctaaatagaaaacaaacttatgtatatttgcatggacatatgatatgaagtttatacttctaatgcatgcatttctagattttatttatacagaatagtacgcagcacatactcgttaatgaatctctctatctataaatcagctgagcaccctgcatgcccagcccttgttttgaaccagccagaacgctgagtcatttttaattaaaaaggtctttcttgtccatccactattatgtaagcaatttattgtttggaggaaaggcaaaataattggcttttttttttcatttaaaaattacaactgattgaggactactctaagtattgggccatatggcagttaataagttaaacatagtccttatttttataaacaaagaagactaagtataaaatacacagagcttcaattttagagatatctgtacagaccctgtcccacacattcacacagcctgatatttttattaaatatgaaaaaagttaaattatgatctcccttccaacatatttcaacaacaaaaacatcaaccaccaggggatagttaagttttatgatgcagaattatggattaattcctataaaagaaaacgttaaatgtcttgaaatgtcctaactcttatgccattgggaaactattctggacctttatgtgacatttttaaaaaatgtacagagggaagggacatacttgaatggtataattttaccctgcttttaaaaaaaagtcatgctgttgcctctaaacaattattatataaactgtcatttgaagacatgataaaaaatgtgcagccataaactgcgggaaaagattactgtagaccaagttgattttgttgttagtggaaaaaaaaatccctagtgttgcttttctcatttcaaataaatgttttatctataattcttttttctaggaaaattattttgttttcttgaagaacttcccttccttaaattttagaagcttctatccctgcaaaacatcgtgtctcccatttccatgggttagacaataaaggcatatgacacagaaattttacttgattatgaataaataaatagaatgtaatgaagaaggcagagaatatttcctacaaatgggacaatatgttgtgaatagattctgtattacttattctatggtatgataattaccacaatattatgcactttactgagattctgagggccagagtctggacatggctttgccggggctttttcagacttttgtagaaggctgtaatcatggtgttgggtagagatagatctcacttgattgcctgcctgaagaataattgcctttctgctcctcatattgatggcaggtattaactgtgacatctgcttctatttttgctattaatcttcatatgtgtgaagctgaaggtcccaccttgacctgaaggcatgtttctcaggagatgggggatcactagagggaacactacagtctgtctaccacaggtgatggggggagaaactctgccaggttggtgtgtgaaaatggtggagaggcaacgaatgcgaagacacggctctgtggaaaaagctcccagaaggcaagggagcagcttgagcccaggtgtgtgagggagccaggctctcagctgtgtgagcttgaggtcagtgggaggagaggtcccagagcaccagtcctcaacctgggagttgcgacccctttgaggtcaaatgaccctttcacaggggtcacccaagaccatcaggaaatatagatatttacgattctattcctggtagtagcaaaattacagttatgaagtatcaataaaaataagcttatggtttggggttaccacaacatgagcaactgtttagagagtcgtgacatcaggaaggttgagaaccactgtcccgggggtagagaatgggtatgcatgcagctgggaaacgaactgcttcacgggatgatattggagactgaggactcatgaaggggttactaaaaggtgtgtgaaggaaggctcagatcgttggcatgcaaactgtgatctcaacaaggatgacagcaatgggcaggtgaaggtggatggagagaagtccaccaggcctcaaaaccacacaaagaatcatgggcgactgaagctgggagagcaagaactggtttcccagagaagagcacaccaattgattgcccagtgccaaagagtcagccctgaaaacacacacacacacacacactcactcacagtcatacacacacaccataaacacagtcatacacacacatatgcacatacactcacacacacacacacacactcacacagtcatacacacacataccacacgcatatatcataccacaccacatactcacatacacacactctatacacacacaatacacatacacaccacacacacacattcatacacacagtgtgtgtaacattatacagactgaagaagatattttaggaatatgtatgtgtatgtatgtataatatgtatttatacttataaacacatatattcatatacacatatatatgcatatacacacacacatatatatatatatatatatatatatatatacatatgttgatgcaataaagattagtggaaaatagagaccatgaacttgaaaaagaacaggaagggtatatagcagggtttgcaggagaggggagaaagaaatgtaattatagtatgatcttaacataattaaataaaaaagactatagagaaagaaagggtgtggaattaggaaggaggggaagtgaggagggcctgggaggaggactggaagaggaaagtaggatcaaatatattgtatgaaaaattatttttaaaaagactttagagcagtgccccgtggacagcaacttaacacgtagtgctcattttaattatgatcagttcatcatgtactgcctgcagatgtgggaaatgcactttgcaatgaccaagttcagtaaaagcccatctggctaatgccatgagggcgcgaggtagagagatgtagaagagagaccagactggaaaggggtctctcttccacacagaaggcatttaaggagaagtcgaaacaaacatcaaacttggaggaaggaatttgaaggatatctcccagcaaccctcaggacaataagactgttccactgtctccaacacaactgtcaggagacagagagtctgccaaatgtagctcgccctcctgcatcccttttgaaaatgaagaaaatctatcagatttgctagacggcaccaagtcacagtaaatggatgcacaaaacaattacagaacgacttttgagatggttcttgctttcaaaatcgaattgctgaaatgtgaaaaggctttgaaaagcccttagcacatgcagccatgctctgcgacttgatgcagtttctcttctccttttctcgttccttgctactcctctaatcccctaaacacacacacacacacacacactgtcactcacacacacacacacacacacacacacacacatacacgcacacacgcatacacacactcacacacacacacacatacacacacgcatacacacactcacatacactcacacacatacacatacacacacacacgcatacaaacactcacacacatacacacactcacacacacacactcacacacacaacacacacactcacacatacacacacacacagtgtcactcacacgtgcacatacacaccccacacaccactttgaatgtttttaaaaaatggacatgatgtaaaacatctggtatacatttatatctttcttcatatttatatgtgtgcctatgtgggtagaatctttgaaacctagagcaataacactgaaattttccgatagaattagtttcctttcactaatctgcaagcacaacctaacaaacactgaagacaaagtggcttaaatgacagaaatgtattttctaataggttcagaggccagcagtctaaatgctttggggacaagtactgtagtgggtggggctcttgcagatggccatcctctcctcttgtcttgtcatggcccttcccttgtgtgttgtgtgtgtgtgtgtgtgtgtgtgtgtgtgtgtgtgcccatgcacacgcacgcacaggtaagcacactgagagagatatctctggtatcttctatcttgggaggatgctggtcacgctggtcatgctgaattagagttccactgtgatggcccctttcaatttgagccacttcctgacagtccctgtcagtctttaattgtactcgcattggaagctaaaggttccctgcaggactattgagtgaaacccatagcacttcctgagcttggataatatatttagatgttcatttctgatcatgagagtgatgctatttccctcatgagatcatagtgtaattgcgcaatacattatgcattcgctgaaaacaaatatttatgaaccagagagaaaagatgcttccacttagaggttagcaagtagcctgactgcgctgacatcggctcccctcacccactaccactagtctcatagcagctaggtgaacatctgcgtgtatagtgcactgtctacaggaaagaggcaatgaacttgtgaagatgttttttttaccatgagggtttgcaagcctattcactgacctgaggggatatatgtatctaccaatgggttcactataagccccaccctgtgaaaaacaagaccaaaggtgttatattctcactggaccaattttattaagttgaatggaaactcctcaaaaataagtccccacttagcttctgcttccagttttctgttctgacggcctttacatatgaactatgacatgggagtaaaagcaaaatgaaccctttcctccccaaattgcttttggctattccagcaacaaaaatcctaagacaattgttttgtcacaacaatagaaaacctaagacaaatgtcttaattgacaagaggctctttgtattgtctcttaaggaaaatgttgaatgtcttgtccttgctaaccgtagcgactgcgaaaagaagaaacaagctgaagaaggaccgagaaccatcatccttgatgagccagggaatcctgagcctcagcagatcgcaaaacaaaaccttcagagtggttctgtccctctgagttttgtgtattgaaatactatgcgtgtatgattgtgcatgtgtatgtgtatgtgtgattgtgtgtgtgtgtgtgtgtgtgtgtgtgtgtgtgtgtgtgtgtgtgtgtgtgtatggtgtggtgtgcatggtgtaaggtgagcctatgggagatatataggttatataatataacctatatatataaggaggaggcctcatgtaaggaactgatatccttacacagagattagacaactagcttgttctctttctgcagtgaaccagaaagaacaagaactcagcgatctaaaagctagaagagggctcttgctgtaacctagccatgccagcccccatcccccatgtcagacttccagccttcagaactatgaggcatgagctcccaggcttggaaatagcagtccaagcaaagcaatattatgaatttcaccattacaaaagcatgcctagcaagaaggccaatgtttggctagacatagttttgctgagacagactagggtagaattcatgagccctccaccatctctccagtcagattatccagcacaaaagatgatacccaggaaagaactcttaatgattgtttatctattggcacggatggctgtgatgagtatcacaggcttacaaggcttttaaggatgttgtgccagtagaaatgctaccattaggatgagcaaggaaacatcactcatatctgatttggatgataaatttgggactatgggttggtaataggtgagatctggggcctatagttagtgtagagtgggtgagaactttttcgagaaatgtgaggtgtttttgcatgaagcatgggtgtgacttggcaaggaggcaagcaagagagcgtaatagactaaatggtcatttctgaaaaaaaataaatgtgtcaaagttctaaccacgagaactagtgagtcctaccttatttggtaaaaggcttctgcatatgcaattaagtgatggctcttaaaataaagcatcctttcttacttggaagggcccaggcccaacagtaagtggcgcaaaggcagatacaatagaaataaggagtttaagcaacattatggcagattagaacaattcaggcaacagtcaaagggtgcagttagtccccagaagctaaagaggcaggaaataatagatttttcttcagagtccccaagaaggctcacaggctgctcacaccctggctgtcaactttttatgtaacacgtttctgttgtttgaagccactggctttgtgttaaccttctgctgtggccacaggaaacgaatatatccacaggctatgcacataaggacaagagacccagacagactgtctcctccaatactagtcctatgctagttgctttatcttgactaaaatcttgagtcctttgacctctcaggcagtctctcacatggatctttgtgtgtagacaggtaaggcaaaaggcaggccaatggcaatggcattgagctccagtgtatgacatccatcttcctatatgatttccgtcatttccctccattgccgctctttctctttcttccgcatctgtctcactggctccacactcctgtggctgtctccccactagctctgcttctgttgtcactattctacaacttctgtttcttcagcagttaatcaggaagtctcctaaacaaagatagttcttccataagctatataagcgttcctccatcaaatagcaattagtcatagcattgacatgttacagtttttatctgtgttgatgtgtttgtctgtttatgcataccatgtgcatgccggcatcctcagagacaagaaaggggcctcaggtttccaggaacaatagatgcaggggtttgtgagttgttatcatggatgccaggaactgaatttgggtcttctgcaagaatagtaattcttaacctcagagaaatcccttcatccccagcactgacgtttaaaaacatatatcacatatgatattgtttaaaataactttaagattgaaagcggtggtggtgcgtacatgaaggggagatgagcaaggtatgtaatggaggaagggaggatgtgcccacaacccagcaagccaggagaaggaagaatcttggaacacaacctactcagttctagatggcagggtctccaaggctgagaacacagtctcgggagtttggatgcaaagtcaaagagcagaatttccaaatgtcatctctgagttgaacaaaattgtcagtggagtacaaacaaaatataatggaataattttttagagtacttgaacaataaagggttgtttattatattatttgtatatcatattatgttatatattacatataatatatttacttatatgtcattttatatttatatataataatttatttgtaatgtgtgtagtttgcatattacatataaatatataaatgtataatttacatgtaacatctaaaatatgtaagtatataaatataaatatattatgtaaaatctatatgataaaatatataatgtatccacattttggtctttgttcttcttgagtttcatgtgttttgcagattgtatcttgtatcttgggtattctaagtttctgggctaatatccacttatcagtgagtacatatcatgtgagttcttttgtgattgcgttacctcactcaggatgatgccctccaggtccatccatttgcctaggaatttcataaattcattctttttgatagctgagtagtactccattgtgtaaatgtaccacatattctgcatccattcctctgttgagggacatctgggttctttccagcttctggctattataaataaggctgctatgaacatagtggagcatgtgaccttctaaccggttgggacatcttctggatatatgcccaggagaggtattgaggggtcttccggtagtactatgtccaattttctgaggaacctccagactgatttccagagtggttgtacaagcttgcaatcccaccaaaaatggaagagtgttcctctttctctacatcctcgccagcatctgctgtcacctgagtttttgatcttagccattctgactggtgtgaggtggaatctcagggttgttttgatttgcatttccctgatgattaaggatgctgagcattacactgtgccccttcttagaactgggagcaaaacacccatggaaggagttacagagacaaagtttggagctgagacaaaaggatggatcatctagagactgccatacctggggatccatcccataatcagcttccaaacgctgacaccattgcatacactagcaagattttgctgaaaggatgcagatatagctgtttcttgtgaggctatgccggggcctagcaaacacagaagtggatgctcacagtcggatcatagggcccccaatggaggagctagagaaagtacccaaggtgctaaaggggtctgcaaccctataggtggaacaacaatatgaactaaccagtacccccagagctcgtgtttctagctgcatatgtatcagaagatggcctagtcggccatcattggaaagagaggcccatcggtcttgcaaactttttatgcctcagtacaggggaacgccagggacaagaagtgggagtgggggtagagggtatggggggacttttggaatagcattggaaatgtaaatgaagaaaatacctaataaaaatctaagtaaaaaatatataatgtaaatatataaaatatataaagaaaatatataatataaatatatataattatatctatctataaaatccttaagaaagaaaacattaaactttatttgaaattgactctattcttgagagactaactgcttattttctttccccaatacaacttaaaaaagaagactttatttcagttaccagtatatatacatacatatatacatacatatatacatatgtatactggtaactgaaataaattaatatggtatataataacatgtgctgctcttgtagaaggcagaagttccattaccaatatctgtgtctggtggttcatgaccacctattactccagccccaagggatccaatggccttttctgatttccatgcacatacacattttttttaaatctataaaaaagaaaacatgaaactatgtttaaaatgactctattctttagggattaacttcttacttctttttcttcttcctgccataccataccctgacagaaacaactaaggaatggacgactttattccagttaccagtttgcgggtacagttaatcatggtggcaggagctagaagcacttggtcacatcagatctacgttcaggaaatagaaactgataaatgcttgtgcctaactccctgtctcctttctatacagtctgggcccactgcatagtgaacagtcccacccccacaattaaaatgaatcttcccacattaactaatcaattccccatattaatctaaacgtgatggcccctcacaggcatgcccagagaataaacaatccttcgcctttctcctaggcgactccagagcctgttgagctgaaaattaacactaaccatgaaaatatcggaaatcaatgaagttgttctgtaaaagctttcaaaaatttgctttaagctaattcagctttgaaatatatttaatcatataaataagaaggcaattatccaagagtcacaaaacatcaaacaagacaattcacatatattaagcatccccaattacattgtattatgaggaagtacaattagtagcatttctatacttggaagaagtcttagactatgtctctatgtccagagatgaaaactatgagcctataagaaggtaagagacttgccactacacagcacagcagatgttaagtctgtttttcttactcccagtactgtctgtgttcctttatatgactcatctacaattacctaagttttgaaatataactcagaacaacattctgggctgaccactgagttatcagattcactctaatccattcttgcaaagaaggaccaacaatatgcaggctgccaggcctgatttccaggtctatgggtgcagaataccactgttttaggaaggttaagcccagctctacactcctgagagctctggttggcaaaagctgcagctctgtttcaggagcagagaggagtcacgtgtgcatagcatcccttgggatgttgtttatgtccagggcacagcccttctgtaagtaacttagaaaagagatggtattttacagtcttcatctgtggcagtttaaatgagaatagctcatgtatttgaaggcttatggcttcgtaggtgggactgttggaagaagtattaagaggtgtggatcagatgtaagttcttagctatggctccagcaccatgcctgcctgtccaccaccatgtttccctatgtgatggtcatggattcaccctttaagagtggatgcaagcccaaaatcaaatgcttccttttataagttgctttagtcgcagtgtctcttcactgcaatagaaaaataaccaagacaccatcttatactaagagtgctatgaactgtgtagtaaacctttgagaaatgtttgttggctaaataggaagcttgttcaaatgagataatgaagtcttcttgtaagcatttgtgttaataaacccatcagttttgtattgtgaacagatgtgactagagtaagtcatatgactaagttttcatagagtaggatcacatagatttccaaagaattgaagagttgtcataggcttttaagatatgaatgaagaatcaatgtcattcagtggcatagagttgtcctttacattttatctatgatatgtacaatagcgcaatgatcagatgagacagtgaaggttgaggaaaacccttcatgtgtgtgattttgctggtatagagcaggaagggaaataactgtcttgtttttaaccttacccttacttatttcaaaaaacattagaatgcactgcagcccacttagaagacaggcaacttagttcacagttctattacctgctatattaatattttgtagacttttaagacacttttcattgaacattttaaactatttttcactgaacatttccactctatcctatcgtcttcatgatttctgttttgaaacagcagtgtcaaaatccattacttaatgtgctaaagtttacattctcaaaccctttattttggacattttggacactttagttttgatgatgatttttttttaaaatttcagtaatgtgtgtgcctaagcatgtgtggattggggtgcaggttggtagctgtgtgttcctgtagaggacagaaaaaatatgtcagatctcctgggactggagttataggtggttttcaggcacaatatgtgagtgttggaaaaaaatccaggtctctgcaagaatagcaagtgtttataaagcttaagacatttctttagcccctttaactacacttactaaaaaggaatctttagatgggtagaaatcattaaaacgcttaacatttgcaaagtatgtttgcctacatcacctaagaaataatataaaatacaaaagccatttcctgtggttcagtcatataacacaagggagtgtgggtgcctaggcactgagtttgcagtctgtgaaaacagagtatcccactgaaccttgaacactgttctcctagaaatgaaaatgtttgctcatagtgtccttgtgccttggtcattgctgtaccttccctggatatgaatattgatgcgtagctggcttttatggctgctaatggccagtgggatagtggatagcaggatatgtctatgacttatactataaagagaaaaatattgggaggaaatatttaaaaaactattgcacttacatgtgaggaatggtactcaagattgtcctatctctcccctaggttttttgttttgttttgttttgtttttgttttatactcaaagttgtcacttagaaatacatgttaatttaaatacgtgatttgccaaatttagtttagtagtgggagggagttgcattatcgtatatccacatgcattctttccagtgttggatatgttgaagtgacagtagtttgacactacctcttcaaactttaaataatataaaaactgataactgttccaacagtatttgctaagttctgcaccatggggtgaagatgaagtatggattagaaacaccagcatcctgaatgccaggtttggtattctgcttaaattgctattattttctttggcattgaatttcatcagtaaagaggaacagaggttgctatgaagagacagaagttacaggtcaactttgcaaacgctgagctctgcagattatgtcacagagtatttcaaaattaatatttgccctttttgtcctggcaagcttatatttctaagaaataatgagctgggctgtttttttcccccctttttgagtgagcaaacgcccagtagagtatttttggcacttgaaaaggcacattgactacttcaagttcccaaagctttgtcgctgacttcacttttccttgggagaagactgtagagtcccctcccataagttcagaagcacaatgataaaaacaagccatttcatccagacgccctgtgcctagaacaacagacttctaaatcaccatgctgaagcagggtgcccacaaagtaaaattgtgaaagcacagggtacaggtgctgtgagaaaagtttagagtctaggctctgcaaagataaacagtaaagccataccgaatctacaaagccctgcttccatagagtgaaggactcctccagcattagtgctgtaggtgcagaagaatttattttctccccattgccaacagaaacaacaaacaaacaagcaaaaaagcccacaagctgttgtcttcttgggtctttgttctatttttcatggttggcatttattgatcatgaaggaagaaaaatcaaaatgcaaaagtggcttgggcagtttcgtctagaattttttttaaagcaatgatgcaccatccccttaaccttttgtcctacaaagcatcgttttctgaaaggaaaaatgatactgatttcctgggctatgacttccctccctcctcgtcacggagtttttagcacacatttcacatggaaaccatgccaagaacagggcacccttcaaaccacgtgcatgagtagcttagaatcttactctgtaagcaaagacaaatagaatttaagccactctataagatagtaactaggtaaaagcccagcatcgtgaccaaatccagagccttcccttacaactcaacatgagagacctacctgcctggagcctgaaaaatctctgtgaagtgaaggtaccattggtgacagtctccaggggttgctttgaggaagatgaaggcaatgaattgtgcatgtgagtatctagaccagtgccagggcacacataagtactttagatggagtccctattatttcttatcatcactgataaagagattagttatcatgtcaaacaaggttggcctttaaaaactcatctttaacagatatattatgcccttacattaaaacctgtaaatatggactatgtttttaattcttgaataggtattttgaattgtctggcgtataatgttggcctcccaggagcgaaaatattttccgggccttcaagtgaacagtttgggtattcagtacagcagcttacgaacccacaaggcaactggtaagactgttctcctcttcactgtttcaattaaaatattgtgtaaaatggaatattcgaatccatttgtttatacaaacaggtgaatgaatatactgttaatagatagtgctttaaaatcgttcttagacagtctcactgggtaagtctggctggcccagaacccttaggtatctacttgcctctctctccaagatgtgttgggtggacttaaagtgcacttggttcttttgttcttttgtttgcttttcctctttttaaaatcatttcctttgactagtgataactgtggactgataattaatggaataccatagtaatacttttttgtagggagaaagcccagatagaaaattttctccaaaaattctactaccagtgttgataattagcatggtagattaaaaaatagacagatgaattttgccttcattccttaagctttgaactaatcttccttaagctttaaaagtaattgtctcactgaccttactttgatgtcctttctggaaggcagaacaacttcctaaatatcgtctttctgcagggctttgcccactctgctctgagtcagctttcagtgtcccaggtagcaagagtcagatctatccatagaaaacatacaaaattgccttccttcagcgctgtgttctgccatgaagtgtttgtcttagttatgattactattgctgtgataaaacaccatgaccaaaagcaagctgggaagggaaggcttactcagcttttattttcacatctcacttcatcatcaaaggaaatccaggcaggaatttaagcagggcaggaacctgaagcagagggtgatgcaaaggccaggaaggggtactgcttactggcttgctcatgatggcttgcttagcctgctttgttatagaacccagaaccaccagtccagggatggcaccacccacaataggctagacccttccttccccatcaatcaccaattaagaaaatgccctgcaactagatcttatgtaggcatttcctcaatggtggttcccttctttcagataactttagcttgtgtcaagttgacataaaacagtgctttactgtctgtgccagaacaatactgaaggcttttaatataaaggattacatttacataccagagctttattctcttgtgaaaagtgactacttttgataaacagggataaacagggatatatatatatattttgcttggatatatagataaatatagatatagatatcaattcattgataatgtgagtttcctgtaaaagtaatagaaaaactcaagagaatcagatgacttggaaaatcatgttgagggaagaaagtcccacctccgtccagtctgatgcccgtgtgtggacagcccctggggaccacacctctgttgtggcacaaagacttaagctccgtccgctcagcctggagctttaggtcctgacccttaccttcttgatacttttaaacaataacatgggctccatgtgactttctcacatggggactactatgtataaccttcatgttgggaacttatgtttaattctctaatctattgaattaaaaaaaaaactatgttaagtccatgtagttcctacactgggacctgtttatctcactgacgaggaaacaaaatgttgctatcattgctcatagcagaaggcacttagaggaggcaaaattgagctgggatttaagtgatggagactggtgggctggagaagaacctggacaactttgctgcaaggagctccagacaacagttgaaatagtctgtcagtctgagagaggagaagagtcaggctagaagtacacagcctagcacttactgtaatcatctggagtacaggagagaactgaagtcctgcccatgatcactcttttctttgattatagtagagaagaaagcaagctataaaggtgatacaggctgacttttgactttgagatatagttcataggatatgttgttgataggcagcaagattgggtatgcttccaaaggaatctgtaactatttggcggggaggggatggagaaatgcctccaaagttaagagtgcatactgctcttgaagaagagttttgtttccagtacccatataagatgattatcaatggcatataatttcgactccaggggtatctgacacctccattcatatacatatatttgcacacagatataaacacatagctaaatacatcttaaaaaatttaaaagaataaccatttgttgaatgacttagtgaaaggcctacttacaagtgattcaccacagttagcctatgaagttaactatttgagacaaccttgagatgtaggggctaatgcagagctcctcaggaatgccagttgtctactggaaaggcacagcctagcaaataacagtgtggcattgagttcaaggtgggtgttctgttttgtactcagtttcaacttttctgaggcaaaatatgtctaagagaaaaagccgccatctataatagactttattagggatggtaaggctgtttggagaggaacacatccactggctatgtggcagttggaccttgaataagactaaaataataaagaactgacagggacagaacaagtaggatcctgggaaagagagtcatccccgtggcttctctcagtatatacaaattcaagacactgttaaaaggtatttttacaagcagattacattgatactcttgagctgatctgatgacgtcaaaaccagggatatcagataatcagatatctaaatcctgccttagccttcctataacatttcttgtaagcaggagacaacggctattgggaaacaaggctctgctctataattggctaggttagtgccttggataccagtatggacctttctggtaaggtgcagcttttagctaaggatctcacttttttccctttaaccagtatctaaacccatcagcctgcacaggcatactgcagcagagggaggaaaagagaggattcctgtctgtctaaggggctgaatctaggaaggtaaaaagcagaagggaagagaggactgtgggcttgtcagcctgtctgaatcctctcactgtctcaatcctaccaagaaaagacatggaacagactaagccatggacaaaattatctaatccaccatggactggccactgtgcctacgtggggtgcagaaaatccagagcatgggccctgccctctggagtgtggaacagtctaggaggaagatctgtgtgcagattgggaatgctcagataagagggctcattcagtgccaggccttaaatcgctggtgcttttgttgcttccctgcctctaccgctattaactcaacagtaagggaacaactttcctttccaaggtcagggacaatagtgatagaagatttcctcatggcctacgtcattggcctgacccagtcagtctcccaggggacagcaagccaatgctaggcagtcctcggtcagtggccttcacaccaaggaggaaaaatgaagcgcgagccctgggctccagagctgcctgtttgttttgacaattggcgctgtgcccttctccacttgtaatttatgacaattgcccagacgttatggaagtagcagatgtgggcaaaccgtttcaacattaactttccttctgatactaatgaagttaacttttgctaggaattccttcaataaattgtgagtgtttgttcttgagtctgcacatcacacgcgcacgcacacgtgcacgcacgtacgcacgcacgcacacacgcacacacgcacgcacgcacgcacgcacgcacgcacgtcctttagctcatggctctttcactgcttatgccgaagcaggttttgccaccgtttccctccacttagttgaactttctttatgatctgttttacacgtgactccatctcttttcttctaacacactcaaggttctagtccgagtgctcttaaactgttattttagagtccagtttgagctgtccggtgtgtcttgcatttccaagaatataggcatgttttacttccagatctactagatttcaatgaagcaatcttggctattttagtagttttgtttattggattttttttattacactctagactcctactttaatgatctcatgacatctctttattacttcttgagtttttcccactgtctcctatgagctgcatcctttcaaaagcaaggtgacctccaagaagagctgccgtgcagccctctgggtaagagtaacgtctcctccttcagcgcagcagaggcgagccagcctgcctccagcctgaatttcctacaccggatgttcagtgtagatgatgcaatccttatcacaaacaatctgcaagggccggagacatgtttaagatcatttcctggaactagttgtgatttgcactatttctttgtgtaatctgaaggcttgccccaagaacaatctgagttcattctatgactcagaagcactgtaactaaaatcactggttagatgaagactaactaagaacgaggagtatttccaggaatacatgaaaatgtattttcttcttttgtcaaggactggtacgttttacttccttataaagagagaagaactatgaatgaatatagcatcagagagaaaatctgctgcatctaatgtattattattattatgctactattatttattctaattttttggttaagataaattttattaaaggtctttatttactataagtgtgatagcccccccccaataaatgtctctgtggaagaaatttaaatagaaaggtctatataagtgggattcaattttgtaacagacattaaaagggtgtgttattgaatttcctatgctttaaatcgctttttccatcatctgttctggacatgaatctgtgatacacacacacacacacacacacacacacacacacacacacacacatgcataccacatttgtgactcatatttggaagatgcctgctattctagagtgtttggaacatatcttgggaaatcatccatgatcccaagacctcctgtcagaggttcctccatgataatactgattactggctccagaacaaagtttatttacaagagcaaagagcttttacacatatccctttctggtacccagtcatccaaacatttccctccatcagaacatagatgtaagaagggccaagtggcatagacgagaggtagttgttcacatttttaggtaccctatcataagccagtgttgagttcttgtctaaaagagttctaaatggacccagcatgatagaattgggcatttggaaggaaaagagattgtcatagaaactggttacttctctgttgctgtggtaaaataccatgaccaaggcaatctatggaatggagggtttgctctggctagagtctatgatgagaaaacagggcagcaaagcaaaaggggcagcaagctaagaggtcatatcacaatcagaatcagagagaagagaaagcaaacaggaagtagggtgaggatatacactctccaagcctgcctctggtgacatattttctctaatcaggccacacatcctaaatttcccccaaagaataccaccaactgtggaccaactgtttacatgcctgagttggatgtgaagagggtgcatctcactcaaaccagcacagacacttagaactagtgtctttttacaaaagcaggactaggtctaatacttcacaggaaatgataaggaccacatgaaaaaatgcatatgaatcctttataaaccataatgtaggtttacaatactgttgctattccagtgtttatctctgaattaaaaagaaaacattgccaaagcacccaggagagaactgggatttgacatttgaagtgtagcaatcctagaaatcatattggatgggtaaaagtgaggagatctgcggcatcgtaatgctttatggtgaatatctcagcttttggttttaacttcaggaaaacttcatggaggatgagttgaggcaataatccgtgtctattcgctctcttatttccaggatgaaaaattaatttccaaggattttctgaaacagaacaggtgttaagatgccttagcaatagtgaggttggtggacgatgctgtgacattgaaagaccttgcaagcttttccacctaaccacttcaggaaacagtctggaagctggagagtctgtggtcacataaggaggctgacatgacaacattgctttaacttaggccaaggtgtttgactactgagcttggaaaagcaatactggaccccttccctaaggggcaacatttcatgggcgacttcctttattcacaaacacctttcccactcactagcaagaagcaaggatctatttagaacttgccagaatctctgtattatcaatagcctagggtgagaaggatagtcttattcatgcagtgtgggctttgacatacctaatgttaatttagatattacatagagtaggcttctggtcacaactaaggtatcccctttggggtctaaaagacatctccaactcaaggtgtctgcacacagttattgagctattctttattgtagaatcttcctctactgacagcaaccttcatgatgttcattgtacttaacttctcagcttgtagggtcattcctagttctcttcctccctctggtccctctttccctctttcatccttcctccgtttaatttttctgtgaaagccaacctaaagaaatcctgctggccctaccttgacaaactatgttaaataagaccagtgttcaccacctgctgttctctgagcctttatgagcctctgctcccttttacctaggagactgcaagctccttccaaacacatgacctacttccccgtggctccaatgcaaacatttcgatgaagcttctgtcacagttcccaaaacatatcacattataattactctactcaacaaccccgggggcctttcttacttaaagaaaaacaaacaaacaaacaaacaaacaaacaaacaaacaagccagggattttctaattgaacacaattctatcagtgatcgggtccccttgccaaactgattccaccccctgccatttccctcagcccctgaacttgtgttttcctcaccttccccaggctactctttcaccaatctccaatctcctgactgtttttcttttagtcttgaatatcaccgtgtgtgtgtgtgtgtgtgtgtgtgtgtgtgtgtgtgtgtgtgtgtccccttctcaaaccattcaaataaagatttcttacactccacctcacatccctagctttctttcactcatcttcgggttcacttgctagatttattatctatatcctccctagaacataaaatctgagagtggtatttctttagcgacttattcactaaggtatcctaggatggcgtatggtccatcataggtgtaaaggctcgtatcatgtcaacttggcacatgctagagtcatcagaggagagctcctcaactcagaaaatgcctccttcaaatcaagctgtaggcaaacctgtagggcattctcttaatcagttattgatgggggagggcccagctcattatatgaagggccatccctggcctggtggtcctgggttctataaacgtaggctgagaaagcaatgtggggcaaaccaggaagcagcatccctccatgtcctctgcatcagctcctgcctctaggttcctgccctgtgtgagttcctatcctgacttcctccagtgaggaagtggaagtggaagccaaataaaccctttccagcttgcttttggtcatggtatgatatcacaacaatagtacccctaactaacaaagtaggtcttgtcaccatacacaaccttccaggtggtctactgtacaaggccagggcacacagtttacataagaatggtgattcctggagttgtggaacatgtccattccatatgcattcattaaacacttcttgatactatgttgttttaactgcaagtctactgtcaattgctataaaaatcccctactgttcttgaagaaagcccagagagcgtcgagatccagggaccaaaggcgggtatttttagcagctcctggattgtgggtttaaaattgtctgacctacaccaccataaatactgtttactaactaaacaaagcactttgaattccactggaggtgggcaaattggctacgtttcgggagtctgcataatcactattttcccacaagataattgaacagtaagtgttagttaagatagtcttggaagaattcccagtttcactgtagggaaggagaagtttatatcatggcttttgtgaagtttggataatcagcactcgtggctattcacacaactttatttttcttttcttattgagagcgaatgaaatctatagctacaaagaactcctgccatatttcaacatcgctttctcacctgtggaagacatccctccctttggagcaattgtcctggtgaacctctccctgttacagctatatgtccataacagttgactgttgactgtgacagtctccttaacttcctgtctggttagtgtaaggtcatgattcccgaggagtggcctctggtgacttcacggcttcctctcgtgagggtgagctgtcaggaacaggattccatgaaagcccattggtgtgaagagatgtctgctgcagagagggaaaatgttaccagtaaaggccgtggcagtgctctagacgtttccctgggattgttggcctggaggtggatacctgatgtgctataatatttatagaatgagtctgtgtgttttgtcaagtgtccctcaaatgggaggtttctcattgttttctcctgtgttgtgttaggattttaagagaaaagatgaagaaaataagcttatgggttttttttttaaccttttagtgcttttatgtactccttattgagtgggacacatagagggagagtatgcctctccttctttgtgtctgcttgccttagaagagccaccttcccagtagcaatggtgacaatgacatcttaagtcctctctaatttcaagagtatctaattatgaattcttagaagagaggagaggtgagcgagctgcccatcaaagttcccagtgggacagaaagcagcaagttcctcttgtttcttctcatggagataagcacagagctggtgccttgtttctgagaaacagaatactttagctcagtaatgctaaattttaatttcccagtctatctctcataggctttggtgaagaggtgtagaaacataaattaatagaagtcacctgtatgaattaatctggtatttactgatcatcctctgtcctggacagtcattgcaaacaacatggcctcgcccctgctgtgtgcatgtgttccacagggatgaccacgtcaggtgtcacaatcctggctccctttaatacaacacagtcatcacccagtcccagtaagtgtgagctggccctctgcttccagtttctactcaatctggtttgtagaacttacaccatctcttaggcagggttttcccagcctcatcctgggttttcatgtgccctttcttcatgcatgatggactgttgactgccttgatcttgtgcagatcatgtggtgatagaacacagctgctgtgagttgatgtgttcaataaccatgcaacccaagaagtcatcacttcccagctgaactccccactccactgactgttacattgcattgccacctgcactgaagaagaaagaggatggcctgaagagtaaaagccatgccttcaaagagggcacagttgacactgaccggccatttgataagaagtgacttgctcatctctctgtcttggtgcttccatttgtaagatgacaattgtgtaatctcagatttgttttgcagatcaagtaagaaaacttttgggaaaccttacacccactctaaactataatatttattagaattaacaggagttcccagaatgctgaagtccaggggcacacatcctatgaccgatatcttaagatatttctagcagttactgttctccatattgtgaccctggcaagaatatcttaaggaacaatggttcactttagttcacagtgggaagaaggcatggggacaggaacatgaggcagctggtcacatttcatctatggtcaagaagcagagatcatgacctctagaactcacctacgtgtctcctttctgtgggatcaaagcccctagccatgggttacgctgcccacatttagggtgggtcttcctttttcaagccaaccctctgggaaataacctgtgcagacaaagccagaggtgtgattccacattgattctaagtccaatcaagtgtgactccgaagatttaccagggtgacgttctctttgtgctttaaaccttgagcaaggaagcttctctttggacggagactcatgacttgtgaaagtgccaagtgtaagtcacactgagcgctgagctttgcatgggtcatcgatatcagcttctcactatctaaggcttaagaaaccatggagaatggggaggaggcaatggaatgtaacagtcactggaggggaagttcagctgggaaatgacgacttcccgggttgcatggttattgatcacatcaactcccagcagctgtgttctatctccatattatctgcacaagatcaaggcagtaaacagtccatcatagatggagaaagggcagatgacaactcatgccttggtcaagagttatgggaaactgacagctgttggggaagtaaaagtatattcttcaggggtgtggctactggtaggtttgtcaaaacctaagtgaaggatcctacccccatgtacttatgggtagctctaattggactcagtaggttatttgaaaagggaagttgagaggatggactgggagtaagggagttggcttgggagtgagtgggaggtggttaagatcaagacatattgtaaagacacacattgtatatgtgcgtgaaattttcaaatactagatttaatacattatgtatatgcttttacaagtataattttaatatacagtaggatgtagacgctgaatcagaaatatctgacagaacagtcacaatgtattcctttctcttggctctggatatatgtatatacatataacatatgtatatatatatattatatatatatgtgtatatatatcatatatatgtatatagagttcatacacacacatatattgtatctatctacacacatacacatttatatatgtatatgtatgtatatatgtatatatatgtgtgtgtgtgtgtgtgtgtgtgtgtgtgtgtgtgtgtatgtatagaaaagatctttaattgtacctttacttagacaagaaaaatatgttctttggctaaaagataattatagaccattaattaacctttcctttaccaagacagttcttctgatcaataattaaaattattattttttccattaatttgtttaagaaatatttagatctacaagcacaggatgttttcatcgaccttcatatgtactggagggtttcgtcctcagagtttggagaggaagaggatgatccaccaggctatgtagctgtttaatagaacctgcctttggtggattggtgtcacatatatgaaggtctggatgcagaagagactctggtctggagaactgagttccataagactggactcttcaatcccaggaaaatacagggatgcgatagggctagacaggaaattagaggccatattacctgcttccttaagatgtgtctgtgtacccaaattagaagaatggcatgtggaccccctgtaagggaatactagaggctactagagatggagaaggctgagccattgtgagacagttttcacaaaggagattcctacttccctctgagtggtcatgaggaacacaagatatgctcaaacatgcatgtcaaatgctccctgcagtctccaccattaaagtgaatatgggaacaacattagacccatcatgcagatttctgactgttcaagtaccttaatctatgtgcttaatatgattgaaacactgagtacaagtaacattttaataagtgatactaaattatatgtttataagtggacaaaaaagttttagttgtgaccttaataagacataattgaattaaaatattcagaatgttctctaagaatgattttactacaaactgtttcatccttcctgtctatttttgcatccttgacgattttaatatttgtttcacagaagagattaattcttgtctttcatctctctcatgtaagtgttttgttggttatatatgttaaacaggtatgctgggtttagtagacagtaatctgtcttagacttttatctagtacgttacgttagcttggagcacaagtgtaattgataatgacaaatacttagcagagaagcggtatggaacatttcatagataatcttctcaactgatgataaaacaaatgcacttccttagcaaccggatgctacgcaatcagtaacctactacaacctctgaagatcaagatggtggggttgggcaacagctaagttggtaacatgtttctctcattgccttgagtcccagctcccatgcaaaaatgctcgccatggcaacccatttgttaccagtgctaggaaggcagagaatgtgaatacatagggcctccctggcctccctcagccagcatagcctcatagagggcctccttgccaataagagaccctgtctcaaaactggtcatcctctggtctccacatgcacactcacgtgcgcatatgcatgcatctgcacacatatgagcacacatgcataagagaaaaatgattgaacacatggtctctttctgttcactacccgatgagcataaacatctcatgagtctttgggttggaagaagaagcaaaggctctagaaggaaacgaaactgaccagaggaaggatgtcaataccagactcatcctgtatttgagatacacacccactattgatctcagtaaggagatctgcaagatgcatgcatgttttcaatatttctgctaaatatcctctctataaagccacctggataactcacctgctgcctacatgacatagcctgtgacagcactaaaggcataaaaagaactctaaaaatgtcagttgtcactcttgggtgtcagtgaatatgatgtcattctccagcagtgtgcccacacatagcgtagtctgtagccacatgagccctgtgggtccttaaatgttgcttgcacgttgatatgggttctcaatataaaatatacactgaattttaaagactttggagggggaaattaaagatagtttattgaatatttttatgctgactacatgttagtttctatcatgtgaagttaaaaacacattattaaaatcaatttttcctgtcacttttattgtattaatatgactgactagtaaaaacctgaaatttcttgtatggctcatactgtggtatgcattatgcttctctgactgctgtaatgagacatctaggggttttctataagtagtcataccacagacattcataaagtgtcctggtcagctatgatgacaggaagcaagtcaacttttaaatgaatgcatatgaactatgaatttatataaaattaacatgaagtgggatgaatcttgccaagctttgccagttttctctttaataagtcgtccacaccatgctgtgactcatgagaacatcctgcttctaggctactggttggttcaccgtggagtggcttccctgagaaccgaatgggagatgtgtacaagtgccctgtggacctacccactgccacctgtgaaaagctgaatctgcaaagtgagttgtacttagcaacgggattctttacaaatagcaaaatatcgtttgtcataaactcagacaataacaaccaaaacctgatttttgtcttaagaaatgcagatagctttatgtctttgtttatttaaccatgtggataccagatcgcatccaaatgtttcaatacgtttgaacaaacacaaacatacatgcatgggaacaagtgtaggcacacccctgttagaaagaaagagcaggagtgcccttgtatatctctgtatgagaaatttgtaacaccatatctggctcacagtaggtgcttaaaaagcatatttggagtgagtcatgtggtcagtgacagcaaatgctagagactgaagtgtgaagtaaaagttttcagttgacataaaagggatgtggttaatcagagtcctagacacccaccatatatggaactgatattcaaaatttttactataacaattggggagataacggaatggtagattccaaaatatgtgagagcctgggtttaatcttcagctctacagggaaaaaaattaaccacaatttttattgtatcatctcaacccattgtaggtagcagctttctagtaaagtttcttctccgaacctcatttctctggagagaaattgtggttgctgtctttccgccactcctcttatcaaagaaaacctggagatgtcaacattggagtttgctttggggtcaattatattgtatagatagcagaggaaaaacaacagtgttgatgtgtacctggatattgagcaaaacagtcagagtattttgaataaaacatgggagataagaagacacacacacatatttaattttaagctaacgcatgcctggcacattgccttagtaacaaggttcttacataaaaataagagcataaacatagaagtcccattattttctttctgtactcttccaaaccatctgtaactaacaccgttctaagtccagtggggtgtgagggggtaaaacaaaagaagaagaagtaattcagaaagaaaggagtatgagcattgagattcggcctccatttctagaagttaggtaatacaggaagtgggagaacagctctattgggcagcgagattaagaactctttccaggaaacgacggagtatcaaatggtggcaaggaggaaatgggtattagacaatgagagtgcggcattaagctactcagagcagcttccctggcgcctgggagagcgaatcttcagagaagtctccttccctaagacagaaaggaagcagggagggaagtgttccagcagtgaccctcatcgtgctgaggagccaaggtcacaaagagtgtgagccctcaccacagtgtgcagcttctccaggacactgacaggatgagggttccattgaaggtcgaaggagacaagttttagagctgttgccccggggaagtgagggaagcaacccagctaaggaataatgaaagtggcggtggcgggcgcagaccgcttgcctgagtctagagaacaagagtaaagtgaataccaaggagaaaggagaggaaataggtagtagttggtgtcttagtttgcaggtgcagattgatttattattttacctgactagtcctttttttttaatttttatttttaattctcctattcctttgagccggagtctatcaaatggtgatcattaagaggtttttttgtttttttgttttttttttttgttttgttttgctttcctgatttaaaaaacaaacaaaaaacaaaaccacgaggaaaggtgacaaaacacctgtgtcctcatgtaatttttatttaatcagaacattgttcttttaaaaatacatatttaaatgccctgaaggcctcacacaccaactcgagccttgaatggctgaaggatccacatctccactctgcattatataatgcttgttccgggatatgctatagtatactccaacctgtgtaaaaccacgagtgtgcctggatcctttattatagccttcagtaaatggtaaatatttgacactttataacatctctttctctccaaaagattcagcaagcatctcaaatgttaccgagataaagaccaacatgagcctgggattgaccctcaccaggaatccggggaccggaggctttctagtgagtgttgtcctctcagatcctcactcctcaggagagaatttgtggtcagtgtcctcctgccatccttcttatcaaatacaatcgggaaatttaatcactgaaggttgcctgtggaccaactatgctatttggacatccaaggaaaaacagcagtgtttgcatagagccttcttgattattcgcgaaaaccatgaatgttttgaatgagatgggaagagtaagaagaagtctttagcccttggaaagtgtgctgagtaggtgtggaaaccatcaaaacctcgcagcttgttttttgcttcctcaaggagcatgcgcgaggcccttccgttccacgggcagggctcaaagcaaagctctggctaatctgatcctatgtgaagtgagaaactgtctcttatgtcatacatctgccggtcctctcacttatttcctaatgtgttatgaaaggaaattttctaaagaaaagaatttctgagcttagatttaatataggaaattatttaaaatatttgactatataaacagtgagaaaaaatcacatgccaagcccccaaagttagaatatcagtaaaaaaaaatcatattttaaatttcccctggctcatcatataagaatagtctagctcagaggttctcaaactgtggggttgtgacctcttaaaggttgaacgacccttttcacaggggtcatatatcagacatcctgcatatcagatatttacattgtaattgataatagcagcaaaattacagttttagcaacaaaaacagttttatggttgggcggaactgtattaaagggtcacagtattcggaagatttgacagctctgcaaaaaaagcattgccctcaaaagcctagtttgtctttgctactgacagactaacctgaagttttgcttttttaaaactggatttaaaaaaacatgtagctaatatcatttccatttagaataacagatatttacattcttacaacctaattaccactaagcaaatgaaatactggttatcatgtctgtcctatcacggcataaatgactatggaaaggagtttctgtacttggttatatatacttggcgatctttataatagggttgatttcatggtttttgcttatttttgcagctgcttaggtcagaagaatatcttgaaagttatggactatagctgtactttaaattgtttgatcttaattctagatgtaagaagaatctataagagaattagtagtccctgggagggatctgagaggagagatcagactttctttaaacattcaaaaggtcagagtcttgagctcctctgaagaattatgtggaaaagactggcgctcatcacatatttctgaaccttcttaagttctgggcttaaagcaagaatgttttggcattagcaattggcgtattgtaacttcagcttcttaaatgctcttttccaattcttctgaaaaagaacctcaattctctaacacttgatgagctgttttctgtggtgataaaacaactgaaggtgcagacatgggcatcaaagattgttattgtgagtgtgtgtgtgtgtgtgtgtgtgtgtgtgtgtgtgtgtactagccagaagcaacaatgactttttcctgattggcaaagtgttctggttttatgggaggaaaaccaggcttgctcactgatcacgaaatatgagcacagctgctaggagtaagccactaacagttaaaatgggtcacacaaatcccttttgtttttccatgacttccatgcatctctattcagttttaataagttcaatgctctatgatcactgttttaagtcacgtgcaattcttcaggtaacttatatcatccttagacttgacctatccctgtctctgtctctgtctctgtctctgtctctgtctctgtctctgtctctgtctttctcttaagctccctcgtttcatccagaaaacttaatattagagagtctaatgtctcctatgtgcttgagtcatgactgaaccagcagatctcatttatcagagagctgccgaggagagaattggtgctgtctttatggcgaggttaagagttagaataggtacgttttgagcaaggaaataaataccagcctcctttgctagcttaataaatagaaagtggaaataagggaccttggagctcaaagtgaagaaatagctgatagcaaggctaaaaggcagcagtgcacaacctcactggtgttgtttagtgtgttaatatactttacaagcacagggttttactcaaagtttgcctttataatctcagggggaaatggttttgaaacactgggtgagcagggacacagtggcccacccctgaatgcaagaagtgtgttctttgtttgccatgctgtctatacacagctcaggcaggcttgaggatgtttgtccttagaggttgctggggtttgggttcctgttaaaaaacgagtggtcaagaggacacttgatgctcaaacaagcctggtgacgtgcaggcacaacacttgctcttctcctgacttctgagtattttatggttatgatcttcaaacatcgataatcacaacaagcttacaagcaaaaacagcacgatcaccttcattttataaatgagccgtgtaagacccacatatctaagagacaaaatgcccactctgcgttcactctccttgagaggcatttctagacgtagtttggtgagggaccccatggtctctctgtccattgaaagttaccctcaatggtcccatcacgtgggagcacagctgatgccctctcctgtcctctcagccttcccagaagatgctccttcaaaagcattttaagaagattttttttgagaggagagggttttttgttgttgttgttgtttcaaccacaagaatgtgtatgtctgctcaccaggtgcatgccagtagtgcccatagaacccaaaagaaggtgtcagatgtcctaagactggagttatagacagttgtgagctacaacgtggggaataggaattgaagctaggtcctctagaaagacagccagcgctcttaaccactgagccatctttccagtcattcaaatgcatttttgactcactagttttaacagttgacaaatcaggtgctagagagatgtctcatcagtgaagatcactggctgccttttcagaggacctgggcccaattcccagcacccaacattgtcttcaggcctccaaggcactgggcacaaaagtaatagacaaaagtgtatacaggtcaaatgcacacacacacacacacacacacttatatatttggtgaatcttgggaaagtatggtgtcttaattccataaaagtagaggtagaaagttacattgcctgtgtgtatattattttctcctttctttgaagacctgtggtcctctctgggcacatcagtgtggaaatcagtattatgcaactgggatctgttctgatgttagtccagactttcagttcttgaccagcttttcacctgcagttcagggtaagtcatgaatgtcaaagagatctgagcaatgtcttagagtcaaagagggaggggctacagtcaaaggggagggattacagtcaaagggggaggagttccagtcaaagtgcgaggggttacagtcaaagggagaggggttagagtcaaagggggagtcccactcaacctctctgtgagtctgaagtttatgtgattgtgacatttgacttatctttgaaaacaatgtgtttttgtcatctctttctgcacagcttgcccttccctcgtggatgttgtagttgtatgtgatgaatcaaacagtatttatccttgggaagcagtaaagaactttttggtaaagtttgtgacaggcctggatataggacctaaaaagacacaggtaaggacatcaaaaacaaacaaacaaacaaacaaacaagctcacagcttgcttttggagaaaataatgttagatatgaagttttaaattttcatttggcaaaatattcatattaaatgaatgtaatggtaacctggaaaattaattgaactatatatttctaaggtcagtattctacctatatgacttggttcaatgttgttaattttatagttttatttttgacagaggcattaaaaatggtgtatagcatttaagtctctttcaaagctgctttttaaaattttttaacccatgaggtaattaataatacattttaagggaatagagagatgacttggaggttaagaatacatcctgctcttgcaaaggaaccaggtttagttcccagactacagttccagtcccaggaggttcaaggtcctttgtcctccactgacacctgtgcatacatggtgcacataaactcacatacatgtgaatatatatatatatatatatatatatatatatatatatatacacacacacatacacacacacatacacacacacatatatatgtatatatatatacatatatatatatatacaaataaataaaaaataataactttttaaattggacacatattttttcttaatacctattttgaccaatagtgaattcttatttacacctttctggtaaaaagaattacgtgaattgtgtgaaatttaacaataattcagtaaacataattctaacattagtttatagcctttagtttataatctaggctaatttgctttgtattttaacataggagcaagtattttcaataatttgaaactgttttatatgttttcagaagtctctaattggatgctattatatcttcttgatgtatggacctaaaactcaggcacaaaagtttcataatttcccaagactaaatagtacacactttaaaaaaaaataacagctactcactaaataaatgcaggagcatttctggagcccaagattctgaaactggcctggacaacagagcgaaacctagaaggaaggagagtgtaggggagggaaggagagagaacagagaggggtaattcctagatatcttgagttgttttttcttcactatcatcatcatcatcaccaccaccatcaccaccaccatcaccatcaccatcctcttctctttttccggtgtctgactcaatctactactcataggtccttctggccgagcagcagcatccccggagagcagttcactggcatctgataggctgaaacctcacacctagtcacagctattgcaacagttttccttattctttgaagatatctttagtgaaaattcacttttctggttccctttaaggtattatttttaaaaagggcattgcttttctatgccaggggagtgagcaaactgctttcggagaccatggaaattccactagtttcactagaaacttctagttatgaagactacatatcacactggtttctggagaacagcgcctttagatctcctgaagtacagagctttcacgcttgtctgtttcttctgcctatgagtcagttatcacacctgtcacagctgattcgacagtcgccaggtttcaggactattctcagattcatcttcctgccaccctccattgtccccttgcctagaggaagctgagttgtctctccactcaagcacatacgtcataaaccctcctctcctgacactcaggcctcggctgcgtcctgaggatcacatgcggctgacatcatcagtcacttttgaattgcttgcacatcttctcttaaagaaagatgcccaggatgatcagcgtgtttctcatgtctccgtccccccccccccccccgtggctgtcataccacctcccaggcaatgctacagactggactcaacaatcaagggctgtccttccacgccctgatatccttacctcagagactcttgtgtctcttagagagcctcttgcccctcattcctatttcctggttacacatctcctaggctgggagaatactttcaatgctcaggaacaggcttattgatagaaatatgtacgtttcttaaactaaaggattagactatgctcctcccccaaacatcctgctcagaagtttatctttctgttagctctctcaagtaagtttctttctgatgctggatcctctaaaggtcagaagttccttgccccatatgtgcatccaacacccttgctctgacaatgctcaaacccacagtaagggaactccaaccatcatcaatcaaatagagtacattgcttaggggtgtgtgaggttctcttcaattcaactccgactctgttacataactactctcaactaaggaggtgctagtctccacctccgattacttatagctgtcttcaaggttctacccattgataacgagagatcttatttatttgtatatgttttaatatttgtgttagaaacctgagcctaatattcatttgcattaagtacactaaggaagtgctttaagaatctatagttacttttgaaccaaaagtgtaaactgtaacagattatcttgcttggtagtcatgctcctgtcacacactcatggccttgaacaaagctcattccacagaaagaggaataattgtcaagctcagaattgaaatgagttcctttaagctattggctcacatcgaaactcaccttgagttcttattatattggttaagtatgagatgtttataagctaattacagtcataaacttctgctcttttccaggtggcgttaattcaatatgccaatgagccgagaattatatttaacttgaacgatttcgaaaccaaagaggatatggtccaggccacatctgagacgcgccaacatggtggggacctcacaaacaccttcagagctatcgaattcgcaaggtaagttttgctgctatcaggtaaaagctttgacaacgtggaaggacaaatagaaagaaaagaaaacggaaagggcaaaagaagagtgacaagggtggaaccaagtctgagctttctgatcggctccccttgacaggacccagaggaaatcaggctacacaccacagtcatgggactgccagagatggaatggttttatatgattttttgacatgaattgcacaattttgcaaaggctatagattaaaatactatagatgaaacaatctaccactgttcgtattaacggcaaacaaattaagctagtatggtattctatacatactaatgaagctcatgggataatacacacaagaatctgaatgctgagattatctatcatgtctgctgcaacccacatggagtgtgaccttcacagctgcatggcttccatccctttcttacctcagtttctccttttcaattctgtaagctttaatagacactttactaaatgttcgcctgtcatttttttttttaagatgagaacaaatgtgcttgcccttacacccgatcccagccttgtccatctcctggttctgttccttcaaacaccattaaaacaagttgccgccatcttcttgcctcttcttccttgaacgttgtagctctgccactaagtgaacatggtgtctccatcagctatcctagcacttccccgtcgagccccactgtcctgagctcctctgaacatttgataaggacagacagacacgctgctatgaactcagtcttcactgaacaccacagacttctgcgatccccaccaatgttttctcaacagctctgctctcttcactgactccatcttctggtttttcttcactgaacaaagccctctctcttctgctccactgtccgctccgttaggaataatgtccctcccttgctgtgagttccagccctgtgtgggctacccattgctttatatcatcacttaactctctttccaaagtcatcagtcaactctccctgaagatgagcatctctattgggcaagtaccaactcacttagcacattcagtaagtcctgaaccagccccattcctttcccacactgcttatgatgctggtgtctgtttacccagtcatcacgtgaacaaaacactcattgtgtcatcttcccactccctctaagatacatatctggcccacacttgccatgtctgtctcaccattccctgtcttatcggacccttcattttctgtgtactgaagtagaagctttcattgactggtaagattttcttcaaatgtctcaaaagagagtatccataagagaagatgtgactggcttcatccttcctgtctctgtctctttggtggctggaccatgtcataaactgaaggccataaacatgagtcacttgtcattaagtggagagccatttccagtccagtaacccagattgaggaaagaatgttgtcaaaataaccttggaggatgcctgccttcagcagagaatgtagctggggcctatccccaagggaaaaaacttggggtcctggcaagtgttccaaaatagggcctggtcactgtttgtttaggtgtggattgtctggcttttagtacctttttaaaggcctgaatttttcctttaccactataatttccaaatgaacaagaattagaattcacccaaattctaagcagcacaacccagaatacacagacacacaaacgcagacagaaacacacacgtgcatgcatgcatacacaacacatacacaccatgaaattactgaaattactgttaaacatgaattataatttatatttctcggaggaagctacagatagaggaatgctcttaaatgggccactggcattagcacagaagaacactgacataaaaaaataaaacatcattcatgtttcatgtgcttaaagatgctaatttcacatttttatttcaaagcaggggtctatctgttagcttctgttaaccatgagtaattgtatccatcgcagagactacgcttattcacagacttctggcgggcgcccgggtgctacaaaagtcatggtagttgtgaccgatggcgagtcccatgatgggtcgaagctgaaaactgtgatccagcaatgcaatgatgacgagatactgaggttcggcatagcagtaagtgacttctgtttggatttgtctggcagttgatggctacacatccctacatgctgacactttccaggtctgcagtttgtactgtctctctgcttcctgctgattttcagtcgtgccaactaaataaatggctgcagaaacgtttgcaagaaagtttacgatgaaatgaacagatgggggaagttacacagactaagcatgacctttgccccctgctctctcttttctcgaggttcttgggtatttaaacagaaatgctcttgatactaaaaatttaatcaaagaaataaaagcaattgctagtactccaaccgagagatactttttcaatgtggccgacgaagcggctcttctggagaaggctggaactctaggggagcaaatattcagcattgaaggtaagaaggcagcactttctttcaaatgccagttttttggagaatttgtaactttgtataatttgccatatggatatgaattcataaaccattcagagaaaccagctcaggttatgttgccaagaaagatagacaaagcatacgcttacatagcttataagggaaaatgtaaggcattagcaagcaggagaaaacaaggaatccaaccacttttgtgttttgcccaaaagatgagacatcagtacggttgatgagacatcagtatggtttgattttccagaaacctccgaggtgcagagaagctcatacatgtttgatatgatgataatttttttacagtttttgagagaacataccactcttttttctctataaattacataataacagaaactctcgaatttgtttataattactgtatatgcctttaaaatggtgacaatacactgatgatgtccagaagttctactgcaggaaaggttttccttacaacagctctcgtgatgtactttcatagcctgggaacaccctccgggcagaactgtcatccaagcagacactaaggaccgaagaattggagtacttttcccagttggttaaaaaaaagtaacaggagatccaattctggttccaggtgcttaatccaagtaactcttagcagtaaagctggggtttagttgttcacctacatatcagacactgtcttagaacctggattttgtagttcagcctcgatcttctggtggtaccagagaaatttctatcctgctgcaaatgtaattgctcaagtatagtgtttctgagttattcaagtcatcacccaaaactaaagcctcctgcaatgattggaaactactaacacgtctgtactagaaaatttgcttgaaggccatgagtaagaataggtgcaatgtaatttagggattccttgaaattatctcagacagttcattttgttgaagactttcaaggagcataacactatttctcccctaaattgtctgcatacagcctgtgtgaattatatcttctaaggaagagtgtatgtcacagtggtacagcttgttattgtattacagtgtctatgtaggaatttggcttgctttttatgaacattattgaaaccattctgaccatgctgaaaataacatctctaccaataaaactctgtggtgttagacagcgacagatacttaagtacagttaaagcaactttctagcctctttagccttgagtactggtgtctgttggctagcacaggttcccttctgtccagtctatggtgcaaagtaattgcatgctcttccattgcatgtgaagtatttgtgcattagcagtgccaatatttaaaggcaaaatccaaattgttccttggccaataactatgaatttaaaacaatgctctcatctcaatttccaccttaactaatcttctcattttgctgaggctaatttgatatcaggaatagcataaatacttcattaaattaattaatgtttagtggggatcaaagccaatattgaacactacttggtgacttgttttggggtttcctcttcctagaatactccaagctatagttttacattgatataagaacatttgtgtgtgtgcacacatgtgtgtatgtgtgtgtatgctggaggaaaggtgtttttcaatgtgtccatatttgaaattttgattgctgacaataatatcgtttttgaaaatggtactctacaggcactgttcaaggaggagacaacttccagatggaaatggcacaagttggattcagtgcagattacgctcctcaaaatgtgtgtacatcagataagttgaagtcaatactatcacttgccagaatacacacagacacagcagcttagacataaagaaggaaaagcagatatccactgagaaatgattcagattcctgggcccagctactaaatttaaaaataaaatagccaggcgtggtggcacacacctttaatcccagcacttgggaggcagaggcaggcgaattttgagttcaaggccagcctgatctgcagagtgagttccaggacagccaaggctacacagagaaactctgtcttgaaattaattaattaattaattaattaattaattaattaaaataaataaataaaaacgattacaattttcttttcttatgtaacagaaaaatatcatttgcaataaagactttgattgatcttccaagggaaagacgctatactaactccaggcaccgtctgtataagaatttcatggcaatcaattaactacttgacttgaaacatctgtcagagaaacaagaccattgtatccctgacagagtcacagactacattttcatagtatactgttcactacagagacagaaaattgttggaaatgagatattcatgaaatctgaagggtgtctgtggtccccggtccccctagctcaggggttcagtccatcggggctcttgggaacaatctctaggtctggtctctaactcttccccaggacatgggaggatgcaaaaccaaaggagaccagattctgtgaaatatttagggattaatttgaaatcagagggggcgatacacagagctaaggatcagaaagtgtagagcaggggttcttacccttcccaacgctgtgaccctctaacaggtcctcgtgttgtggtgacacccccccccagtcatcagcttatttttgttactactttataactgtgattttgctaatgttatgaactataatgtaaataccttatattcaggctctttgtcatgagacccctgtaaaggaatcattcaacgcccaaaggggtctcgacccacaggttgagaaccattagtctagactaaaagatgctaacttttctgactcaacaacccttagagatgttgacaaaagttaaaaacctttcccataggaaaagataaaacgacaacattactgaattattgttgcacaagtctgtgaggttactgccgtcccctggaggccacttctatatcctcagcttaaagtctgtgcttatgttaattatgccattctcaaatttttaatattttttacacagaataggattttctttcctattttttattttaatcccacatcatatccttgtttccttatatataaggggaaaaaaaaacccttaacaataacatctttcatcctgaccaagcctgtgtgcctaaggacttgaagcctttgatatttagattgagtttgagccaatgcacaagagcatgcagagcttgggcctccccatccatctctgaattaggccaactttccaccccctatgtcgactgtcacagctacaggtgagttttgtagctgtgctatgatttaacacatgggattaggggatatagatgccagaatgtttgaaaggaacagaaaaaaaaaaagaatgatgaactgtagggctaaagcaatacctcagagagcttgtgacaagagaatctgagttcagatcccagcacccacagtatggaaagggatagatggttgcccaagtacctgtaaccctagcactgtggagagtgcagccacaggaagatcactagagttttctggctgccaccttcgcttcagtttcagtgagagacccccacagcaaggaaatgaggcagagagtgtcggagcagagcacctctggcctctgtgtgcgcaagcctgcacattccagcataaaacacacaccacaaatatacgaggaagagagttgaaaatacagccagtcagaagaaggtctcccaagacatgctaggtagggaagcgctgccctacctcactcctctggggtcagcactttctgttgctttagcgtgcctcatattcatcccgagcatttcctataaatatgtgggaggagaaactctcgtctgattcatctgtaagttctgaaaggttcagcacttgcaaatgcttgccttcaaattgaaagtgactatgcatccatcctgtaccatggccaattgcaaagatttctgcataatgaattatagtaagttcttccaagagagcatagctcaagtgtcactcagccttcctaaagctaagacccttcaatatcgttcctcgtgttgtggtgatggccccaccataaaattatttttcattgctacttcattgtggtaactttgctaccattacaaattgtagtttaaatatctgataggcagaatgatcttaggtgacccctgtgaaaaagtcattggaccctgaaggggtcatgatctacagattgagaatggatgccacagctcatggtaagcttgaaaaacaaaacaattccaagatatatatttaatttagtatgcaaatttccttaaattctgttagtttctttcggtgtttgactcacctgaattcctttgccttaaaggtgatttgtcttaatcttcatttcttcaatcttttcaggatattctgatgttaggtgcagtgggggcttttgactggagtggaactcttgtccaggagacatctcacaagcccgtgatctttcctaaacaagcctttgaccaggttctgcaggatagaaaccacagttcgtttttaggtgaggcacagcaatagttggctcagaaaactcagggtttggttggttgtttttttgttttgcttttgtttttgtttttccctctttgaactctcagttcagctcagacagtgagctctcctctctcattaatgtggttttaatccagtagttacctcttggccagttgggtctccaaaacagaatttgttcctaaaacataatacactgagcagtagcctcctgttgttttggagttcttagggtgtttgttattgttggtacacatatgatgagcatccagtgatgttcactacctgagggagattacttatattctataagtaaggatttgaaaatcatttcagagccagtgactttaatgtttattaacttcaacaacctagcaaatgactagtccagaattcaaacccaggcctctaactccagggcctgtattctttccattaaatagcaacaccacttaatttcatttgctgattcattaaactaaaggacagtatctttgttttgtttcctgttgctataataagatatggagacaaaggcaactcaaaggaaaaagggtttatttggctcacaattctaggttgcagtccatcactgcaggtaaatcaaggcaacaggaacttgaagcaactattcacataatatacacagtcagaagctgagagaagtggtttaatggatgcgtgcttgctcttagctcagttcctctactcttactcagttcaggatcccctgcctaaggaatgatgccacccacagtgggcgtcccatcccaattactcaattaatgcaatcaacttaattcctcatagatatatccgtgagcacacctaatctaaacaacccctaactgagactctcttcccaagtaataatagattatgtcaagttgaccactaatatgaacaattagcaaggcttgtaagtaagtagctaaagagagtatcccagaaccgagaggcagctttataagtcctgtctatgctacctagaactataaatgaagggcagaaaaattcatttcaggagcatgagtagacataacatctaacattaagatttctgagcatctctgttacctttgaaaattctctctgactgagacagtgatgttctatctagaactacttctctcctaggttactctgtggctgcaatttctactgaagacggtgtccattttgttgctggtgctcctcgagcaaattatactggccagatagtgttgtacagcgttaacaagcaaggcaatgtgaccgtgattcagtctcacagaggggaccaggtaaatatcattactaagtaagtgaaattcattttatggataaccaggccaagcgaagtagaaacgtgtttactgagtggctccaacatgtttgtgtaagtcatctcaatttactcatatctgtcaaaccctaatggaggaaggttcactgggcttaagtctgatcctgctattgccattgatttttctaggggtaaggagaccacaaactaacattcataccatacttttgccttctttttagtagtataaagaatggggtatctattctgagagaaaaacaatgagcgttacagaagaaatcccttactaatttttaaatccttaatagatgttacaccaacactcactgaacattgctgaatgggatggcattcagagcctcagcccttctaattgacttcatctctacctagttctcttatcttttctatgcagcaacatcacctgtgttggaccatgacactggcattagttatccacgtttctctccacctagaacaatccttttgtctttaagatgttatttaaacttgtcttgaagatgctatacttctctccctgagccttctacctgctccctacactctgataaagtgtctgttacaacattttgttttgttttgttttgttttgttttgttttgttttgttttgttttgttttccatggtaacatgtctactctctgtccttagctggcctgatccttcttgtctttctctaaatcagagctcacatagcttataagggttcctctcataagctctggctcactggcatcagaaatacctaaaacacatacgtgactatatataactcttcaaattaatttgctttgctcctctagattggctcctattttggcagtgtgctgtgctcagttgatgtagataaagacaccattacagacgtgctcctggtaggtgctcctacatacatgaacgacctcaagaaagaagagggaaaagtctacctatttaccatcacaaaggtaaaaataaacattaagaaaacagcttagtactttaagtactgataaataagttgattctagtactgttaagcaaattaacctgaaatttgaaagacacttattttcatgcatagtgtggcatatgttcaatcagattcaagacatcaccatcattatcatttttaaatgtattaaaaggcatggagtttaatatatagtatatcccattttccatgagaggtctttggatatatgttcctatgcaaataaagccagtgtaagcacaaataatgaatggcatgcatgtacatacaaatattagttattatcattctgtgaaatgatagtagtcactgggcattctgacctcccatttcacagtaaaaataattgtcccagcaactcccacaacccccagatgacctagagtgctttctacattagtttgtcagaaaattccagctgttagtgtcacatttaagtgcacgtccaactcatggaatgtcagatccttgccataaaactgagctcactcaaaaagacaaggcacgggttttccaatatgtagacgaaactctgcattcatttccttaggactcgagctcaatgagaacaggaagaaaagcaaatgaaagtcagtgtctgacatgaaacaccaggcaggtgcaggggaagagaagtctgtgcaggcaaagttctgtctagttgttagggcattttatatgctggatgcttactacatgttaatgtaaaaacggactgtctaacacaagtagttaaattaattgcaattttatataaacaatgtaaaagcacatgcagatagaattatatagttccttcttaagagttttttttaatctctagtttcttttgaatttcttgtttgcaaactattctgaactatcgttaattgttgatgaacatagctgtttaaattttgttttgattgttttattttcttaactgtatgactgttttgcctgcatgattatatgtttaccatatgtacattttgtatgaccaaggagaccagaagagggtgttggatccctagaactggaggtagtaatggttgtgagttaccatgtggatgcttagaaatgaacccaggtccactgcaagaacaagaagttctcttaatcatggagccaactttccagccccagtaacattctctcttaatgctttttctaatacagtaaaaaaaaatcttcataaattactataaagtagaaagaatcaacaatgacctagtttcctggttgagacacttcactttcttgcaaagccattaaatattttcatactagagcacaaactcagaaggaaaagctgtgttttataaggaaatgtcttttcctttgcagagagtcatttagtgtttcctgttatggaatgctagtgccttctttttccacctcttaccccaatataattatgtcacagtgcagcagtttttaagtaagatctagattatcaagtttcattgagttttgttatctatcctaatttcatccatgttactagactcctaccagaaaacttttaagtcaaagatttggaaatagatgatgatcctcatactgagagaaagtagagatagggttgatttatgtaggttttttttttcattcaataaaaaaattattgtctcctttcatcctcgtttaggagcagatatctcatgaccctaattaataaaatctttatttataactttcactacacgtggagaatcatcaatactaatattaaaaccctatccacattttgaaatcttgtctagacatagctgctttgaattttaatgatacacattgagagtttcactgtcacggtccctctcccctttgccagggcatcttgaatcagcaccagtttcttgaagggccagaaggcactggaaatgctcggtttggttcagcaattgcagccctgtcagacatcaacatggatggctttaatgatgtgattgtcggttcacctgtagagaatgagaactctggagctgtgtacatttacaatggtcaccagggtaccattcgcaccaagtactcccaggtaacccatgcacaacatgatgatgtattgtgtacataaatgctggagctagaccgcatcatccaatccatgcctcttatatccaccttctttccatcaagaaaaaaaaatacttagtgaagccttatgatatgtcaaacattattctagataacgctgataatgctatacagaacaagacaaacaaaattcttttttgttgaccttatattccaatagaggacatatgaaaaaggaaataaattgcagtggtatagataataacaattgtcaagaatcaaacctaagaccataaaactcgactaaggttaaacttcatggatgaagggtatcagacaactgaagaatgattgaggatttcttactattaggcaattttgtgttcattttgaggaaagctagctagggcaggaaacaagacctgaacttgtcttagctcattccctgcccatggacttctcaccattttgtgctgcttcgtggttatgaactaaaaagtccatgttatttccttgatgaaggaatcattgttaaaaaaagtaataataatacagaaatcatatagaatgtggttgaagaaagggatggagtttcctggaccagacaacctgaaaaatgaccacagggaatgtaaggtgcaagaaaaaggctactgttctgtgatcccgctgtgtctactacaatgccacattaattccgctctttcagaaaatccttgggtccaatggagcctttaggagacatctccagttctttggaaggtccctggatggctatggtgatttaaatggggattccatcactgatgtatccattggtgctttggggcaagtgattcaactctggtgagtcagtaagtgtgagactcagactagttaactaaaacggcttgctttattgtgtagtgtgtatcatgtccaatgttttctataaggctgtaggaaatgtatttattactgttcacataaagaaagggatattcatggttttcatagagatagagagatatagattagatatagatagatatgggtatggatatagatagagatagagatagatataggtattgataagcatgtatctttgaaacacacacacacacacatatacaaatacttagagagagatccttgtcattagagtcaagtttttcttctccttatgtgaaaagattcagtgtgcagaaaaagtaccctaagtgatatcctgcatatttctgaatgttatcttcttatacacagcctcatttcagcttccagttaggaaaccttatgagaaaacactcacaaaacacaaagtaaaacttcctgtgtgcttaaaagacacacattaaaatcctaagtcatgaatgagaaccattattttggcttagctgacctcttcactaacctccataggcatcaaagatgagggaacaagaaaggattccaagataatatggttcaagctttgaaaagccaggtctatgaaggccttgaaaagatacctcagttatttagagggcctgctgtgttagcgtaaggacttgagtccagtctccagagcccatattaaaagccagacatacccaggtgagatagctcatgcctttaatccaagaacttggaaggctgacagaggtagatatctgtgagttggaggccagcctcaaacatagagtattccagatcagctgtagctatatgtttagatcacttaaataaacaaacaaaaaactaagcatagtggcacatacatatagtcccagatatggtgaggcagagaaaatatctgtagctcactagctagctagccttgactaaatatcaagttacagggatgcaaataccatgccttaagcaacagggtgcctgaacactcaaggttgaccactggtatcctggtacacatgcatacataaatatgcacccccccatacagatacatacacacaaacatttaggtgtgtgatctagtgagctactggaattaaaaattaattgattattcaatcaagaatactcatgcattcatccttctctattgaaaatatatgccttaactgtccaaacatactggggacagaaacacagtcctttgatgttttatgattcctgagtttgatgctactctatacatatatattattattatacatattattactctatacatatattattattataactgaattatgcttttcagtagtaaaatgagttttttgacaaatgaaactgttatgtggaaaaccaaggatagctttaagactgagaaactggaaaacacatttactgggtaaagttggttaaaataattcaagaatggcatacttggaatgttacctagttattcggcttcatttaaaataatgtaagaaaacaagagacctgacagtaaagagagccatgtacgcctcaggaggcttcccacgcagcgcctcgacatttactgtactatgatatagtttagtcagtggcctgaccaagctgctgttttcaaaggtggatttcattcttcagaaaagtcaacaacttgggaccaaatgaatgtgctgagatgactgctcccactcagctaatattctgtggtcacattcctacaacgtgctgaactgctctttctggataactctgagaaaaaatgtctaatacatttacaaaacatgcaaatcaatgtcacctgattcggaacgatcctcggtccctcagataactggcctaaaattcactgaatcatgataaatggttgtaaacctggagccgtgttacatttttcgtgtcatggttggttattaagagaaatccagatgtatagcaacttttaaaattgtcttgccagaaaataaaaaggcatgctttttggatctgtttatggtacttttcaaaatggtgaaatctgtagttactgcttgctgccttagagatgggggaaggttacacgggggtcactgtactgaagttcaagttctagtaatggagggactcagaccgtaggttccatttcctcactgataagtacccagtgaagtggtaagcctccgagtacccatgtctcagatattttcattaataagtctttttacgccaatgctgaaggagcaaataaaactgtggcttagatatacaaaggaccacaccaaggtagaaactctggtaccctgtgatggactcctcatccatcatgctagttcccaccatcatggaccagtgatgccaaccatgggatagcacgtcacaggtcatggcaatattcctcagctctgccacctccaacttctttccttctctctcctgccatttcaaggactgagagtaacactgacccaagttgggaagacatagaggggtcatgactttacatattgtctgcatagaggcttcatgcttctattttatgcaggttcaagtgttatgaagacaggtaggtaggtagataggtagatagatagatagatagatagatagatagatagatagatagatagatagatagatagatgatagatagatagatagatagatagatagatagatagatagatagatagagtcattcattctgtgggctatacagttatcaaccaaaaatccattcacctcactgccatcgtttgctttcaaataggaaataatgctctcaaattctaagacaatggagagaaaggtcaacaatattgaccccaagtcctctatgtaaagtgtatatgtattctgggcaataatttgcatctgtttccctgtttgcatttgtctttcaggtcacaaagcattgctgacgtggccatagaagctttgttcactccagacaaaatcactttgctcaacaaggatgctaagataaccctaaagctctgcttcagagcagagtttagacctgctgggcaaaacaatcaagtaggtaggtagacctaaagtaacctgtacactgatgggtttgccttgatagctttagctagaacttttggtttgcagaccaaaaagaaaaactggatctttacaggacatgcttaaattgcacacatgcagtatccaagagttattctttaggcatgggaggttgctgcaagcatccttgctcaggtctagattctggcattctgctggagaacactttagtcactgtagtgtaatcatgagctctgttgttgagactctcttacccacagatcctttctggagatgcttagcatacacagattttattgctctgctgcgagctctaagtgagtgtgttacctactgtctaagccattccctgtataggtgtccctagtaaagcactaaatgttattcccgaagaagaagtgagaaaaacagaaaagaacatataatctgttccattgcgttgccatttctgcctatgagtcttagtgtgtcccatcagatgggagaaagcccaggtaggactgtcggcaaatgtcagcagaaactgtcatcctctgtctcccaagagaccagactatcttgtgggacctggctgagatgctgcatcctctttgatgccatttctaactaaccatctcctctggtatctcagcatcctctgcagacagcaatccaagcaatgcttcattaaaacctgcatatttccccttgttcctggtcaatggattctaatctctccttcataaggttctggctctatatttcagaattcttagttcctagtggtgcttcagttaattgcaagaaaattagcttaaaggctgaaaacaattaggtcgactgtttggatgacacttgtgtgtgccttgaggcacacgtccacctgaggagctatcacaattaagtcgaaaaccatcaccatataaacatttttagtctgcataaaagattaaaatggaaaatgtagttctctggcagacatggctggctgcccagctatcttggccctaaagcatgaatatgccttgtggatcttccaccttttgaatgttcttcatatattatgttggcgaacactgaaaaaacctggacttccagagaattccattcctgctgattgtctggtgaggatgtgggagcctttcttgccactgggaacctgtccctttgactctctcctgctgtgtccaaatccaccctgatgagatggtcataacttttcacttcgttgcttggcaataacagcacataagaaataaatctcatctttaaaactggataatctatgaaactacacatctatttcaagctacttgaaaaatatgtgctgtttaccgacttcatcctttttatagctaccgagtccccactactagttttccctttatgtgtttttttatcagttacttttattctgtccattcaatctttttcatgtttttgatatgtttattggtctcattaagtcactgaaatacagaaattccagtttctttaatagatacattaaaagtaacagatatattgtcttaggaagtgtattcaactttcaaatcctgaataaatctgataaagtaattccccataaggcaactgccctaagcagtagggtgagctctgaatttctgagtggccaatggattctttcaaaggaagctggcctgattatttggacttcagttactgtcatcatttttcatcacacggtagtttttcatttctactcccctgagttgttattaaaattttctgactgccaatgaaacagagatccaaagagggtaggaagagtcctcaagtcaaagaagacatagactgtgaaatgaccgcccagtctaagaatgtctgactcaaagcttggtgctgcaatgccgcatgccattttccacgtaagcatctagactgtgtcaggcagagtacatgttcttttcgatggtcacacttcattcttatagtaacacttagttcttgtaatggcatggaattagaaaggacatgaactttcattacaaatttccttaagttttatttctgaccttgtccaagctgggtgaactcatgccaattattctgcctcatttcatctagttcattatctcaaaaatagcatcagagtatccagtgtccaggtgttttgtagagatcttagcatatgaggatgtggtcaactggaatttctccatttaactactcatcctgtgtgtgctccctgcgtgtgccctacattatggaagatgaaactgatacacaggaaagggacaaatttgccaaagtttatccaatagatttcccaggacaagcctaatagcccaatagatgttgggtttaattgttacaagacatgtttctctggctagcttgtgtgtgtgtgtgtgtgtgtgtgtgtgtgtgtgtgtgtgtgtggtgtggtgtgttcacagtcacttagaccaaatcccatgaaattacaaatgccatatagtctttccttgtacataaaccaccaatataaagatagtcttcccatcttcttgatatcaggggcttccttcaatcggatccaatggaaacaaggctgttttcgtcttcggagcatacttgacatgatttgtttgtggttttatcacagccatcctgtttaacatgacgcttgatgcggacggacattcatccagggtaacctccaggggggtgttcagagaaaacagtgagcgattcttgcagaagaatatggtggtaaacgaagtgcagaagtgttctgagcaccacattagcatacaggtgagggctctgggttcccaaccctgcttttcttttaaaagaggaatgagtacaggaagtctaaaatggaatctatctgttagaagatgcttgtctttctaatgaccttaggtcttgcctaactctgtgaacacaaagcacatttcttctatactaatacttacggtcacattcagattttatatgtgttggtgacatgacattttattaggaattgcaaccaaagggcctaaaagattgttaaagaaagggaaggcttggagccagagggatggccgagcagataagagcacctgcagcataagcagttcgacctgagttcaaatccccaatactgatgtaaaagagccaagtgtggctatacgtgtgcctacaacctcagcactctgaacagcaggcaagatggtttctggggctggcctgctggatgccagacttagtcaacgatcatctatatactctgtctcaacgggaaaaatgttgaatatgacgaagcagaagacctgattttcttctctggcctccacacatatgtacacatacagcacacacatgtatgtgtgcaggtgaatacacacacacacaccacacacacaaaagaagataagtagattaattattttttaaagtgaaaaacagtgtttctaaatgactaacagggtgaaattaacactgacaagtttattttgacatcttttcagtcaggtaaaagttgtatccattttaagctcctgagaatgaaaatctcaattttgggttctagtattgctttacagcaggtcagtgattctcaaccttcctaatgttgtgaccctttaatatagttcctcatgttgtggtgacccccgactatgagattatgtcattgctacttcataactacaattttgctaattgtgaattgtagtgcagatatctggtgtgtgacctcccaggggtgatggctaaggttgagaactgctatcctaggtgaatgttggtagatggtggcgcaaagattgcttgttctaacattaggccgtaactgctagagttctcatagacttcggaaatctttaatgaaaaacgcttcttgggagaaattttctagccagaaagttattttaagttatatgaaacatctcctccttccttagcaactgtgaataaaacctgataggagaagatactcagagtagaactcgggtctccacacaggaacatatatacatgcacgtgtacacacacacaaatacacacatacatatataccttatatgtatacacacatatatatacacacaccatacccatacacttgtgtgcacacacacaacatccacacacaacatacatacatacaacatacatacaatatacacatgtgcgtgcacacacaacacacataacatacacacaaagtacatacaatacacacacaacactcacatacaacatgcacacacatgcacatacacatacaacacacacaacatatacacacaacatacacatacacatacaacacacacaacatatacacacaacatacacatatgtgcacgcatgcatacacacaacacacacaaaacacatacaacactcatacacgatacacacacacgcacatacacacaccaaacgtaaggaaggaaagagaaggggaacgggaactgaagtacaggataagaatggagggaggaaggagaagaggaggcagtgaggaaacttagcttccattcttccctgactttgtctagaggggatcaaattacccatggaattacagatttctgtgggatcatcactggaatgatgaagctagggatgagaagtgaggccacccaagagctgggcactgatatagctcccatccgttgaaaaaaacaaaacaaaactggatatattatctaaatatttacaattgcttgtgtgtaaacaatgagattatttaccatcccagtaggaattgctgcttcagatttttactgtaattgagtcatcttaggtctcttttaatgttgaggctaacagcagaattgggaccaaagaggaagtcttcatcagtcagagagaattaattacaagcaattgtggatgggctttgtttacaagttaccatgactaagtaatcagtcaatctctctcctgtatttagaagccctctgatgttgtcaaccctttggatctgcgtgtggacatcagtttggaaaacccaggcactagccctgccctcgaagcctattctgaaactgtcaaagtcttcagtgtgagtggggcttgcccttcccaaacagaggttggccaacagcttccatagtcagtatgatgggaaagatgttaaggatgcagcctgaatgtaaggatacacacaggtcactggcatatcaattctacaagcagagatggcttcctctccactctgcttctgggcccaagagcggtgccaagtatccaagggagttcaaaaaatgcatcttgaagaaataaataataaaacaggccaaattgcttgtactcaccatccacttgagaaaaaaatatcagatacctgtgaagttgttcatctctctctactatgcctagtttaatttaggtctccgtaaacaaactattaccttgaattttgtatttttttcagtaatttttctttaggattatgtaaccatgtacaagctcctaaaactttgttcagctccccatagctttggcctttatgtaaatggaataatagtagtgtatataatctctctgttttgaacctaagcacacccaagaggatgacgcatttttccttggttgtatagatccctttctataaggagtgtggcagcgatggaatttgcatctctgacctgatcctggatgtccaacagctgccagccattcagtatgtttgactttacatttccgtgtaaaatatagaaataaaaggcccatgacatctccccactcagaataaaaatttggatttctttaaagaagaagtattgtgaatgtagttaaaacattgcaaaactgaatttcagcttctgccactcccctaagagcaaagcaatgagaaatgctaactggctgggtttgcggagctcttgtccctgcagtgtagtcagaagcgacaaagaacgcaagccagcagcgtttgcttacttgcctcctcattattaagcaatcttcaagtaaatgcaaagaattttagaatcgacgacattttttttcaacagtggggtcgccttaacctcagtggctttatctttcttttcttgttttcacagaactcaatcctttattgtcagtaaccaaaacaagaggttaacattttcagtcatcctgaaaaacagaggggaaagtgcatacaacactgtggtcctggccgagttttctgagaacttgttttttgcttctttctccatgccggtatgtgaggacaaccctgcccctacacacacacacacacacacacatgctcatgccccaccccaccccccaagccagcacagcatttcttccctccttcctccctgacaatcactgtccctgatactcatccctctatttcctcaaagttgtctgggaaaaaaaaaaacaaacaaacaaacaaaaaaaaaaaactgcgatgacccggggcatgctcagagccaccacgtggcttccagttagttaagcctccagagaacgcagcctggctacgactagaatctagggcggctctgattccagtgagggtcactttttcctttaccccaggccttggcggcagcagctcatagcttttccagccatctgtgtgaggaggccgcctgtcccggtgctagacagacgcgatgcacttgctcagggccattgtgagtcctgcagcttagtcctagatttgcagatgctgctgcggactccgctgccaagatgacatgttcctgcaaagccattctatcaagctgacctgatcactaaaccaggaataagtttcaccaagagagccctagttcctctgctctcaacgcgtgaagagagaagagaaaaaaaagaaaaccaggaaaagctattttccaattagactgcttgattaaatgttataaaaaaagtttcttcctatcttaagttaatgtcaacttttatagatttagaaatccaaacttatactgaccccatgcttcaatggcctgatcacataacacctcttacattaaacacaaaatgaagtaaggaaactggcaaaatctgctagatatttataattcaaataccactgggcagtggaggcacacactttaatcccagcactcaggagagagaggcaggtggatctctgagttccagtccagcctagtctacagtgtgagttctgagacagccagggctacatagagaaacactgtctcagaaaaaaaaaaatatatatatatatatatgtatgtatatatatatatatatatatatatatatatatatatatatatatatatatatatgtatgtatgtatgtatatatacatatatatatatactacaaatgccaatgtgtatttctcttccttcatttgaaaatatgcttttcaaaaatattaaggagaaggtattactaaagataagccttctggttgttatattaaagatatttgtgctcctgaacgacaaaaggtgatctccttcttagtgtgcattttgccaatcctttggcttctcgagtacacctttagagttggcaatacaaatgcatgctaaccgtttggatactacaagatattcaagtctttgagaacaataaaatatttaaataaaaaacaatatcaccactaagatgtccttgtatacatttcagtgtgggtatgcacacacatacatacatatatacacacacatatatacacacatgcatacacataccacacacatatatacacacatatacacactgcacatatacataccacacatatacacaccacacatatatacacatatacacacaacatcatacacactacacacacatacacacaccacacacttaattgttatttctttggtcctgttcaggtcgatggaacagaagtaacatgtgaggttggttcatcgcagaaatctgttacctgtgatgtgggataccctgccttaaagagtgaacagcaggtacagtgtgcatgctccagtccatgctctccacatgtattgtattgagagcactgtccttcctggacaccatttaacagacaccacaaagcagctacatacctggacagggttccctcgctgaggttgctttgtttaaatggctagcaaaggtcgcatttcctacatgtaccttttcccacgtgcacatacaacacagaatgttcttttgtgtggctatgttggccaatatttgtcaaagtgctagaagtgatgttttcaggtcagcacaaaacttggcagttctgacaaacgtagctccacagtgcgtgtatctgagagaagctaagctctgttctcagatcaacaagctaaagccactcaacatcttaagacaatattaagaattccgcaagaatgggttgatcttgctagagaacattttcctggcatagagcatcgtggactgatggatttcaatgtcctgtgtaggtgacttttaccattaacttcgactttaatcttcaaaacctccagaaccaggcggccatcaatttccaagccttcaggtaagatgcaatggaatcataaactcctggttgggagctttttatgagatttctctttaagtgctgtctaatatttgtttcaatagtgagagccaagaaacaaacaaagcagacaattcggtcagtctcacgattcctctcctgtatgatgccgaacttcacttaacccggtaggtgaaggctgctacttgggtgggtagctttttacccctgacagcttgggtgggtagcttttttaccccttggtacataaatcattgagctcattaccacagacaatcctctgtttattcagtcttagattatgacattatttcccaccagtcaactagatgtcaaatatgcagataaactgatgccaagggacactttgacctttgaggtttattgactcagaatagcaccaggataacagaggaaaaatgtttttgccacatatgtcaacatatgttacgtaggtcaagctaccatgatgtgaatcaccatctcactgcaactttttctaatgtatatgtttatgattgtaacgtatgtcaacatccactaaaggtggtgagatgcctgagctgtatcaaaaaaaaacaataaaacaaacaaacaaaaaacaaaaatcaaacagcaataatatccccttgatccttagacaccgaatcatacccttggggctttgacaattgcctgtatttctcactgccctgatcattaaatgcatcctggatgtcgagccatatacctgttcttgggcacggaagtccccagcaccacatcttagacagagcacaaacaatataaaacagagtcacaggcggaataagctgatgtggaaactggcctaagtctcactccttaaatggaaaaccccagacatgactgatggtggatttcttccaaccaggaagaaatgggggattttccaaaggaaggcatccacgaggaaaggctttcttcccttttcttgtcttccaaacacaggtcaacaggaggacagtggttaaaatgtaactagtagacacaaattagcttgacttgttgcaaggagcaggtgtcttgggaaatgcatggtatacaaaaccaacaagggctacagacaaatcccatctgagttcactctgagaactaaggccacttcctcttggaaaccaaagacccctgaaaaagcacaatactgatttcccaataattctatgggtaactacattctttgactgggcctttccagcccagtccagggaagcatggagcatacagcttgtgtaataaatcacaaaacaaacctgaaaaggagtgtgtgctatcctgtctgaagctggagacacttgagcaaaggtaaaaacaacacattgtaccaagtgagtcacaaagacacaagtcgaaacaaaacacacccatgttgtctagccctgagccacacagtagctacagtttcaaaaaaataaaaagaaaaaagaaaagaaaggaagaaagaaaggaaagaaggaaagaaggaagggagggagggagggagtaagggagggagggagagagagagagagagagagagagagagagagagagagagagaagaaaaagaaaaagtctctttgctaaaacaaacaa

SEQ ID NO: 142 - DNA, 2178 bp, Mus musculus
aactcctccgtacagtttctggaaagtctagcctctgggagccctggatcgaggatactgtgtgcacccccagagcactttagattccccagcgcagacccaagatgggaccgggacaggcagggggcgcgctcctgctgcggctgctaatgctagttcaaggtattttgaattgtctggcgtataatgttggcctcccaggagcgaaaatattttccgggccttcaagtgaacagtttgggtattcagtacagcagcttacgaacccacaaggcaactggctactggttggttcaccgtggagtggcttccctgagaaccgaatgggagatgtgtacaagtgccctgtggacctacccactgccacctgtgaaaagctgaatctgcaaaattcagcaagcatctcaaatgttaccgagataaagaccaacatgagcctgggattgaccctcaccaggaatccggggaccggaggctttctaacctgtggtcctctctgggcacatcagtgtggaaatcagtattatgcaactgggatctgttctgatgttagtccagactttcagttcttgaccagcttttcacctgcagttcaggcttgcccttccctcgtggatgttgtagttgtatgtgatgaatcaaacagtatttatccttgggaagcagtaaagaactttttggtaaagtttgtgacaggcctggatataggacctaaaaagacacaggtggcgttaattcaatatgccaatgagccgagaattatatttaacttgaacgatttcgaaaccaaagaggatatggtccaggccacatctgagacgcgccaacatggtggggacctcacaaacaccttcagagctatcgaattcgcaagagactacgcttattcacagacttctggcgggcgcccgggtgctacaaaagtcatggtagttgtgaccgatggcgagtcccatgatgggtcgaagctgaaaactgtgatccagcaatgcaatgatgacgagatactgaggttcggcatagcagttcttgggtatttaaacagaaatgctcttgatactaaaaatttaatcaaagaaataaaagcaattgctagtactccaaccgagagatactttttcaatgtggccgacgaagcggctcttctggagaaggctggaactctaggggagcaaatattcagcattgaaggcactgttcaaggaggagacaacttccagatggaaatggcacaagttggattcagtgcagattacgctcctcaaaatgatattctgatgttaggtgcagtgggggcttttgactggagtggaactcttgtccaggagacatctcacaagcccgtgatctttcctaaacaagcctttgaccaggttctgcaggatagaaaccacagttcgtttttaggttactctgtggctgcaatttctactgaagacggtgtccattttgttgctggtgctcctcgagcaaattatactggccagatagtgttgtacagcgttaacaagcaaggcaatgtgaccgtgattcagtctcacagaggggaccagattggctcctattttggcagtgtgctgtgctcagttgatgtagataaagacaccattacagacgtgctcctggtaggtgctcctacatacatgaacgacctcaagaaagaagagggaaaagtctacctatttaccatcacaaagggcatcttgaatcagcaccagtttcttgaagggccagaaggcactggaaatgctcggtttggttcagcaattgcagccctgtcagacatcaacatggatggctttaatgatgtgattgtcggttcacctgtagagaatgagaactctggagctgtgtacatttacaatggtcaccagggtaccattcgcaccaagtactcccagaaaatccttgggtccaatggagcctttaggagacatctccagttctttggaaggtccctggatggctatggtgatttaaatggggattccatcactgatgtatccattggtgctttggggcaagtgattcaactctggtcacaaagcattgctgacgtggccatagaagctttgttcactccagacaaaatcactttgctcaacaaggatgctaagataaccctaaagctctgcttcagagcagagtttagacctgctgggcaaaacaatcaagtag

SEQ ID NO: 143 - protein, 695 aa, Mus musculus
  VARIANT (1)...(695): Xaa = Any Amino Acid
IPQRRPKMGPGQAGGALLLRLLMLVQGILNCLAYNVGLPGAKIFSGPSSEQFGYSVQQLTNPQGNWLLVGSPWSGFPENRMGDVYKCPVDLPTATCEKLNLQNSASISNVTEIKTNMSLGLTLTRNPGTGGFLTCGPLWAHQCGNQYYATGICSDVSPDFQFLTSFSPAVQACPSLVDVVVVCDESNSIYPWEAVKNFLVKFVTGLDIGPKKTQVIQYANEPRIIFNLNDFETKEDMVQATSETRQHGGDLTNTFRAIEFARDYAYSQTSGGRPGATKVMVVVTDGESHDGSKLKTVIQQCNDDEILRFGIAVLGYLNRNALDTKNLIKEIKAIASTPTERYFFNVADEAALLEKAGTLGEQIFSIEGTVQGGDNFQMEMAQVGFSADYAPQNDILMLGAVGAFDWSGTLVQETSHKPVIFPKQAFDQVLQDRNHSSFLGYSVAAISTEDGVHFVAGAPRANYTGQIVKVNKQGNVTVIQSHRGDQIGSYFGSVLCSVDVDKDTITDVLLVGAPTYMNDLKKEEGKVYLFTITKGILNQHQFLEGPEGTGNARFGSAIAALSDINMDGFNDVIVGSPVENENSGAVYIYNGHQGTIRTKYSQKILGSNGAFRRHLQFFGRSLDGYGDLNGDSITDVSIGALGQVIQLWSQSIADVAIEALFTPDKITLLNKDAKITLKLCFRAEFRPAGQNNQVX

SEQ ID NO: 144 - DNA, 125466 bp, Homo sapiens
taatgaacctgaatgtcactattccctcaacgagatatcataggatactttattagtgcaaaattcttttctgacaattctttggaaggtgctttttgcagagatttaagttaaatgtcaactctagagctcagatcttctctttctcagggaagtcctaaagcagggtagtctatgacttctccctcctctgaatttcagtggcaattacagtctgccccagtccttatggcataattgtattttatttatctgcatttacccatataatatctattataggcccatgtgaaggtaaaactgggctcatatgaacagtcacaaacatccttggatatatggacactctatgaactgcagtctccctgctcctggcccttagaaataacctcttccaattctttctgctctttgttgtagctcaccaacagaagccagaccaggcacttttcagtaatcaaagtagtcctttctttcagattctagatcattgctttgtctatcttcttaattaaggtaagttcatcattcatgaggctcctcaatccagagagcaagttgactcccagggaattctctcaccaattcagagtcagaggctgttactgcatgagtatgtctcactccacagctgaccatcagcttcctgaggagagggcgcattgcacttctggttctccctcactgtgctttccatgcagtatgttggccacaataggaactcaataaatacatgctgaatggaaggaaacaggacctacctagcatgaagaaagaaccatttcttaccgcacagggttcgaaagttggctgaaggcaaaaatgaaaatgaacaccagattttccagcacatgattgaattgcatttgatggtattgtcagggaggcttctttggactaatagaaataattaaggaagacagactgcttcagacaccctaggggctacttagctctccagtgaggcattttgcttttatgtttaaatattattttcactgattataaaaagaaacatccgttctcttttatcaccttctagtcaaggcagccaaatgtgcttagatagatggaaaatgccttttaagtaagtgattacctatgaagaattagtctctcttctttcctttcctagacattgtggcattaatattggcattttgtttctttaaattgcatcctaaggtcccgttccaccacagctccttcccagacggcattactgtagaccagactttttaccctgcttgtctccttttctaaagacttttattttctttttagtttgcacttttcaaactccagccataattattggggtataatttatacatagcaaaggttatccttttcaagtcaacagttcaatgagttttgaaaaattgatatagtcatgtaccaccaccacaatcaagatataaaatcttactatcacttctaaaagtttcctcatgccccttttgtcaacttcctctccccattcccagcctctgcaactgatctgatttctgttgctttagctttggctttttgagattgtcatatggatagagtcataaagtacatcaccttttgtatctgccttttttcatttagcattcatttgtgatcgtgattcatgcacgttgttgaatgtatcaattgttcattcctttttattactaagtagtattccatcctatggatatattttgtgattaatgtttattagtttgttttcttgtctgtaatatttgtatgtgtggtgagttggaagagattttgtttatatcatagttggatttttttcactttgtatttcctatcagacaatatggtctgctaggaagactcatgcctggtattgaacatatttacatgccttgcattgttcaggcagatatgtactcagttcctatatgctgtataaatgacctactgcatatgtgtgatgattcttcctgtagttttgaagagtgtgatcagggattttgtatctcaaattgtgcaatttaaagatgtgcagtttattatttagttataattatataattagttatacctcaatgcagctgttaaataaaaatatataaaatcactgttaaaatcttattcttaaaaggaaaattacacatgcagcaggggtttgtggtagggctggagctgagatgtagtgatatatgtaatgtggaagtaagtagttggagaaggcagagaatggcaaagaacagaaaccaaattgcagggaaatatggagggaaaattctgagccagattcagaaatggagccaaaggtcaggaggagatagtgtttctgagtctacagtggttcctctcatatgaatgctggtgacccagctattctggatatacacaggtaccctgccagtggggcgtgggggaatgactacaggtaaataagaatgtgtaacacattggggtatacaaaagacttctttggaatccctctaagaaaatgttagtctgagggaaagcagcagtctcctcattttcagacagactcaagagcagacctggcacaataacatccagtgtcatcacaagttgttgaaatggacagggatctattccaattttgtgatggataagtacatgggccgccaaataacaggccaacagcagctaggactgatctctaagcacagctagaaataactcaggggttgaggaacttagttcatttgtgttgctacaacaaaataccacaggctgggaatttataaagaacagaaatgtactctctcactgttcgggaggctgggaagttcaagatctagtcaccgatatctggtgagggtcttcttgctggagcctcacatgacaaaagatgcaaggacaaaaaggagtcaaccttcctctgtcaagtccttaatccattcatgagagtggagcccgcacctcaacacctccccaaagacttcacttcccaacactgttatattggggattaagtttccaacacatggatttggggggacacattcagacaatagctgggccctatatatacaagtggaacagtgagaggaggacatctgggcatttgcatggataggacctcatttgtactgagaggctggtgaggctgataattttcagtttacaaatgagtaaaagtcactacctctaggtctatgggccacaactctaagaagaaaatgggcctctatgtataggttacaactacaagaagaaaataaactgcattaccatgatataccatgtgaaagtttatggttttaggggcttttaaaatgttagttcctctcaagttcaagccttagaatgtcttcatttatctacacatacagagttttttgatggtgcaagccatcttccatataactgtacttttataaaggttcctgatgcatctaaagaaaatgtgcctaggctgggcatggtggctcacacctattcccagcacttcgggaagccgaggcaggcagatcatctgaagtcaggagttcgagaacagactggccaacatggcaaaaccccatgtctaataaaaatacaaaaattagtcaggtgtggtggtgtgtgcctgtagtcccagctacttgggaggaggctgaggcaggagaatcacttgaacccaggaggcggaggttgcagagagctgagatcatgccactgcactccagtttgggcaacagagtaagactccgtctcaaaaaaaaaaaaaaggtgcctaaacgttctctcattccactgagtagcataaaccagactgaacttccatttgttctgctcatatccaagcatattatttcagctagaacaagactctgaagacagtatctggtaatgagatttcaagcccattgagcatagccactgagggtagtcatgactaattctcaacactgtgcttggctcaatactttgcacattgtagatgctaaataaatatgtggtaagtgagtgaatgttacaaaaccgaagagattgcaagattctcaacttaatccaaatgacggataatgttagatataataagaatctgtgagaaaaaagagatagaaagtctggagaagaattatgcagagaactcagattctcaacttaatccaagtgaaggataatgttagaaataataagaatctgtgagaaaaagggatagaaattctggagaagaattatgcagagagcttagagacaaatattaggagaccatgaaataggccaccatttgtgagccaggaatactagctgttgctttctcatactgcacagtaggaaatgtgaaagcagaaaatatttagattgtgattaaaactgagaatcctggaaaaactgaagttcaaaatctttctgggctctcccagcttcactgattccattcttttgatgggcaagcaaagttcactagtctgccagtcaaatagatgctaatggtaaaattggctctgtttgactttttgatgttacacatttgaaatgtgtttccatctaaaaggacaggctccaatctaaatggtaccaacaaaattacttcaaacaaaataggagttcatgtcactcaagatgcactaaaagttaaattgcaaaatggctgaaaaggagaggtcttggcttcagaaaagaataataactacctaaagaacaaaagttcgtgttcttggcaggaaattttaaaaaaagaaaaatcatctggtgtggtcatacagtgtatcaaactgaagaagaccctttctttactgagttaaaattaagtctatagaatcctaactggagacaagccatggaaaactaaaggcacttgcaagttgaagttacagggcaatggaaatgatgagtaattaaggaggaagtcagcctacagagaagacaatagagcaggtacacacagagaagcaaagccaacaagtcatgaattccctaaaagttgcagagagttaattaggttcttatcttcccagtctccactttaagtacccaagggctataattcctgtctttgggttctcagaaagttcttcatatccttgcaattaactattctttgacttgggctagtttaaatatgatttatttttcacccctgaaaaataactgccctctaactggaacatgcaagttttccagacagagtagagtagcagatagccataagcagccttaatccttcatatgacacatttctttaaaaaagtctaaagtatggatgaacaatgtttccccttcattgaacttttccatgtcctaagagataaaattctttttttttcgggttcatcttaacaaatcaagacattagtgactagttgaagaagtatgtttattcatttggggaacaaacattcattgagcatcaactctgtgtcaggctctattttaggaactgtgagtgaaagaagttaatgagacatgttaacttggaagtccttaagatttcccagaagagagacagatatgtcttaaacgtagtctagtacaaggactagaaacctgctcaaattagcttcagagaaaaagagaaactattattaggttggtccaaaaataattgtgggttttgccactaaaagtaatagaatgatacacagatatttcatggatgtaaacccaggaagaacagtcagatctcacacaatggcaaacaaaattaaaagacctagaacaatctctctccgtgtctctctctttctctgtctgtctgtctcatgcatgcacacctcagtttcttggtctctcatatctgtctctgtttttgataaacagtgcagattggctttttctacactcattgaagaaaatgaatgggctgggcataattccaacactttgggaaggtggggcaggaggattgcttgaggccaagagttccagaccagccttggcaacacagtgagaccccgtctctataaaaagaaaaattaaaaaattagacaggtgtggtggtgcatgcctgcccagctactcgggaggctgaggtagcaggatcacttgagcccaggagtttgaggctgaaacgaactatgaataccactgcactctagcctaggcagcacaaagccccatctcaaaaaaaaaaaaaaaaaaaaaaaggcgggggggaaaaaagaaagaaaatggttgtacaaagtgaacacaaatttccatttcatgtgatcagcaaagattctagaatctgtataccatgaatgtaaatccctaggagattgatcgagcttggtcaggtgtttggcttagcgacaaggaggcaggattatgtgactcagtgacttctagaaggggatcatggaagactctgagaaagccctattggcagagctggcaaatagctttgcatgtctgccacaagcatgaaaacaagtaaggccagtcaaccgtagttgtgctagaatcgaaatatgaatatgattcatcagtgtattgatgggtccaggaagctaggaaatctagaattattttatttgttttgtttgtgtttaagttaggagtgtctcttttattttggccattatgcaccccagccagtgcttagagacttgtgtgtgagtcaagctcaatggattctaagctttactcactcatcccatggattcactgagtaacatttgagaagccactggttacttcacttcaaaattactaggacttacctagaagttcatatttaccacccttttcaggtctagggagaagaatgtggaattgttaggaaactcatttcaatgtattataataactattaatatttattagaaatttatttactaggtataggactagactcttataacaaaaatgtataagatttcagagacccagcatttaaatgagaaggtagaatatacacatataactcaataatatattactctgtaatacatacaaaagaaagtttatttgggggaaaaaacaaaaacaaaaaaaaaagctagaggaaaccagagccaagaaagaagaatgattagttctcagtgaagaaaatgggaaaggctgggctaataatataaaatttgactggagccttgaagtagaatttgaaacaatggaagaaaaaaagaaagctattctaagtagaaaaataaggaattgacaatgaagaatgggaaaggcaggccagtgaactggtgaatttggcctaaacatagtgtgcaagagggaaagatagccacggagcccacagaggtgagttggagccaaatcgtgaccttaaaccctagggtactttgaatgtcctgaagacatctaatgattttcagcagatcagtcctgcatttttggataactgtgacaacaggtataaaagatgaactggaacaggagagaaggaagcacagagagattatatgggagtttgtcaccatggtgaaagatcaaaagggtttgaaccaaagagagattagcagtggaacagaaaataggagatggcacagaaaaccctagtagggtgtaaagacagaattggaatgggatgttagcagggggctggtggtgcacctggggaagaaagcagaggtttctggtttgggtgattgtctatatgaaaacgggataaacaaaggagggcagggcatgacgatacaacagatcagaaggaaacactggggaaacttatctgagccgtgttccccaacaaaactctgtcttgagctaaggaaaagaaaaagaggggaaggcctcacttcacccctgagtgctttttggagtagggtctctgggtctctcaagatcctttcaagtggccagtgaagtcaaaactattttcataacaatactgagacattactgcgtttttcactgtgttgacatttgccctcatggtgcaagaacaaggatggggactggtggtcattgtattcttcatcactgggcactcacaggaagagaaagggagagggacacggagaggccagcagatcaatgaattttaatgccacggaataggaaaaaccattgatatggtttcagattccacattgcaactttaagaaactacctcttgttgagttttggtgtagtatcaggggattatccagaattatctcctgtttttctaagtccatatctgtgtaacaccagattaatcaatataatttcaccaaaactacatgccgtaacagattggatgcagaagaagatctgagaatccaaatgtctgtttttaagccagatatttaaaatattagcaaaaatgtaaagcaatgccactcttctcccggattctttcatttggagaaatatagttatttttcataaaatgtacattatttatgttcacacataataggatttttgttaaaggacttactgagtaaagggctcttgagaccaaagagtttgagaagccccagcttaaccttccatatttcctgctctgaatgtggtgtccctcacaactgcaactaggcaggagagcaccctggaaggggttctcaaactactttgtctcaggaacactttatcctcttaaaattaatgtgaggcaggagtttgttctttgtttctaaaagttttgcctggctctggaaaatcgtagctcctgacttattctgcacttcatgacagtgtaatgttaatttgtccagttctgagaacaaaaaccaagaaggatgcatgttatttccccccacccccagagataaaacacaaattcctgtctcacattaaaggaagtgtcctgcctcccaaacacaggtctgttccaaacacttactcacatttcagtgagtcagaaggaaacagacagatattcatctccctgaaacctggctgacttccttcaaaaagtctgtaaggagcgtcaaaatcgtgtcaccggttagtgagcagccacctaagagctctcaggtgatagccggagttttagtaagcaggtgagtaccccagacaattcagaaaaaaatgccttcaggtgtttgtcaaggtgagtaagtgcagccagtaagtgactgataagaaaacaggaaagagcctgggactatataatttgggttcaaagggtattagtcataagccatcagcagcaacatctgatgcataccaatttaatactttaacaatgtgacacatcagccctatctatagtaaagagaagagcttgatttttatgaattattaagtccttcccaccttgagccactttgcttcctagaggcagtatctcaggcatcccattcagctcatagtagcattccatgaagatctggaatgatgacaataatgatgattattagactcataactccttaagcttgatttatgaaaacagttggttccttcacaaaagtagtcactggaagaattctggtttcagcaatgtgctggaaatttgtggccaaacttttggataaaacataagattcagacaagaaaaattaatatcctatttcttaggtttttaactaaaaatctcggatatagaatgttctctttccagatgtgagactgaaataatggaagaaaatggtcacagtctatgtcacggtgtaatgtagacagggagagtcacaagtgcatgtatgggctctcagccttttctctggccttgaagttaatctcctaaactcagtcattaaatcagctcttaattatctcggaggagaggaagtaatgatgatttctctctctctgtctctctgtcacacacacacacacacacacagctcttgcagcaggtattgcttaaatatcaccttggataatcataacttgtgagcagatcttctttcctgatgagttagtttctaacctggtcattctgcgcttatttttgtccctttctccacccacttaggaaaaacagagaaagggacgcaccgcgcagcccctaggcactgtggtttagggctagtgccctcggcacccgctgccaggagccgggcgctgccaagggctgcggaggggccacgttctcccggggactggggcatctcctgcgtgctggcgacaggctgcgggggcggagtggtgccagggcgggcgctcgcccgtcggatatgcccacccgtcccgtccagggcaggaaagcctgccagggcgccatccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggtaagcggggatttcgctctgcatcggctgcaggagggacccgcgcggcttcctggggctcgctggagggattgggcggaactagggagcgagctccgtgtgttccctcggattccacgtggactcgggctcccagccaccaggacctgcttggaaagagatacttcttcgttcccttcctgctatcccaggccttgcgtccccattaggcgcgtctcgccctgtctgttaagcaccctccaaagtcatctcagtgagtgctttgttttaggtacacacacgcacgcacacacacacacacacacacacacacacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctgatggcggcctgcagctccccagcgcggtccttgctggctttgcagaagcctgcgagccccaaaatgcttatttttcaacccaaggatgtgaataatgcctctatttcttacttgaggacgaagcgctgtgtttcttcccggggggacttggaataaaccaagcgccacttaaatacttggcagaggggaattcttccttcctttctgccttcctcttattgttgtaacattgtctattcgacgaatgtaaacttaggctaggaaaagttcttttcacttctggatcctagatgccgcaatgagagaataagccggagcagccgctctaactgtagtgctgtggcagtggggcccgcccacctcctgagttcttttacactaagaggaggaaataaggctggggtggagagcttttgtgggaccatcgcctgagtactttttccctgaccattaggcagagctagagtgtggtcaaatttaagaattttagtttatttggagggagaaggagacacgtttgtataatgtagtttgaacagcgatcaaaacaaaacaaaaaagttgtctctgattttaaagtgtgtgtgtggttttttttttttttttacaaagaagataaatatttcctaagctgtcctcctttgagactgacattcagccacttgctattctttattgtggaggaatgaatcctagtccacgtcaacctggtggcattttctccaggtcagagataagagagaaatagcaccactgtccccagcccgagcagagaatgggcatcttaggttttctgtctcacctgtattgggtgcttcagatactttctccgggaaccagatgagttgttttgaggggccaccaaccctaatctacggatttcaggtaaagttgtacttgacattgaaaatgagtctctggaatacaactagagctaatagaaatataaacccaagcttttcatctctctgtaattacccagtattaaaataagctgtggaaacataacatcattttcttatctttgaaatgttgaggcttgttatgtaaagagcagtgagaaattctttaatggaatgtaacgctgcaaggcatgaagtcaggaacagagacttaacctggagttaataaggacacctcagggcaagcaagcagagatgatcgaaaataacatctgcaaaagttttgtgcatttattccctcctcctactccagccatttgtatactcaaggaacaggttttctcttaatttaagatcctcataagaaagctctctcatttgtgatatcacttgaggttcctggagaagcagcatcgttttttggtaccatgagtatcccaggttaacatgaataagtgaaatctctagctcagtagtatctaaaattttgtatggcattaccctatctgtataaaatttctcattcactatcattacacacacacacacacataactgttataaaattatagtatgtacaattgcatcatatcacatacaaaaattcaaatttaaaagctatgtatgtgacagagcttcattatgatgatcttaaattaagagaaaacctgttccttgagtatacaatatgccgtgttatgtatatacaattgtatatacatatatatacctgttaatatgtataaaacacatgtgtgtttagacatcttgtatcatctctagcatacatgcaaaccactttaaaaacatatcaccttcaaatcttattttaacacttacattcaaatttgctttccagaaaccttttcacaggtgcttaagaagaaaatgtactcatagtttagtcctatgtttatcacctttcagtgctcatttctaagtgcttaataccatgaaaatggtaaatgggcagtctgaggatgaaaaagagagaacataagaggcctagataatctataaactaaatataggccattagcagaaggcaaatgtaattttgaaatgaaggccatcacgtattttctccagtatgttcacaggtcaaggatagtccttccacccaggttctagaccacatcttttcttactatccctgaaaccctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcctcttcattctgcagattgtctctgggcccattccctgcgcaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaaacatgaaagccaggaatttgtccccatgttttcaacctcacagccactctccaaattctcttggctctcctcccatccatgcaactcctgccacccagtcagtccctcatcttatgtctgtatgtaacttttaaactggattttcttttcttatctctccaacccattctcttcattttcactaatgatatctttctaagacacttatatgtttccaattactgctttgtttcaaatgttagtggctccccatctcaggtagggtaaagtgccaatttcttggcatgtcataaaaaggtacattctacctatccaatcttttctttactgtatgctttcctgaacacaaatacacattcacacacacacaccacacacatgcccacacatgtacacactctaaagccatctatatacaccattctttgttatgactacacctgatcataccatatttagtgtgaaaatattttccaaatactccctttgccttcattgcattgttgctttcaccccttttcactcatctctttgcaactgaccattatccaatgctagaagggtcaatcccaagcaaaattataaagtagagaacttttacttttgcaacaaaaaggaaagcttgaggtaacctacctttgctgggtcccaccctaaaccacctctctggtctcatcctcagccccttaatgggacttaggccgccctctgataaagtaactttgctcccctatggcttagcagttatacctgcccaacctcagctaagctttgctctcttaatactaggtcctgagccactgtttgacttaaatttatggactggggtttaggattcagtatttacaatggctcatatatttctgatgtatggtctggtttggaagtgattgcttaaatatcatcactgcctccccactttcctaagattaaaattccagtgttacctaccccttaccaccttgtgggatgatcaccaagacaggtagatttcaacatcaagagttagcggctgtgagcggctgtgtcagttaaattccttccgaagtggatgatgactactccctgtcttcatgtgctgacagccctggagatattaaaaggtagaagcttgttaatgtaaagagatgagcttctcatgatgtaattttagacattcagcaaaataaagacacatgttcagtcaatgtgtataaagtcaagaatttcaggaagaatggggaaaatatttggggccaaaagtgtccaggcatcacataaattctaccactaaagccataagtcttgactaccaacactgctcagcttgggatattagtaaaagatttagcacagcataaaacaagagaaaccatgaaagatcaccgctctgattggcaagtgaaagaaatggaaggtgggtggagttctttttttccagttgttcagtgaccaatcatttaccagcagaacatacagaagagtggctccctacaggggagaatcctagcactgcaaatcatgagacaatagactctgtgtatgacagtgattcctatgccccttcaggtgatccatagaggctttattgatctggctacagtgaatttcataaaactaatacttgataatattcttataaggtatctactttatgtaaggctgtgtgttaggctcaaggtggaatcagagaaaacttaaaacatggctgagagaggttggagtttatttggaaaaaaatccaaacatggggaaaggaaattgtctcagccctgaagcatacttaaccaatttcagccccttgtcatcttcctttctagcagaagtccatttattgagttaccatcctcttctgcatagctaaaaaattgaggtgatgctgaagggtgattaggctggtcccaggcatctgggctgtgtctgatttagccatgggcatgtaatgcaaggttgaccaatgagatctgctgggtgacttatgggaaaagaattttcattcctaagagagatatttgttaaagaaaatattgtcaagtttatatgtgaaatttggaacaactacagccatcttgcaactgcgatgtcaactagcttaaggataaagctagtatattggagttagccttatggaaagaaatggactttgatgttgtctttgaacttctgaattattggaatttaagactatagtatgtcttggtgtctttaaaattttcatataatttaaaacttggttatatcattttctataacttagagagctgtaacatcagtttccatagcataatagatgtcatgtgttcacaattaatgagtggtacagataacatgttgaattcagaggatggagagatatcattgtgatacattgaagtgtctagcctcctgagatgtcttcatggaaacaggtaagaatcattacaatttagatctgccatgaagaacctcagagatcctggagtacagtttctaccttttaaaatggatgtaagtgatactagaaaagcaagcaacataactagcaataggactcgtctcctagttcctggggcagatgtttaggttcttgaatagaatactgacgcaatgaaaacagaaggtccttatgcccacaatgtggtattcaagttgttcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggttttagttttagtttaggagaccagttgtgagatgatggtggtaaaaactcagatagtggcagtagggaaagagactggaggatttattggaaaggcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagatttaggagtcattggcacctagagaataactgaagataggacattaacaagatgagtcaggcaaagggactagaagagggctttggccatggctcaaggaactgctttagagggtcaggtgaggaagaggaaatgtgaagggagagagtaggaacagctggagaagtagaaagacaactgcaagaactggggtagcacagaactatttggagaaggaagaggtagtgaatagggtcaacttcttcaaagaagtcaagcaagttgatagtcttgaagggcagtctacatggagtgaaaaaagagaaatcagaacagagcggccagaggagtaatggaagatgaggaaatgtagagagtgtgagaaagtttggtatgatagtaaaagggaggagagagtagcaagagaggtaaaatgggagcagctgcctttaagcaaacatgggaaaggcttgcataaaaattattataaggagattttttatttctgttacttatggtgctgcatggtacacttgtaatgttttaaaattgcattgaggtatatgtatgtggcagagattcattgcacaagagaaactgagggaaggggaggagctttgatgactatacaaaggatattatcagagagaaaggagaggaagagagttaggtgtccagcactagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggaaaaaggtacctcccatcctccagagtggctgcttagattgatgagcccatgtatacattttggtttcaaacatcttttcacactaatgcagttatgattaataagctgtttttagggcatgtaatatataacactccaattccagtggcagaattaatatcagtgcgttagtcagatttcctaaaaaccaaacaagttcttttagaaatatagatttatgtttctccagttaagccttcaattccccttatttctatctagtttaataaagatccccaaaataatcttgttagaaataacagtctcatatatcacagagaaatagtgttgtctctgaaagattttgctagtaaaatgtgaaagctgtttgccctgtaacttagtgttgttttcaaagcatttcaaaacattttcattgaatcataaattagaaaagaagttgatgtctattcttaattttgttagtcataattaaagtgcttatattcaagtgttttatccagtctatgcctgctaactcttgaacacgtaatttacattttagaaccagtataaacttgaactgcatatttggctaatgttttcagctccatagactgttgggacagttaatgattttcaaatatattttacttcctttgagagacttgtctgttctgttgcccaaataggtaacagaaactttgcaattctgtcagcaaagattcctgcattattatcttgttctgaaaaggtgactgaaattcttccatttattaaagtgtctagagacagtttttgctacagaagccatatataactcctgaccactgaaaggctttctgtataaaaatgaagttaatgtttaaacagagcaatggaaataaaagagtgttcaaaaaatggaaataaaacacagcaatggaaataaaagaatcactgtattgtcagtgcaagagattacttcattgtgttttgaaaggcgagcaaagctattgcaccgatggacgccttgaacattggcagttgtcattctcccggattcatttgaaggtggcctttgtttgtctttgtgcaggcctgatctcatttccatggataccatgtagaaatgcagactgaacacaagctggcttcgggtcagttcagtcagacaactctattccaaattgtttaccagttgccttcgagtcctttagccaacagcttcttagatgcttgttagaatagagaccccaaaccatcctggatttcataacctcttctaaaccatattctgaatgctggtgcataaaaatagatatttcaaaataattgacttagtgttctatggtggaggaggggaaggaaaaacttagccttggaaattggggcacttttatgtaatctttattattttttcagtataaaaatttaataaatagccctaatgagaaaatctaatgccacattgaaaaatgattaaaaatttatggaagtagtcatggtaattaagaaatgcctttattattacacagtatttaatttttgcccctcaaataatctgcctttaatatattagtgtcattttattattttttttgctatggttcaagtgagctatcaccttaactctttttaaaagtgaagtcccagaccgagtgcagtggctcatgcctataatcccagcactttgggaggctgaggtcaggagttcaagaccagcttggccaacatggtgaaaccctgtctctactaaaaatacaaaaaaattagccaggtgtggtggcaggttcctgtaatcccagctactcgagaggctgaggcaggagaattgcttgaacctgggaggcggaggttgcagtgagccaagattggtgccactgcacttcagcctaggtgacagagccagacgctgtctcaaaaaagaaacccaaaaaacaaacaaacaaaaaaggcagagtcccatgagctcctgccttttttcatgtcctctctctctttctggaatactctttagccccagcctccattctgtgcatcgtttaaatcttaatttcactgaggttcatgcaccctaggaaccctgccaatcttctaattcaatttaggtatcactcctcacttggacccttccatagcaatgttacattctatttcaataaccctttcagaacttggctatagttcttactgactgcaagctgagaagacaggcccatatcatcttcacttgtatcaagggttcttggcaccattttattcaatgagtgatgaatctatgagccatgtatgacagctactgtaaggggattaaagacacactttctgaatgaaggccaagctgaaaaatttctacttctttccaattagtatatgcaaaaataattctatttgtaagtgtatctgaatttgctaaaatattcctttagttgataaatttgttttcacttctttgacagagtttgtttgcttttaaaatgtttttcctttctcataacatgtctaactaggatagctctgttgacaagtaacaagatgaatgaaagtattaggacagtacagatatcattttttccccaaacccttttctgttccccttttctgttctcataaagcaacaccataatttatcttcagcttgactctctctcccaccgaatacattctttaagattaccttctgtcctatttatcattgtatttcaggagcctggctcatagtaagcactcagaaaatgatgtattaaaaaagaaaaaaaatcaaaattcaaatacagtaaattttaaaacttttatttattgtaaaatgtaacatacatgtagacaaatgcataaaaggtaaatgtacagctttttagggcttgggtttcattttactctacttagaattagtaattttgtttgttactatttcacggatgctgccacaagacatgaaacttctgggtaagagacaaaggtctttattactcattgcacagcaagtaacttgatcagcatatctgtgttgataccctttgcccaccaagacacagaggggcaacacagagggcccagatagatgcctaaacatgcagtaagttgcattacagaaaaggaacactgagcatggtgaatctgctgttttgtagcaagtcagaaagcctgttctttgtcccacagggagatgttacctcattcttcaaagatgctcactgcaaagacatccctgagaaatgctatggtaaacagtcatcagggtcttgcatctcaggcatactcagcagatatgtaggtgtgttagatctccatggaagcatgtctcccaacacagcttaacacataattttttaaaatgttgtgtaagcacaactcagataaaaaaataaaaataaaagatttccaggatcccagaagtcccctatatgttcttttccaatcacaaatccatttctctagtcttatttttttggcaataatttccttgctttcatttatactcctactagttaaatataccatctacactcaagggtttaattttgctagattttaagtatacacacacacaattatacaatacatattattttgtttttgaattttttaacattgcaattgtgagattaatctatatgttgcacatagatatagttcttttgttttcaccactgtacagtaaatagtatagtatttttatcacacagttcttcatcaccagattgctaagagattttttaaagtgacaattgagtattaattttataaatatttttctgcatctattggttattacataaatttttcttctttattaatgtggaaaattacattgattgatattaaaatatgatgaaaacctggtatttgtggtataaacccaagttgatccacatgttctttttataggttgctggattttgtttagaatttttgtattcatgttcatgagtgtgattatcctataattctttatgtttcttactctctctactgtattgtccctccatatgtctgcctacacttcattctggttagtttcttttatcctatattactgtttactaatttttgtttcaacagtgtgtattctggagttaaaacattcattgagttcttaatgatggttattatatttctcagtttatgagtttctatttggttcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgacaaaattgtttgaggcttgggtgatatttttctacataaagcattttcttttttttctttttctttttgtttttttttttttttttttttcttgatgaagtccagctctgttgtccaggctggagtgcagtgatgcaatcttggctcactgcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttatggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgattcaactccccagcactttggaaagccaaggcagaaggattgtttgaggccaggaatttgaacctagactggtcaatatagcgagactctgtttctacaaaagaaaaatttaaaaaattagccaggaatcgtgctgcatgcctgtagtcccagctacgccggaggatgaggcaagaggatcatttgagcctaagaggtcaaggctgtagcaaacctggatgacagaacaaggccctttctaaaaaaaaaaaaaaaaaaaaaagtgatccaactgtctgcctgagtcatttctctgaacttctttcttcaccccatcttcttagcaatttgatgctttagaagacatcttaaatatcttgttttatatttcttgcaatttttcagtgatcttcagtgggagagttggttaaaataacaaagtcttttattgccaaaggagaaaatctggagtagtgttttagagtccccttttaaaaaaatattgatttttaattttccaaattctcctcatactatttattgatgtggcattttaactgatagaaaattagattttttcaaaatagattaaaacaatattcaatattggttagtattctaaaattttaattttatagtataaaacatttttgaccaataaattcaactcactttttaatatatatctgtatatttgcttgtattaattactcccttttctttaactgtgaagtaaatgtgtccattgaaatactaaacttgattaataattttatcttgtggattttctttataaagttgaatatttaaatatctttagagaaaaatgacacatactaaaataattaacagaaaaaatatttatatttcttttgatatttacatgtgattatatgaatataatcttttcatagatatactcactatatgcaaatgaatactgcacttttatcacttaatatattttgtatatacttttccatgtgagttttatatttataactttaatgcatcctgccatgccatggttaactattgtcccattgttggatatttaggttgtttcctgtgggatattttgccccccactgtaaataatgtggctataaacatcattgtacaagaagttttttcttttcgttttacttttggatcatttccaaaaggggcattactatgtcaaagagtgtgtgtgttttttagctcttgttgcatatggaacagtgtagccatctgtaatgtggaatttaccaatttcatcagcattagattttcatttacttcttgaagtttgatggatataaagtggtgctccatatttatttccattctttttattcatgagggtgcattttttcaagttacgatttaaaaatgcctatcttttgaaaaaaaatatttttagattagggtattctagaaatttgagctagaagaaacctcaagatatcatctagttcagtgtcctgctttattcttatgataaccagccttgaagtgactaaagaccatgactccaacctgaacagaacactccagccagtatagtgtccatcattttaagctacccattggggctccctctcaaaatctctttgacaaactgccctttgtcttttattccccacaggctgattacaatccattttcacttgaggcatggcaatcttctagttaaaatttccacacttccatgggtcagaaccctttaagggagagggaagacattctctctgccagagcacttgactgtgagtaactgaatctgtagactgttctggttaccccttgacatgtaaccagtcaccccaaaatttagtgatatgaaaccacaacctcacttattatctctcatggtgtcttgggtcagggctttgagaatggcttggctggaccatctcactcgaagtctctcacatactgttagagggaggcagctctccctcttcctgtggtatcctcaagcctctccacatggtgccctctgagtaagttgacttcttgcatggtgggtagggcaccaaaggcaaccatcccaaaagaaactggcagaatggatgggcttttataaccttggctcagaaatcacataactgcatctattcatcaaagcaatcacaaagtctcacctagattcagggggaggagacttaagattccacctatggatggggagtgtcaaaagatttccagacatatttttaaacaaagtagtaacttaataaacttaatggtcctcgaccattcattgttttctttttctttttcttttttagagacagagtctcacgacgtttgcccaggctggtcttgaactcctcagctcaagcgatctgccctcctcagcctcccgaagtgctgggattacaaacttttgagagaccatgcgaggccccatttgttgtttagaccagtgtttgggcatggatattattgacaattggggccagataattttttttgaagtagtaaggtaggctgggggtgtctggtctgtgcattgtaggatattgatcatcagccctgtcctccacccactagatgttaatagcaatacactactccagctgccctagagtgacaaccaaaaatatgcccagacattactaaatgtcctctgagggataaaattacatccagttgagcaccactgcactaaatgaacatatattaagcacatttaatgttcatggcaacataaaagagaactccaactctggagagtaagttaaatcccatcatttttctgagtaactttagataagccataggcaaacaattccctaccttgttgggtcattgggaagatcgaaggggattataagtgaaaaagtatttttcatattgtaaaagcatatggaacattatttaaaaaaaaatcagtacacttggtatgcatccatttttatcatcattcatttatttaagggaccttcttaagggacttttatggagtgcctattgtatacccacagagtgtcaggcctggggcactggaggattgaggcagccagcccccttccagaagctcttctttccatttctagcatcacctggacaggagaatagtagcacctagatccttagtgactgtaaagtttgacacttaaagcaaggactttctaagaaaattgcatctttctttttttaataaaagtaaggggaaatgttatgccactgcattccaaaagcagttgtaagggtccttttgtgcttttggtttttgctctaatgttttgtttaaggactagagccataaaccaaacattgcagaacttaaatctttacacagtgtgtggtcatttccaaaaggcctacaacttctaagtttagttgctttgttttttttttttttttttttttttttttggagggggaggagaggactttctacttgcattactgtcctttcaacatgaagacaatgctattggaaaatgagatttcctgtggtgatgtatgtgttcaaaagatctaatgtgacctatgatcatttcccgttgccatacacattctgagtaatgatgagatacactttagagtttgaagtctatttgcttaggttcagagtcagggtctgagtaaccccacttcctgtttgtgtgacttcctggagggtccatggaaggataatattttcttggcttttgtggtgtgcttctcgtgtgtgtcagcaaaatgcagcaacgtgtcatcctcctaaccattagacagcaattttcagaaatgtgaatataaatttgctcaggatatactttttatgttagagatgaaagtgggggccaggtgggcagatcactggaggtgaggagtttgagaccagcctggccaatgtggtgaaaccccatctgtactaaaaatacaaaaattagccaagcattgtagcaggtgcctgtaatcccagctaacaggaggctgaggtaggagaattgctggaacccgggaggtggaggttgcaatgagccaagattgcaccactgcactccagcctgggcaacagagcgagactctgtgtcaaaaaaaaaaaaaaagatgaaagtgggataataaattgctatgccttattaaatttctcaagaagtgtgcccccctcagtagtgtataatgatactaatcgtaaaaacaaaaaaaatctactaagtacttaccatttgttagacactgggttgagagttttatatgcattgtctgaccacaatgaggtaaacatatacatgatatctattttacagatgggaaaggaatggcttatacaaaacaaggaacttgctcaaggtcacagtactattcaaacctcagaggccaagctcttaggcactgcgatatactactggctttgctcagtaaatggacctttcagcttaaaaaatgctgtacatcacaaactaacacagaaacagaaaaccaaacacagcatgttctcactcgtaagtggaagctgaacaatgacaagacatggaccccgggaggggaacaacacacactggggcctgtcggtgggggcgaggggagagagagcatcaggataagtagctaatgcatgctgggcttaatacctaggtgatggattgataggtgcagcaaaccaccatggcacacgtttacctatggaacacaaacctgcacattctgcacatgtatcccagaacttaaaataaaaagttacagttgtgaaattttttaaaaatggtgtacatctcttaatggtattagcatacttctgccatgccatcaccccgtaatatagtcagtcttctttttagggttctcctatagctagattcttgaaaaagttaaatgttctgtcaaattctaaatagaaaatacaatgtgtttatttgcatgaacatatgtgtatataggtatgtatattttaaattaatctgtcttttaattcattgatgtatatacctgcacagtagcctgcattcaagaggatttattagttaattaaactgttctttattaatctcctattatatccgtaacttattgttaggtggaaaggtgaagcaatcagtgtttattcagtaattattattgaaccacgaccatgtgcaaggtattattctaagtgctggggaatatatcagtgaacaaaatagacacagcccctctctgttagggtcaaaggcatatttattataaaacaagtgaagccgaagtttcaggggccctccctgtgcacttcccttcctctgttttcacagtgccagatattttcattcaacatgcaaaaggttaaggtcaccgtctcttttctatcctaacacaacatatttcaacaacaaaaacataaaaaaaaattcattaatcaacttcatcaattcagaggttctggattaatcactataaaacaaagcatgaggtgccttgaaatgctgtagctcctatgcagacttagaaaacagtcctaaacatgtgcatggcatcacaaacagggaggtgtgaaagtgaaaggagcttttcctaactacgaataatgataattttaaaaattcaatgtagcatgctagaagaaaaaatgaattctcttgttctctttagagaataggacttaataaaattgctgtcatgtgaagaggtgatatagagcagagccccaaactaggaaaaaacgagttgcataagtgtgtcaggcaatcagttggatttccaggaagtacactacagtaagagctgccaatagtgagcatcaaagaagttggaagaaaggtatgcacaggctaggatggtcagaaaagaccctaaccaaaatttatagagaagtggcttgtgaacagggtataataaaagaaatactaacttcagttatgtctgttttttccatatattgcctcaagatatgtgagacatatcctgctaatgagcaagttaggtgacaggcactgacttgctaaatacacacaaaatatgctattttgagagagagaaacggggagagagagagaaaaaaaaaagagaaagtttatcctttcacatagaagcaatttaggaagaagtggagaagtagaaagtgacttcatgagatggtatttctagtaactcttgggccaacacactttcttctgtatttcactgtcttcctctcagccactgagagacggcaagtctaccagatggtggcttaccctccagcaatcttatgaaaaagagagaatctattgagttgttaagaagcactaagtcataataaatggacattagaggcaattgcaatgggcttttggagatgttcctggcctgaagattgaatttttgaaatgtgaaagggcctccaaatgatctaaacacatgccacagtactccaggacttgatgcagttacaaaacaaaatgaaaacaactttggattgttttcacacaaaatataaaccttaaatgatacaactggaattattgtatatctgtccttatatttatatctgtgcataaatgtatggacagaattatcttcaaaacctgaaatagtaaattggaattttctggtgtaatatactttctccttgtattagtcagctcgggttatcataacaaaatatcacagactaggtggcttaaacaagagagacatattttctcacagttctggaggttaaaagttcaagatcaaggctctctcaggttggtgttggtttctactgaggactctcatcccggcttatagatgggcactttctcaccatgtcctcacatcacctttccctatgtgggtactgagagagaaagatctctggtgtctcttcttcttgtagggacatcagtcatactagattagggcttcactcttaggacctcatttgaccttaaccacttcattaaaggctctgtctccaaatacaatcacattgagggttagggtttgaatacaggaattttgagagacacaattcagtttgtaacaccccctttggcttaatggtttaaggggtttatttctggtcatggaagtgacgctcatgtatttctttgatatgaacacaaagtaagtgtcaaacatatgatatatggacacactgtaaaaaacaaatagccgcaaatcatgaagcaggatattatcgccagatgtcagctagagtctctctctctgcctcttaaaattgagataagatttattcaaatccctattccattcttataagaaaatgcagtgccctctcaagatttccgtgaactcccaggagatgtgcattttcattgacttgggccctcacttcctgactgcagagtgtttattctccactctgccaggtctggtatttgattttgaccctaggtacagtcaatacattagcctgatactgtctcatggatgctacaagatgccatgacatgcatgagtcagagaaggactttattactcacagcacagcaggcagcacgagtatgagcatgtgtctatcagttcccctttccccactctagtctcatagtgttacatgaaggggcccagacagacacctgcacacagtggggtgcaagacaggaaagaaacaatgagcttggtggacctgctgctttatagcaagcagtcagcaagccttctctttgacctgggggaagagattatctcacccctcaatattattcatcataaacacaatgctaagaaatggcccaggtaaatagtagtcagggccttgcattcttgatatacccattgtattaagttgaatggtagtctcccccaaatatgtctctattctaatccccaacacctatgagtattaccttatctggaaagagggtttctgtagattgccttgaggagactgatggtaaaaacatgaaggctcaagctacttctggtgagggctcagaaggaaaccaggaatatgctgttggaaactgcagaaaatgtcctcattatacagcggcagaatatttgacctaattgggtcttattgttgttcagaaagcatacaacttttaagtgaggaacttggatatttagctgagcaaattttcaagcaaaatattcaaggtgtagcctgtttttacctgctagatatagtaaattgtgagaggaaagagataatttgaaggatcaccacttgatgatctggcaaattctcagcctatctagattgattatatattttatatatatatgctgagtgttatggactgaatgtttgtgtctctccaaaatgcatgtgttgaaatgcaatccccagtgtgatggcatttggagattgagtctttggaacataattaggtcatgtggatagagctgtcttcctgccttgtgaggatgcaacaagaagtcagcagcctgaaacttggaagaaggctctcaccagaacttgaccatgctgcacaatgattttagacttccatctccagaactgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgcattacctacataagaaacctgcaaatttttaaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccattatattttggaagcaaataacctattttctaggctcacaggcttagagatggagaggaattttgccccaggacagatcatgcctggcatctcactcacaccaaatttagatgatgagatttgggacttttgagctgacaatatttagatgagatttcgagctcagagttaattctgtaatgggttgagccatttggaaatgttgagataccttaaagaatgtattttgcatgtggcatgaatgtgaattttggggggccaggtgacagagtatagtgactcccaaaaagatatgtccatgtcttaatcactggaaccagtaattggaaaaggggtctttacagatgtggtggttaaggatcttgagatgaaaacatcctggattatctgggtgagagctaaatccaatgacaaatgtttttgtaagagtggggcagagggagatttgacacatgtaaaggggaggaggagatgtgaccacagacatagagattggagtgatgcagacacaagttaaggaatgctcacagccccaagaagatagaagaaacaagaaatggattcttctctggagcctgcagagggagcagagccctgccaacaccttgattttggacttctgaccttcagaactgtgagagaataaacttctgctgttttaaaccacaacgtttatggtaatttgttacagcagccagagaaaactaatgtatccattaagacatatagaggggccagagacccatagaggactgtctttcccagctgactaatcctgtagttgttcctttattttgcctaaaaggttgaattttcttccttaactttcccacaaaatcattcatacaatacctttgtgtgtgcaatgagcttttgccaaggtgtggtgagatcagaggcaagccaattacagcaatacaaacagactaaagtactgttaggcatccctgttgctgcaggtttccaacccaccgctatgttgctggtcatcctttctttccctcttgtcattgttcctgcctccctcaaagtcctattcagcttcctccttagtggccctgcctctttattactgatgccctgaaagttttatctgcacctcagtttatcaaggatttttctacacaaagatagtttctctctaaaatataagtataaaatattttccccattaaataataaatgattgcatcagagtaatagtgtttaaaaagaactttgagagattcattgtagtgatggtgaatatgtgagtgggggggagtgaggggagtggtaataaggaaggaaggtaggatgggaccaagaaaacccggactcagaaggatgttggaattagaaccagtcagagctagagaagcaaggtcctcaaggctgagaatatgttctcatgcatccagacatcaaagttacaaagtggaagaatttgccaacttaaaatgtaagtaatgagtgtatttgaaaacaaatttgtcatcactgattttagcaaaatctgtgtaaattaagtacaaagaaattgtcatggttataaaaaaaatccttgggagcagtaaagggttatttatatgtaaaatatcattatagtcttaggaagttgagcacagcctggctttcattctgcaccacagactagagtggagattccctcaggatgaggactgtattttaaatttcattgatgattaacactttctacagggtgggaaaatattctcctactgtacactcttgctgagaatttgtaaggtttgtggatgcatttggatttatttggataaaaaaggatgagtttgttcctaatacacatgagatagatttggttttctgttcctggcaccagatagcaacattatatccaaatggtggcttggattgactggaaagtttcaaataacattaaaaaaattaatttctatttttatttttggagaaggaagaaatgattctgtcttaagcatcagcatttattgctttctattatttttatttttaaacaataccattgttgggctacctttggtgggcatttaggttgactccatgtctttgctattgtgaacagcactgcaatgaacataggcatgcatgtgtctttatggtaaaacaatttatagtcctttgggtgtatacctaataatgggattgctgggtcaaatgataattgtgttttaagttctttgagaagtcaccaaactgctttccacaatggtagaactaatttacgttcccaccagcagtttataagtgatcccttttctctacaacctcaccagcatgttatttttttactttttattaatagccttgctgactggtatgagatgatatctcactgtggctttgacttgtatttctctaaagatcaatggtgtggagcattttttcatatacttgttggccacatgtatttcttcttttgaaagcattggttaatttcctttgcccactttttaatggggttgtttggttttttgctggtaaatttgcttaagttccataccgattctggacatttaatctttttcagatgcatagttttcgaatattctctcccactccataggttgtctgtttactctgttgatagtttattttgctgtacagaagctttttagtttaattaggtctcacttgtcaattttgttttgttataactgcttttggcatctttatcatgaaatccttgccagagccaatgttcggaatggtatttccttgattattttccaggttttatactttcaggttttgcatttaagtccttaaatctatcttgagttgatttttgtgtatggtgtaaggaaggggtccattatcaatcttctgcctgtgactagccagttatcccaacaccatttagtaaatgggcagtcctttccctatttctttctttttttttttttgtcaactttgtcgaagatcagatggttgtcagtgtaaaactttatttctggggctctctattctgtgccattcatctatgtgtccatttttgtaccagtaccatgttgttttcattactgtagccttgtagtatagtttgaagttggataatatgatgcctctaactttgttctctttgcttagattgtttttgctatttaggctctttttgattccatatgaattagaattagttttttctaattctgtgaagaatgtcattaatagtttgataggaatagcattgaatctataaattggattgggaagtatggccattttaacaatattgattcttcctagccacaagcatgaaatgtttttccatttgtttgtatcatctaggatttatttcagaagtgttttatcagtctctgtagagatctttcacttccctggttatctgtactcctaggtattttattctttttgtggcttttgtgaatgggattattttcttgttttggccctcagcttggacgttattggtgtataggaatgctactgatttttgtatgtcaatcttgtatcctgaaactttgttgaagttgcttatcaaatctaggagctttgagcagagactatggcattttctaggtatagaatcatatcatctgcaaacaaatagtttgacttcctctttttctatttggatgcctttatttctttctcttgtttgattgctttggctgtgactaccagtaatatgataaataggactggtgagggtcagcatcctcgtcttgttctggttctctaagggaatgcttcccacttttgcccattcagtatgatgttggctgtgggtttgtcatagatggttcttattactttgaggtatgtttcttcagtgcctaatttgttgagggtatttaacttgaaaggatgttgaattttatcgaaaggtttttctgcatctattcagatgatcatgtggtttttgtttttagttctgtttatgtgatgaatcacatttattgattggcatttgttgcaccaacttgcatccgagggataaaacctacttgatcatggtggattagctttttgatgtgctgctggatttggcttactggtactttattgaggaattttgcatctatgttcatcagggatgttggcctgaagttttcttttttattgtgtctctaccaggatttggtattagaataatgctggcttcatagaatgagttaggaaggagtccctcctcctcaattttttggaataattttagtaggaatggtaccagctcttctttatacatctggtaaaattcagctatgaattcgtctggtcctgggctttttctggttggtaagctttttattactcattcaatttcaaaatgcattattggtttatccagtttcagtttctttgtggttcaatattcagaggttgtatgtttccaggaatttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatgttgctttctgctagctttggagttggtttgttcttgttgttctagctcccattggtgtgatattaggttgttaatttgagatctttctaactttttcatgtgtatgtttagcactatcaactttcctcttaacattgcttttgctgtgtcccagagattctcatgttgtatctttgctttcattagtttcaaagaatttcttgacttctgccttaatttcgttgtttacccaaaagtcattcaggagcaggatgtttactttagatgcaattatttggttttgagcaatcttctcagtattgatttctatttttattgtgctgtggtccaagactgtggttggtatgattttttttttaatttgctgagaattgttttatggctgattgtgtggtcagtgttagagtatgtaccttgtgcagatgagaagaatgtgtattctattgttttggtgtagaaagttcttagatgtctattaggtccatttgatcaagtgtcaatcaggtcctaaatatctttgttagttttctgcctcaatgatctgtctaatactgtcagtggggtgttgaagttgcccattattattgtgtggttatctaagtctttgtaggtctctaaggacttgttttatgaatctgggtgcccctattttgggtgcatacgtatttagggtagttaggtcttctgttgaattgaactctttacatgatataatgcccttctttgtcctttctgattgttgttggtttaaagtcaattttgtctgaaattagaatagcagcctctgcttttttcacttctcgtttgcttgatagatttttctccaactctttgcctttgagcctatgggtgtcatcacatgtgagaaggttctcttgaagacagcatacactcgggtcttgcttctttctccaacttgccactctgtgccttttaattagggcattcaggccatttatactcaaggttaacattgatttgtgcggatttgatcctatcatcaagttagctgattgttatacagacttgattgtgtagttgctttatagtgtcaatggtctatgtacttaagtgtgtttttgtggtagctgctaacagtctttcctttccatatctagcacccccttaaggacctcctgtaagggagaggtctggtggtaactaattcccttagcatttgcttatctgaaaagatcttatttctccttcacttatgaagcttaatttggctggaaatgaaattcttggttggaattgcttttgcttaagaattctgaatataggcctcaaatctcttctggcttgtagtatttctgcttataaggttcgttgttagcctgatggggttccctttataggtgacctagcccttctttctggctgcctttaacatttgttctctattttcgactttggagaatccgatgactatgtgttttggggatgatcatcttgtctggtatcctgcaggggttctctgcatttcccgaatttaaatgttggcgtctgcaatgaggttggggaaattttcacggatgatatcctcaaatatgttttccaagttgctttctttctttccctttctttcagggataccaatgaatcataaatttggtctctttacataatcccatatttcttggaggttttgttcattcttttttattcttttttctttatttttgactgagttaatttggagaactggtctttgagctctgacattttttcatcagcttggtctattctgctgttaatacttgtgattgtattatgaaattcttgaagtgagtatttcagctgtatcagatgaatatttctttcttgaaatagtcattttgtctttcagctcctgtattattttgttgtattcctgagattccttggattgggttttgactttttctcctgaaccttgatgatcttcatttctattcatattgtgaattctagttctgtcatttcagccacttcagcctgggtaagaaccattgctggggaactagtgctgttgtttggaagtaaggagacattctggctttatgagttgtcagagttcatgggctgtttctttgtcatccgtgtgggctgatattccttcagtctttgaaattgctactttttggatgggttgttttttgcttttatcttctttgatgcacttggaggatgtgattgtggtgtttagtgaactggcattgtctctgtaagattatagggagcaaaggctcagccctgcactcctaggcttcatactctaactctgaggaactggcattgggcccccccgctttgttctctggtctttcaaggttaggcatctgctgcactggaggggccaaagtgttcatgctctatattgtccacaacactccgatgggggaatgccagccaaagctctttgttggggtggtggcagcaggatccatcgtcacttttatgtgacagcagctgtggcagcatggccgtgtgcccatgtgtcagctggggtggggctccagaaggagcagggtggcagcaacctgctggcggtgcatggtagcagtacagcaggggcagggcaccagtggggatgaggttgccagtattcctgtgtgcattcatgccagcatagcaggctgcccacacatcagctgggggtatggtaggatgagcatgcactggcaggggaggagagacaaggtcttctggcatgtgtgggccagcaaagcagtgttggggggatgtggaggggtgtgaggcatgggtaagcgcatgctggcaaaatgctggggagaggctgcggttggggaggctgtggctgggggaggctgcaggtaaaccattatgcatcggtaggggctgttctgctggagccctctgatggccaggcatggtctgtcagtgcaggagctctgatgaggtgccctaggaagcactctggttgggcatctgaagctgctctgcaagaggccatggtcaggctggagctccaggaaaggccagcagacaggagatgctcagataggactggccccatcccacgggcaagactgccctgctctgtccgggtccaacagtcaccctaaggctaaagtctcctataggagcacggcaggccttgagggatgggcgttcttggccatattctgctgttgttaaatcctctgggctccccactggctggagtctgcctttgccacctctctaagcagctgtctttgtgtcagctcaggtgtccgtgggggtcgtgagttccgctgctaggatgctggaggtccatggcaggagcaggccactcctcacctgttcaactgaccccagaagttgctggggaccaggaaggattcctggtgctgggcagcctcgtgtagggctcctagctttctcccccttcagcccagcatccgtgtcctccctcatccactctcaatgccttccctgcaaagacctgttcagagtgtgtgccagccttcccaatgtcctggtttctcggtcggagaggtttcttcgggctgcctctagtcagccatcttggctcccgtcttggtatagtttttgagtaacacaaagaggattatagaaagcatataaaatatttgtagaaattacatttattcttgaagaggtcatgtctaaaattagtgaaatactctttaaaacattttgttttttaggctgggcacggtggctcacgcctgtaaattccagcactttgggaggccgaggcacgtgggtctcctgaggtcaggaattcgagaccagcttgaccaatatgatgaaaccctatctctactaaaaatacaaaaattagcagggcgtggtggtacacgcctgtaatcccagctactcaggaggctgagatatgagaattgcttgaacccgggaggcggaggttgcagtgagcggagatcgtgccattgctctccagcctgggtaacagagcgagactccagtctcaaaataaataaataaataaataaataaataaacgtcaaataaataaataaaacattttgttttttaaatgaaaataaagggtactttaaaaaaataattttaaaataagttgaattatttaaaaatgattcaatgatttattgaaccacaaaggataaaagaagtaattcatataaataagcaaactcattaattttttatcttgagcaaaatatataaattagttacccacggtcacctgtgacctaaaaatattaaatggaaaatttcaaaagtaaataagtcataagtttaaaattgtgtatcgttccgagtagtgtgacaaaatctcactccatcctgcccaggatgtgaatcgtccctttgtccagcaggctgtctgaggcccctgcccattagtcatgtaggagccatcttggttatcagatcaacagtcatggtattgcagggcttgtgtctgagtcacccttatttatttatttagagatggaatcttgctctgtggtccaggctgcagtgcagtggcatgatctcggctcactccaacttccacctcctgggttcaagcaattctcctgcctcaccctgccatgtagctgggagtacaggcatgtgccaccatgcccagctattttttgtatttttagtagagatgtggtttccccatcttggccaggctggtcttgaactccttacctcaggtgatctgtccacctcggcctcccaaagtactgggattacaggcgtgagccaccatgcctggccaagtcatccttattttacttcataatggccccaaagtgcaagagtagtaatgctggcatattattataattgttctgttttattattagttgttgtttttaatctcttgttgtgtctaattttataagttagatgttattataggtatgtatatatagaaaaaacagtatataccatatagggtttggtattacctattgttttaggcatctactggagggatgggaggatcttagaacacattccctgaggataagagagaattaatgtaattctcattcctgcactaagaacaatgtttaccacatcataaatactcaataagtttattgagtgaacaaaaaataaataggaaaataaaatctgtttattaactgtgtgtataaattcattagttttgtattatggacagttttgaatagagagagaaaaaacatagaatcatggagaaaatatcacaagttatcatacagatatgaacaagtttatacaagacttattacaaacatagagttccatggaattgaagtgttattatgtgaccatttgagttactgagatgaaagacatttataaccattgcacttttaagtctataggcataaatgtagggatcccattcttaggacatgcctagcaaatgaaagtaagagtcaaatgcaacccaatgggccagagtttcctttatatattgtaaattatatatttgtgcatgtgacaataagattacacactgcaaatgatgttgaaataaaatagctcatgcttatagtccttctagtccagggtaggagaagcaattttctttcttcattattttatcctgattcttatttttattttattttattattattattattttttttttggtgaggtggagtttcactctgtcacccaggctggagtgcagtggctcgatcttggctcactgcaacctccgccttccgggctcaagtgattaacctgcctcagcctcccgagtagctgggactacaggtatgtgccaccatgtccggctaattttttttttttttttttgtatttttagtagagacggggtttcactatgttggccaggctggtctcaaacttctgacctcaggtgatccacccaccttggcctcccaaagtggtgggattataggcatgagccaccgtgccggcctttttatcttgattcttatacactaaaggaaaatttaaaagcagctacattacactcacaattgtactgtttgttgtgttactattcacatatattttacctttttcttctattctgaatattatttttgttattttattttcgttaagcactgtcatcttcttcacaattgctgtttttttaatggcaggataaaactctgtctagtttatatgctaccatttgcatattcacgcccctaatcttggacattcagataattttaatggtggttattaagaactaatttttttagattgctagaaattattaaagctatttaatatgtataaagtgtgttttcttaggccacctaagactgagagatgacataaaatacaaaatttttattagcaaaatagaatttctgtggcccagccacctacttacacacacagagagcctaagtgcctaaacactgttttctcattcttccggagtagataacattctcccagactctagagcatggttctcctggaaacctttgctgcccctaattgtgtcccctgtgtcctgatcactattgcaccacggcccctgccctcggcatgctctagttgctcactatcctctgccctcttccctgtcaatccttctgcagctactgaggaccagtccctcaggcatgggagaaatgtgctccaccttcttaaagtaatgacactctgtgctcacagttagagataggccttacagttcttatgtttttgttcaatatttaatggagacattgttccccctagaagtgcagtatgcatcttcaggaatgggccaaattgcaatctgagaggctgtgtcaaaaccacacctctattcccaagtccacctcttgcttttggcctttgctctcttctcttaacctgaatttcttcctatgtatgtccctgggcacgttttgcaaatgagtcccttctatgaaaaacccatccctgcccctggcccttcagtatatatagatatgctcaaatttgcattgaccacaaaagttagacccttttattttgccaccctttactacaaaatgcatcctttagttctgacactgatatcatagacatcaataaacttcccttgccaaatttttgtggttgaatataaaatgacatgttttgttttatacattatttacgctcttgttgttaaaagactttttcctttctgagtttcactgcattttttttttttgggggacagggtcttactttgttgcccaggctgaagtacagtggcacaatcacagttcactgcagccttgaactcctgggctcaaatgatcctcctgtcttagacggccattgagattacacgtgtgagctgccatgctcaggctttgctacatttttagaacaaaagtaggttaactatatcaaatccccaatcatatgtttctcttttgaattataacttaaaattatgctccagaagaaagtaggagaataaatttcatatttactaaaattaattcttaaattattgtttccaaaaaaattatttcagagatggtcaggaatcctcaggaaaggagatcctgtaaatttttgtttgtttgatttagagacagagtctctgtcacccagtctgcagtgcagtggtgccatcatggctcactgcagcctggacctcctgaactcaagcaatactctcatctcagcctcccaagtagctggaactacaggcatgcaccaccatgcccacctaattgtctattttttgtagagatgaggtctcattgtgctgccaaggacggtcttgcactcctggattcaagctatcctcctgcctcagactctaagaaaaataagaaatctacatgagttaacttatgcttgactatctggtttacttatggatattaaaatggcaaccagcctgttataatctaggatgaaacagtatcccctttttattgtgaaaatagaggaaactagttagccctgcatgagataaaatgtatttggtgtaagctttcgtgagatttactggaatactttggcctggttactgtcaacacgtgtctgacaaggtcacctttgttaaatatgttgagtttgcgatgctattattgcctttccaggcattcacatgaggacaaagaaggaagatttatactctgggtgataataggctcctggcaaagcccaagtcagttgaagactcactgcatctaatagagaactggaaatgtatagattaatgaagcaacctatgactttctgtgccagacttttcaccattgccgtactcttctctttcacaccctatgcctacgtttaacatgatgttcccggtgcctgggatgaactttgccttcctctttatgtagtgaattccaacttgtcctccaagatccagattaattgccatctcctctgtgaaacctttgaacttagatttaccctcttctcaatactgagctcaaggttctttttaccactctttattttaacacttatacattttgatgccattttttttagtaaaattaccataatggaaatgcaaagagaacagggagattttagttttatttatttgcagtatcctcaggaccttaaaaaacgcctggtacaaaggagctgtataaacatatgttgaatgatccattttttaagtatgtatagacacatgggcatggtttggaggaaggaaacaagatgaaccaaatatggttcttattatccatatgattcagttgaactatgaggacagacatcagaagatataggcactgggattgcaaagaagaaatacatgttgaattagacagaatacttccattaattttttatgagctatttagatatcatatgccaagtgtgaaatgatgacagagatctgaattgtaaatacatattaagagaaaaagtatagagaattgagattgtccagatttatcaaaagaggcaggatataaagggaaagatttaagtagctgaaaagagatttagtatcaatggaatgaagggatggtgataaagaaggtcatgctttgtgaggaaaaatgagcagatcatttatgaatagaaattctggacaataaagttgagagatgagccaaacctagactcagagtgggtgacattgcgcaagaaagacatttagccttcatgagtttcagtttccttatttgtaatttgttaataatagcttggttttgctgttccacaggattgttgtggcactcaaatgagtcaggatgattctgacataggcagacataagcattaagaaacagtaagatgcgagttggaataaacattataatttaaatagaggaaaaatactggaaggaaatacatctgaattaactgaacttacagtagaaagaaaagattatgaatgatttttcccttgagttttctctatattccaaatcattattgaagaacatatagtaattaaaatgcattttattaaaaaaaaatcctaggtgctgagaaagtaagagtgaataaaagaaacaaggtttgacttctcaaggagcttacattttagtaggcacagacaaaagaatatggctatataagataattttggataattgctctagtagtgatacagtgatgaagaagggtgctgctgctacacagagggccaagggagagcagagacctatttgagcaaagtcctacatgccgtattaggtgaggatgttataggcagtggaacaggcagctgcaaagcgcataagcagaatgagctgcatgtgttcaaaaaacagaaggaaagtgagtgtggctggaacacagggagggaggacgagagtggtcggaagtgaagtcagaaagatacaccagggctcaatcatgaaggacctttgaatttacagtgaggacattggattttattctcagttcaatggcaagacataagttaataatatatatctatgcatatatagtaacacatatatgcctatatatgtgaattgctgtataattgaactgctaaatgataaaatgaactccatcataatttcctgccattaaatgatctgcccaggtctaattaatgggggaaaatgaggtcgttttatgtacagtcacgtgtcctttccagaattaggtattttaaaagtgaaagcagtttggcatcatctctccacgctaatatgttagatgattgataacatattcaaatagcatttattgagctctccacaatggggtgaagataaatgttggttgaaaacaccaggtattttgcatgccaattctggatctctgcttaatttgctgttattttcttttgcatttttttattattcaaaaataaaaaggagcaatggagcatatgaaaaatagatgttaaggagaaaatttgcagatgttaagctttgcagattttgctatagagtatttcagaatgagtatttgtgtttctcttcatggcagcacattatttgtaagaaataaaaagctgaattccttgtgtggacaaatccctgatacagtgattttggcacttacagagggacgttaactacttaaagtccccgttgcttcatcattgacttcattatcattttggagcactctacagaatctgctccctgaaatgcagaggcgcaatggaagagcaagcctttttcttccggcctttcagtgcctaaaacaatagacatatgaaataccatgcacttgcaatgctgcctagaaagtaggacatttctttgtgaaagcacatgttaatggaactttgatgtcaattttaaagagtccattctgtcttcagtgtctgcgaaggtaaatattgatcttaagcaacatgaggcatattcccatctccagagagagcattaatatccacacaaccttctttctgtaggatgaagaactggcagcattaatgctgtcagtgtcatacagagaaacatgatttgccttattcctttccttcattccctttccatcagaaataagaattttcaaaaaaaataaaataaaatctatcaaggctttatatgccttggtctttgttctgttttttgaaatgattagcatttctcaatcattcagaaagaagcatcaaaaacaaaacacttttgacagttcccactggaataaaaaagatatgacaccaatccctacattttcatcctcaaaaatgataatgatcacttctgaaagaaaatgataacaattttcaaggagctgtgattttctatctcctttgatgtagtcatcaatgccttttcgacagatgtttcatatagagtccatgtcaagatgttcaaggtgattcagaataaatagatgatacccttcagcccttgcccttgggtggcttagagtcttgttgttttgggaaggacaaatataactcaaattacttaagaatacttagagataatttagttgttttaagtcttgtgttcaaattttgtcttcatcctttcctctttccagctgtgagatatacttgtcccctggaacctcaaaattctctgcaaaacaaagataatattagtaactatcttctagcatttccatgaagattagtaagataatgaattatgcatatatagtatttagcttggtgccgggcctccaaataagtacttaaaaagcagtagttattttttctgggtaaacgttgataagtaataattattaggtcaagcaagttttcttaaaaatggcctttgagaattatacgacacacttatattcatgaattgtaaatatgtgctatttcatatttttcttaataggcattttaaattgttgtttggcctacaatgttggtctcccagaagcaaaaatattttccggtccttcaagtgaacagtttggctatgcagtgcagcagtttataaatccaaaaggcaactggtaagaatattctcttctttattatttcagtaaaaatacaaaataaatttcatatttgacttcaattgctttttcaaattggtgcctgactgtactataaatgggtggccctcaaatatccttaaatgaacaatctttctttgagagttgacaactgcagactgatcattaatgggatggtataatggttcatttttaaaaacctggatagaaagttttctctaaatattcaaaagcaaatttataataccagttttgaccattaatacataggtaggtagattgatagaatgatagatttgtcttcatttctgatcatgtaaactgatattcattgaactttgtaaatcattacctagttattaatgctatctctggaccatttctaaatggtagaattgtttcctacatttttttctttagcaaggttttgtctacttgcttcattctaagttaggcttttgccctccttgtggtgaagggtcctcacaaatatcaatgcaaaatgtacaaaggtggctttctctagcatattaacaccttttgtttttgccccaaagtgctcccagtttttacatgctatgtgatggttacattttcaaaccatggcttttctacccaggtgaaaaacaaccacctcaatggagatggaaatctagttcccataatactaatgcaagtgaacccagagaaatgaggtaatttgaaagttgtatttgggaagaagcgctgtagctcctattctgccagagttcatgcccactggtggacacaggtcctgccatggggaccttatctccttgttgcagcaggaggctccaaccatccccactcaccctggaacttcagattctgaatctccactctctagagctcttttcagtgattaaatgggctgttgttggcttatcaaataagaaccgtaatgtatggccaagtgcagtggctcacgcttgtaatcccagcactttgggaggctgaggtgggaggatcacttgagcctaagagttagagaccacctgggcaacacagtgagacctcatctctattaaaaacctgaaaatcagctggatatggaggtgcatgcctgcagtcccagctactcaggaagccgagctgggaggttggcttgagcccaggagtttgaggctgcagtgacctatgttggcaccgctgcactccagcctgagtgactgagtaagatcctgtctcaaaaaaaaaagaggaaaaaaccgtaactgtaattcataagcctttttttctgtgtgaacttccatttgatactctaaacaattgaattcaaagaaaggttcaggatcacatgttggggcatgcctgtctatttgatgaggaaacaaaatgaaatcatcccctgagagggcagcatttctcagcaggcatcttggaggatgtaaatcgtgagctgggttttaagtagtgaggatgaagaggctggagatgagtgttaactaatgtgaggagacttagaaaacaatgcatgtagatacagtttgtcaattgtctagaaggataagaacatctggttggaaaccaaagattggcaattattgtaaccatttgggatacgagagagagttgcatgtctaacaattatcaaatgatgctttgataatcataaagtggtgaggaggctagaaagacaatatggtcggtatattttgaccttggaatctagcagatgaagtagctaatgacccacagttttaaatattcagccctaattttttccctcagactgctatattaaacaattcattcaacatctccactttaatgcccagtagacataccaaactgaactgggagaacacaagtatctgattttctgcacaagctaatgaggccaaaaatctttgacttgtcttctttctcctcccctatatcttatccatgagccagtcctgttaatcctatcaccaaaataccaattatacctggccgttcctcactgtctctcctgatgccaccctgatggaagccaacaccagctcttacaggcactgctgcagcagcttctccacctgccttcagcttcccttcctgccagctttattctgctgtctttgctctagccagtgtgaactgttaaaaacatggctcggccaggaacggtggctcatacctgtaattccagcactttgggaggccaaggcgggtggatcacttgaggccaggatttcaagaccagcctggtcaacatggcgaaaccccatctctactaaaaacacaaaaatcagccaggtgtggtggcgggcgcctgtaatcccagctactccagagtctgaggcaggagaatcgcttgaacctgggaggcagaggttgcagtgagccaagatcaagccactgcactctagcttgggtgacagagtgagactccatctcaaaaaacaaacaaaaaacacagctcattccctagattaaaattccttaaaggatgctctgcgattgggtgtcagcctctctcctattatcatcttttacaccttctcctctgctttctatgctccaagaactaagtcttttgtctgttccttgaacatgcctagctcattcctgttgcaaagcttttgcaaattattttctcctgcctggaagagtcttccctaagatcatcactcaaatggttttcatctttcagtctcagctcaaatgtttcttcctcatagacctttcagagcaaccctatctatatagcactcgactgctctctgagtcactccagccttacaggtggatttattttctaatgattagtactatcttaaatgatctatacttgtttatatgctcattatctgtctcctgccactgtctctgagttcagggacactgttttgttgactgctgcattctccacacccagagtgatatctggcactgagtaaaggatcaacaattatttgttaaatgactaaatggaagtcccaattctaaatgattcatcccaagtgctatacaaagtgagctatagtagactgacttaagatgtttgagctgaaagggagcttcagatgaactccactgttctagttcatagacatggcctagctgaggacatctggcaccgagtttgaagcaattcttttaagtaacagctttcctggacagagtaaatctaagagccaccatcagtaatagacattattgaaggtgataagcctttcaaggattgtaaggggctcaaccactggccatgctgctggttggaagttgaacaagacgaaaagggacacagagttgagaggatcccaccaggcagagttctgggaacatgagaggcagccatatctcctttctctgtccaggattacctctaagtatccaagacattgttgaaagacaagtatatttgtagtttatagtgagatcctagtgctggtaagaccagggacactggacatttctaaatcctgcctggaccttctcatgacatccctgaatgatgtataaacacaggacaataggtctgggaagcaaggcaccactctattattggctgggccagggctttgaactccagtatagagctttctggcaaggtgtagcactgagattaggctcaaggcctaaccaccagatgatacaagcataccccaccatgcaagaggaagagacagcacctgtctgacctgaagggctgaaccatatggaattcagaagcaggaaggacagagaacaaaagttggccaagcaagtctgtctgggtccttttgttgatctggtcttatgaagcaaagaaacaagagaggcaaaaccatgggcatgattttctaaactacatgaggtgcaaaaaatgcaaaacatagttgttggccttaaggagtgtaaaatagagtcagtgaggaagatttatatgcagaataggcaactttgaataatatagaagacatcagtcagtgtaaaccccttgcagttaatggtgtttgttttctttcagtgtcactagctataataacttaagagctcattttcttttcccaaggcctgggtcattagagagacaaggttttctcatgacctctgtcatttgcccagccctgccaaggtaccttgccacagagggcagggctgtggccaggatccaggtgaatgggttatcccattacagtgctagagtgggccatgttaggacaagcagtcttcacgactctcaggctcaaggaaaattatatgaaacttggaacccagaattgcctgtttgttttgacagtgggccctgtgcccttctctactcttaatttatgacagttgcataggcattatggaagtagcagatgtgggaaggactgtttaaacattgactttccttctgatactaatcaagttagttttggacacagaaattggtatgaccatgaattattcctttagcaaattgcgagttctttttccatggatttatcatgtaatacatgcacacacacacaactttgttttctttattcccttactgcttattctgaagctgtcattttggtatctttttcctctgcttactttgactttctttgtaatctttctatctaagtcctgacttcactcctttccctcagacaactcactgaaggctctagtctgagtattcttaaatcacactctgttatttttaaagtacaattttagctctgtcatgtgtgccatgttttctaagaatttatgggcatatttacatcaggatctaccagattttaacaaaataatcttaactcttttgctagtttcatttatgagactttcattgcactatgaacttcaactctagaaacagtggtgacatggctttgataattctggagcctttttaacagtctcaagtgagcgggataattttaaaacaagctgacctcccaagtagagtacctgggcagccctctggctgtaagtaaggctgtggtctgttctcttttcggtgtaggcggagggccatcccgcttcagagccctcacttcacacacaggatgttccaatgtggatgatgcaattcttatcacaaacaatctacaaaggattgagatatgtttaaaatcatttcctggagtttgtggtgatatgcactctttctgtttgtctaatctgaaggcctgttgcaagaacaatctgagctcattatgtgactcaaaaaccagagagaactgcaatctctctgtgtgatgaggactgactgggaattagggtatttccagttgtagaaatgtctttcattctaacaaggactagtgcattctttttccttaaagagagaggagaaatagaaagaacaagtgtcatagcaaaaaataaaaataaaaaaaatccacctatatatgagcttatagttttaactttttaattgagaaaaactttaataaagctctacatgtgttatgaatatagcattgtcatccacagatgtgcctataggagaactttaaataaaaaaaaaagtttaattctataacagacatcaaagattatgtcacgtgatactttgataataacaccacctggtatttattgagtactctttccttgccaaacatgtaatacccataattactctaggagctttgcaaaattattaccccctttacaaatgagaggagtgtgactcagaaatgttaagtaattaacctaagattacagagctgataattaataaagataggggaagctaatgcaaaatgagacaaaatgttccaaacgtacatatttttgtaagtatccaagaaggagagtgacaggatgtagttggcatttataaataatatttaaattttattttaacataaactttatgaagtaagagaaactttcagaatcttgaatgaaaaattctgttagagaatttccaatgttagcatcattggctttaccatcagctgtttcctgggcaaagatgatagttaccatccatcttttcatcctatcatagacaggaatttcttgtatgaatatactcaggagccggagcacaagggttttaccctcagcttccccaccactccctgggtgactttgggaaagtcacacaacttctctggagcagaaagtatgccatccttatcaaactggaatgttatgagcaccttgtgtgagaataaaagtaaagcacttcagggctgggctcggtggctcatgcctgtaattccagcactttgggaggccaaggcgggcggatcacttgaggtcaggagttcgagaccagtctggctaacatggtgaaaccccatctctaccaaaaccataaaaaattagcagggcgtggtggcaggcacctgtaatcccagctccttgggaggctgaggcaggagaatcacttgaacctgggaggcagatgttgcagtgagctgagatcataccactgcagtctagccttggcaacagagggagattccatctcaaaaaaaaaactgggtcctccctacctcttcctatcccctcaaccaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttaccattaggttgtcctggcagtgccatttaacatgccaacttcatttattcacagagtttgcttatatcttatttaattaaattaattaattaattaattaatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggatggagtgcagtagggcaatctcggctcactgcaagctccgcctcctgggttcatgccattctcctccctcagcctcccaagtagctgaaactacaagcgcccaccaccatgcctggctaattttttatatttttagtagacacgaggtttcaccgtgttggccaggctgatctcgaactcctggcctcaagtgatcccatctcagcctcccaaagtgctgggattacaggcgtgagccaccgagcctggccctccttttattttaaattcataacataaatattccttttcttcttccattcaattttattttttactcataacttagtccagtgtttgattctataaagacattagaaatccaactgtaatatattcttacacttttattttaactttaaatacttactgttaaaaattttataaatacttattatgctattgctgtacaattaagccatcctcagcactattaatacaggtatccaaagtggcatgtctcatctcaacaatgacaaccccccaagaggcggaggttgcagtgagccaagatcacgtcactgcactccagccggggcaacagtgagactccaactcaaaaaaaaaaaaaatctatagtaggaaggacactttaaatatctcctgatttgcttcttcgttccttcactctggatacaagtttgtgtgtgcacctacaaacacatgaatacatacacacccattgtttgtgacttgcacgtgggagagatatgttgctccagaatgtctgctgtgctttaatgatctataaaaatcctccatgcctcaccaacaagtcttataattttaagctttcctctgtggtaatgtgtgaatatctgtttctggaataaagttcatttacaaaggtgactgggacttacacacacaccttcctagtatctagttgtctaagacatttacatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaaaattatccccctctctccctccaatagccaagaacaggaatttgtatcatcacaaggctttagggttagtattttagcttttgattttaaattcaagaaaactgcatgtcggatgagaggaagtaacataattagtttttattgattatatttcttctagtgccaaagccaatttctggaatttttatgagacagaacagtaagcttaagatgttttagcaatagtgaagtcagtggactctttatcgtgaaacggaaagatgctgaggatctagccatcccgctaactgaggagacaatgtggaagcctaagaagtctgaggcagcataatgaggcctaaatactaaaattgcctttcaatatatgccaaagaatttaactattaaatttatgatagcagtatttccaaataaaacctaaaaaatgaaatgactctttttacctgtcttccttcttcccagagacgggcagccttcacgggtgaattctttccatcacaaattcattttatgtttaccagcagaaagcaggtaccatttagagctcaccaagcaccttgtgttgtccgtggcctggaactaaacaatataagaaacaatatttatatttatatactatagacttggaaaatttttacgtgcatgtagatacaataagtttctaatccaaagtaaaatatccccttggatggctcatagacctctcaaacttaaaatatctcacagtgaactcttgagctccccctatcgcaaaatcttgctctactgacagcatcccctttaatctgatggtagtgactagtttcttttagcttctcagccaaacacctttaggctgtctttgactcgtattcattcattcattcattcattcattcattcattgaaagaccaactcctcaagaagtcctgctgcccctaccatcacactctatctaaaacaagaccacctcttaccactttcccttctgccagccctgtatgagcactccatcatctgttgcctggatgattgcagttgtcttctaagtactttacatgactcacctgtgcttcaatacaatgattcccaacagtgtggccttcaaaattcttctacaatatgtcagatcacatcatgctgtactcaaaaccctccaatggcattctcatttccctcagctggaaagctgaggccttctattaatcattacgtacaagtcactacatgatctatcattaccagtaggactaccatctccttccactatccccctcactcattctgttccagccacagggcttttgcatttgctgttcccgcagcctagactattctgccactagagtcttaaggtttactctttaaccttcttcaagtttttacttaaatattaccttctcagtgaggccttccctgaccattccgatgaagattatactgctctccaccccacactcctaactccagcctgcttatttttctcccaaagcactgatcactaccactatatggtttacttacttattacatttactgtctattttctcccactagaatgtaagctcctcaggctagaaacttttttactgatttattcactagtatatcctcagtacctagaatgaggtctggtacataataggtctggccaccacgtatagactcacagattgtatactgcacaaggcctggacacaccattcaaggaatggtgtcccctggggttgtgtaccatttcagtccccaagagcccaataaacatttgttataaaattgaataaaacaaaatgttttgccctactattttaagtacatctctgtcagtaatctctggtaaaatctctagtattgaagaaaacacttggagaatttacagactcacagaccaaaggaagatatttataacagcccctagattgtgggtttaaaactgtcctacctacaccaccataaatactgcttgctaactaaacaaagtattttgaattccactggaggtaggcaaattggctgtgttttgaaagtctacataatcactattttcccacaagataattgaacagtaagtgttatttaaagtagtcttggaagaattcccagtttcactggaggaaaagaaaagtttatatcttgggattttgttttgttttgagaatcagcacacatgcctgttcatgcaactcttttgtctggttgggattaaattaaatccattacttcaaagaggtttcgccatacttcaacaggtatactcaccaacatatccaatttcccaccttggtaacagtttctcttggtgtgtctcttcctgcacgtaaaatttcatagagaaatataacagcctccctcatcttcctgtctgattaatttaagaatgccacaattttcttggaatagcctcttggtgatgtcctagcctcttcttatgagggtgagttgtcaggaactaggatttcaccgaggccttagggtgtgaatgaggaggagagtctgctggaaatgtttctaataaagaaggtaagcaaaggtcagtgacttctctgtagtcaccaacatgacctgtagcctacttattaatgtggttcacaatatttaagaaatgagtcatatatgatgaggaaacccttgttcttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgataaaaaaaaaaaaaaacagttaaattttagatcagacacacttctctgttgtttctcagcaagcctctctcgggctgtggtgaggatggttggaaatgtgcataatagaatcacctgaatttggtatttgcatttggtattgtctgaacataccctgttcctacctgtcattgggtttgtatttggtgttgtctgaacatgccttgttcctacctgccattgagaacagtgtagcctaggccccacagtatggatgtaccctcccaggacagctgtgcttcgtgtccagtctgcagccccttcatatatcacacagccacacaccccttcacataagtgtggcctgactccctgtgtctggtttctaatccatgctagttctagaacccacctcatctgctaagatcattttcccaatctgggccctctgccaggacttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacgttaggaggttgagaccagcctggcaaacatggcaaaatcccctactaaaaatacaaaaattagccaggtgtggtggcgcgggcctgtagtcttagctacttgggaggctgaggcaggagagtcgcttaaacccgggaggtggaggttgcagtgaaccaagatggtgccactgcactctagcctaggcaacagagtgagactccatctcaaaaaaaaaaaaaaaaaaaaaaaaagtaaggattttctgcttaacttttccttaatcaggaaactcttttttaaatgatagcatagaatcatccattcatttgcttgttcatttgctgttgttttttttaactcatttgttcaacaagtggttattcattgctacaggcacagaattcctagccctcatgtacctttcctctctagtgagggatttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccagggttagagaagaaagagtcagattctttcctttttacactttaagatatgtccagcatgcaaaaatcagagttaatgctgtgtaatactactatgaaatgaagacctgtacagatggagaaaatcaaggctctggaagacaattttcttggtaccgactctataagattcctaatttcttctgagctatcatgaatttgaaagacatcagatatgctcaaacacgcgttccaattctgcactggttccctcccttcattaaagtggctattgggacttactaacatccaacattcagatttctatctttttcaaaagccttaacctatctgcctggtattattgtaaacctaactatggtaatattttaaaaggtaaattatggtaaattattagctcataagaagaaaaaatctttcaactctaacgttaaggctgactgaattaaagtgtgctagagtgttctatcttagtttgagaataattttataagatgaacgaggagagaacttattaatgaactattaactttcaaaataatctgcattttcctttttccctaagtgttcatgctattctgtctgctaatacttcaggttaaaaccttcatcctttggtgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaataattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgctttttatgttcttaatgtagctggctactagaaaatttgaaattatatatgtggctaatattcgtagcttgcattatatttctattggacagcattgctttagagagactttctagggtgtgtggcaatgcagcagtgttacagacattgatcaaagctctttatcagctaagcagaaaggcagcaggtcaaatcatagctgaacaaatataaactgttcacattgaaatttaaatgtgtttttcactgtttgtgatcaggtttatctttaagaaactatacttaacactttgtgtctaataaaaaaaatgtgtttctaggttactggttggttcaccctggagtggctttcctgagaaccgaatgggagatgtgtataaatgtcctgttgacctatccactgccacatgtgaaaaactaaatttgcaaagtaagtttaaatttacttgcaaggcatgtgatttgtcttagactcaactgaaaaataacatcagaacaatcattgttctgtcttaaagaaatacagacagcttttttttgcccttatgtctttagtaatatggggcacaatcatatccaaatttccaaaacagtttggagacttgacttaacaagatgcgtggaaaatgtgctatctcctggaccatttacctatagaccatggactggtttccatcaacatttagaataattttgatgattacttgcagaatcaaggctatccttgaatccgaggctatccatatttctttctctcctctttgcaaaataaaccattaagtttggaaacatcagtacaagggctgagtttggaggcaccaaaaacactctgtgtttcttgttatgtctaaatgatggcattctaataaaacaaatccacaatttggaattatttgctgttttaattatccccatctcagatgcctcctattaatgccaaaaatttactaaaggttcaagggtagacagctaaatgagtgacatttccatgtaatatgctgatacaagtaaaaagtcactcaatttgatcatcattacatcatcagcagcagcagcctaaaaaaacagccctgaggaatcacggagttcctctgaagaattgaggcatgaattagaaaagagtgttgtgaaaatcaagggaaagaagagtttcaaaaatagtgattaagacttggaaacaagggaagtggtgtttcttgcatatctctgtagacctaatatctagaataatttatggcacataatagggctcaataaacatattttcagtgaagtagaaggaatatcagtagtgtcaaatgctacagaagttgaaggggatgaggactgagtaaatgtcttcagcttatttaagcaggttgtgggtgatctagatcagtgatctccaaattttttgaacactcagtatatatatatatatatttctaataacacaaatatatacatttggagtgagtgttcaaagctttattatatagtccaaaaattttagtatatcacccctaacatttcatatcacccttaacttctgaacactcattcttaatgtatatatttttattatttttaaagctatatacatgtactggcctatcttctcaataataccttcacataaaaataaattttaaagaataacaacatgcccatagaagttctattattttctgtcttcactctaacagatcatattttgtgtaacttactcacctagaggataaatccaccagtgttatggggagaaaatagataacaaagaatttaggagtgtgtcagtagtgaatgtacaaggagtgaaagttgacctccatttccagaagttcagcagtgaagggggagctgggaaaaacaattctatgggatagcagtgtgagaagatttttctagtaaacaagagatgatactttttgtagggaacatggaggcagcagtaaaaagggatgatttgtccaggatagagttaactgattaaaattaatgtcatttgtacctgagaaatagagtcttaaaaagagttcttccttctctaagacacaaaggaaggagagaaaaattaggagttctaagaatgatctttacacaatgattagagaaactgagattaccctggaagtctgattcatcttctctgcagtagtcgttattcactgagtgatgggatctgagttgaggttggaggcttgaaaagaaggggtgaacttggctgggcatggtgtctcacgcctgtaatcctagcactttgggaggccgaggtgggtagatagcctgagctcaggagttcaagaccaacctgggcaacatggtgaaaccccatctctactaaaatacaaaaaattatccaggtgtggtggtgtgcacctgtattcccagctacttgggaggctgaggcaggagaattgctagaacccgggaggcagaggttgcagtgagccaagatcgctccactgcactccagcctggatgacagagtgagactctgtctcaaaaaaaaaaaaaaaaaaaaaaaaaaaaaaaaagaaaggtgaacttttacaacagtcaccctgggaaataagggaaggaatccaattaagaataagtgacagaggcaatgatagcttggcagagatgagaaacatgactgaatgatggtattactaaagagaattgcaatgttcgataactcaagaatggatacagtggttgatgccctaggtcagtggaagacaggaggtggagagatttatttagtatattatatgactcgtctaatttccttttaacattcacccactattgctttgagccagattctatcatagggcattctttgataacacttcaaggatatttttactgacccagaaaaaaaaaaaggcattagatagagctactgtgactttcaaaagagaggcaaaaatgatgtcctcaaatgtgttttgttttgctagaatattgtaaaaaaaatcataattaaacatctataagtcataccctctccagagcccactccttactgtcttatgctctgcagcctcacacattaatgtgcgttaccagatcactgaaagcatcgcgtttccccacacttcattatataactcaagtacctatattgatgacactaaattcaatgctacatgcaaacatgggtgtgcctgttttcttttaatatctttaagtaaacgaggaatttttaatcacttttaaaaattgttttccctttgaaagcttcaacaagcattccaaatgttactgagatgaaaaccaacatgagcctcggcttgatcctcaccaggaacatgggaactggaggttttctcgtgagtgtttactttacaaatcattattcctctcaagaaagtacatagacagtagtgtcttctcaccatccctcccaatctgaggatttagatgtttagaacttgctttttgataaattatgctatttatttggctatccaatgttgaatattcaaaataatgttgatgtgtagactttttaggatattcagcaaaaccactgctactgaatgttttgaagaaaagggaacaaaaagaaccctgattctttgcccttggaaagtgtgctgagtatttgttgataacagcagaatcccaaatctcatttctacttcctgtaggatcattcaagatagtttcaaagctaaaaagtatttttggtttttaatcatttcctgtaattgttgagtaatctggtgttatctgaggcatggagcagtctctcatgtcagtgctcactttcatttagttacaaaaagagtaaaaagacatcactaatcagtgaaatagaatgccttatttaacaagtgcttttggaacaattaattgattaatatttacatatccaaatacactgtcaagtgaattgaaagttaatataaaaaaactagaaaaaaatggaaattttctgaaggatggaaaaatttctgagtttagagctaatagaaaaaataatataggaaattgttgaaaggatttgactatataaaaaaagggaaaaacatcacacaccaaaaaaaaagtttgaagacaaaaacacaatcttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatgtgcctcaaaatttttaatctataactccagataaagtaaaaaatgaaaggtaaaaagcaagagaatttgagagattaattagcagtccaggtagcaagcagagaggcagaaagagagagaggaggagaaagaaaaaaagaaaaaacccaaagtttcctttacatacttagaaggtcaaaatcataagatactcttaagaattatgtggaaaagactgacaatcatcacatttttttgaaacttcttaagttctgggcttaaagtaggaatgtagttctggcacttacaattggcatattttaatttcaacttcttaatgctgttttccattgcttttaaaacaaaaaaaaattttgaatacttcatgagttctttttcaaagtgattttaaaaaaagcttaggaatggggatatagaaaccaataattagtatctgttatttggtaaactaaccaaagacattaataatgactttcttctaattaattggcaaaataaatcagttttatagggagaaaactatgccttgttcattgcacatgaaatatggccaaagctgcttcccctttgacagttaaactgggtcaaataagttttcttttatttttccaattacttcttgcaagcccatactcttctgttcagttttataactgattcacaactttacataacgttaaattctgtaggcattttttaggatcttaattagatttctcttttgcacttgtctcctttttcatgtatcaattttaaagttatttaatctaatgtttcttgtgtcatttaatcatgatttaatcaggagtttttggcattcaaggactcctgaaaaggagagaattgggattgcattaatggagatattaaggattggagcaggtataatgtgagcaagaagacaagtgccattcagcgttagtgactgcagttaattgggaagtggccaaagttaaaaactggtagtcagtgaacctcatttgtgtttgcttagcatatggagtaattttgaactgaattttcacacaacatttgccctctcgactctcttttacaaattagggaatctggcaacacaacctatttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaactaatgttcagcaagaacaatgataatgatgctagctaacaatattatatggcatttgctatttacctggcattgttcttagtgttttgtatctatagacccatttaatctttacaacaatcttaaaagatagaatgtgtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccgaaggcattactgactcattggttttgagttgacaattattagtatcttagaaaagagtagagatgatttctgagctccataatggagaggtagaaggtttgcatttttcatgtgtttccattgattgttttctcatttctttgaagacatgtggtcctctgtgggcacagcaatgtgggaatcagtattacacaacgggtgtgtgttctgacatcagtcctgattttcagctctcagccagcttctcacctgcaactcagcgtaagttattaatgtgcagatggtctgagcaatgccttacagttaaaggagggggaaaaggttatcaactagtggcacccaaaccctccttaagtctcatttttatatggctgtgaaatatgacttacctgtggaaatctgcttctttcctcttttcctgtgtagcctgcccttccctcatagatgttgtggttgtgtgtgatgaatcaaatagtatttatccttgggatgcagtaaagaattttttggaaaaatttgtacaaggcctggatataggccccacaaagacacaggtatggctaacagaaatgcataactaacttatggctttctttctgaaaaaaatattgttagctatgaagtcttaatttttgtatttgccaaatccccattttaaatgcatttgatggtagtttttaaagttaattgaaacttttactacattgggttattctacctatggctttgcccagtgctggtcttttgaccttagagttctatttctgacacaagcattaaaggtatgggacataacttttttttttttttttaagaccaagtcttgctcttgtcacctaggctggagtgcaatggcacgatttaggctcactgcaacctctgcctcctgggttcaagcgattcttttgcctcagcctcccgagtggctggtattacaggctcctgccaccacacccagctaatttttgtatttttagtagaaacaggatttcaccatgttggccaggctggccttgaactcctgacctcaggtgatccacctgcctcagcctcccaaagtgctgggattacaggcatgagccaccatgcccggccaggatataacattttaatcttcctttagtttcctgtctttcccttctaacccatgagttacattttaaaattcaatatgtatttttatgtccatttggaccaataattaatttcttttgtttattccttgctggtaaaacaattattgaattctgaaatttgtataaataagtcactaagcatagttccagcatttatgataatattttatagttatttatcatattccagtttagcttgcccttttgcctacagaaaaggtcttttcaataattttatatagttctttatattttaagaagtctttaatttgcttttacatcttcttgaggtaggcacctaaagctcaatagtattattttaaagttcagtttctggttttggattttttttttcctttctgattgaatctgccatttcctgagccattctggttgtagcagtatactgaaccagtgtcaacccggaccagttcactgttaccagtgtatgctcatggattgcatcttatactctaatgtccaacatctaatacaaattgttgacatatttttccctaaatgctttccagctatctttattgaaatttgcttctctgctttcctgttcactattataacatgttgttatatgtttctcccattgaaattgcttttcagtaccaagagtatctcaatacccacagaagctttggaaatttccctgtgggcattttccaggacattccgctaaataaaactacatatagcactggtttccagaaagcaccactcttaaagccccttataagttttcatatgtatctccttatttcctctgtttctaaatgagttaccctcataatgtgactaattttatttaagtctcctatatagaattcacagtcttcctcttttgtgtcttcctaccacagtgcatctgattcctctctagaagtggtttaactcaatctcttttcttacagcctaaatttgaccttcctgtaagttctaacctaccacatttctttaaatcttttttcttctttttcacacagaagtcctggggctctgtcgtgggattactaccatcttcctctcgtattggactttgaaattctcagttattttttattctttcctccctctcaagtcttacatccctagagaaaggggtccaggaatattatatttctcactatcttcccagtgcctagctcactgctcccttggcaaaacacagcagatggaactcagaaatccagtcctcaccgcttccacctccttacatactgacctgtatttcagagagcctcttattgccattcagagatccctcactgccactcctgttctggaaagcccatctcctaggcttagaggatgatctcaatgcctgcaaacaaggacattaacagaagggtgtgaccttattgatctctaggattagggaatgctcccaaacatcttgttcagaaattctttcaaataagatgctctccagtggcattttctctgaaagccagaaactccctgccccatatgcacatatagcatcttctttccagtgttgttgaagcccataatagaggaaattcagcacaataaatagacctcaattgactacgctgattaggagcacattggtttttgttgtattcaattctaattatttattacacagttaccatcctttgatgagatgttactcttcatctgtgattgcttatagttgttcgcgagcttctgtccattggtaattagaaagtttatttatatcaagtttaatcttcctgttaaaaacagtgttctaatagtcatccatattaaaatattatatggcagtattaaaaactacaaatattactcttgggaatcaaatcatacactgtagcacatcatctttcttggcaatagtactgctgttgtacactgatggcctctaacagagaagaaatcattccattgaaagaaaagtaactatcaagaacaaagttggaagtgatgccttaaagctaccggcccatgtctaaatgtacttttgatttttattttattggttaagtagaaattatttttaatgtaatgacagcccattaataaatgtctcctctgttgaaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttgagaaggcagctgggaaagttaaatctttgattttaggatatttataagatatcacatgatatttaaatgaatttatgtgaagtaaatgaaatgagaagaccttagattaaaacagtaggaaatggggcaatctgtcataatttgttaatattcatcagagattcagacaaattgagctcatggatcacttggtgcaaattaacaaagaccacagaatcttaaacatacgagtttaagtttattatgcttattacaatcagtgggaaatgtgaaattataactatacaggactctcttgattcttatctcaatttctctattttctcagatccactgacctttcttttcactctattttttattttatttttattatactttaagttctgggatacatgtgcagaacgtgcaggttcattacatagtatacacatgccatggtgatttgctgcacccatcaacccatatctacattaggtacttctcctaatgctatccctctcctagtcccccaccccttgacaggccccagtgtgtgatgttcccctccctgtgtcctcattgttcaatgtgctctcattgttcagctcccacttatgagtgagaacatgcagtgtttggttttctgttcctatgtaagtttgctgagaatgatggtttccagctccatccatgtccctgcaaaccagataccttcacaaaaatgctaaacacactccggttgttaaacaaattaatgagaacaacaagcttgccttcccttaaacctattctctctctttgtcttgtgcattccttctttttaccaccataattctttttgaaaaaagcaactctattccctccctctacttccttgaaacttacagttctgccactagataagcatgaccctcttcatcccccaaccctgtggtcccaccttaaacctcatcctttctggctcctctgaacatttgataatgatgaacatacgctgctattcctaaccaagttgccatgacaccacaaacttctcgaactcctgccaaattcttttgcctcttcactagctccttttcctattttttcttcactaaacagagccctctcttctttactgctcttctcctgtagggattctatccactgtcatggcatcagcagcagcactgttgggttatctcattgctatgttgtcagccctacactctctcccaaaactcacactggcatctagctgatgatgaatatttttatttggagtgttggctcacttaccaaattcaatctgtcccacactggccttattcttttccctaccactcctcatgaacttgccattttgattcatgccactgtctcttgcctagtcagtcgaactaaaaatttggtttcctttattctttccactcttccttatgtcacacatctggtcagtggccacatcctgtcatttctatttctgcatttcccattttatctgtcttctttttctgtgtgtgtatttcagttgctacttccgtcaactggtgacaatcccaaatgtctcaaaagcagattccccacaagagaagatatgattggtttggttcatcattactgtctctattcagggacaataaaggttttttgggccaggccatctcataagctgctggccagtcaataggtcagctgccattaggtgaagcgccctttctggacacagcaaactggactaaaaggacaaagaagttgagatgaaaaatggctttcctggagttagaaactgcaacggcccggttttcagcagggaaggtgggagtagcatttttccctggaaggagcctggggccctggcgagctttgttctccaggacaatggccactgtccattgaggaaggacttgcctggctttcatcatgtttcaaaactttggttttctcccttgggccattgtctatctccctcttcccactatttcccaagctaacaggttttagtctgcccagtgctaggagaatcacccaacattttactcatccctcctagaatgtaattgcctgtctctctctctctgtctgtctctcatctctttctttaaaacattgaagataatctgaaattatttcagtaattgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccgaaaaatgcagaatattttctatgtttctatagtctacattatagaatacaaaaaagattttaggaaataaaatgatatgctcagttttataataaactgaaactcatatgtttaagattctgtggcctttgttaatttgcaccaagttatccatgagctcaatttgtctgaatctctgatgaatattaacaaattatgacagattgccccatttcctactgttttaatctaaggtcttctcatttcatttacttcatataaattcatttaaacatcatgtaatatcttataaacatcctaaaatcaaagatttaactttcccgactgccttcttaaagtattcaagacatagaatgctctgatttttttctttatttgatactatctattaaaatttgaattgtgtgtatcctgtgtcccaataattttactgctaagattttatcccatttgaaaaagtatgccaagatatatacacagggatatttattacagccttacttgtaaaactcaaaatgtcctaagcatccaataatggggaaccggttaaataaaccagtcttccttcatatggtcctccaaataaaatattatgcagacatttaaaaaaagaatgagaccttcatgtatatacatgtgctgatatggaaaggtctccatcaaagtaaaaaacaactgtttagaatatgccctcatttgatgcaaaggcataagaatgatacagtggactctggggactcaggggggaaatggtgggaagcgggtgagggataaaagactacaaattggattcagtgtattctgctcaggtgatgggtgcaaatctcacaaaccaccactaaagaacttatttatatgaccaaataccacctgttccccaaaaacctatggaaataaaacattttttaaaaaagaatatgccctcatttgagtaaaagtttaaggggtagactatgcctgtacctatattacatctaaataaaacattttctagaaggaaatgcaagaaactgataatggtgcttacctgtggagaggggtttagtgtcacatttggtttatacctttccaaatactttgatttttttttaactgtggatatctattacttttaaaaaaataagtattgataaagtaaacacaagactaatgcataaaatttataacagaaatatctttgctttattaattcatactgattaattcaactttcttagaagaaaagaattctaaggaatactgggataaatacatgcacacatatacacacatatgccctgacacacaagacattgtttttaatgtcaagcaagacttccatttgtatatgtttctctacaagctacaaatggaacattaaatatgtcctcagaattaatatggagttacaatagattgtgtttaaagaagctagtttcatgtttctattttaaaccagaggttctcatattaacttcatattttgatagcaagtctttatttaattttatctgccacagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagtaagtggcttttcttttcacttgtcttgccgctattgggtaaatctttctttatagcatcacttctcaaggctgcactttcccattggctgttcatagttgaatataaaagaaagttcttactctatctctgcttcttgatgattttcaatcctgtctactaaataaagggttatggaaatgttgcttgatttacttttccagagggaatattgtgttcaaaataggctagaatgtactcatagggaaaatgtacagcagtaatgactgcacattctcttcctctattttcaaggttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtaaaaaaaataacctcctttcaagaattttcttcaaaatgtttaaataattgtttattatcacatatttgctttactaatgttaacttgtataccatgtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatgaatatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcacccaaatcctagttcttgatggttaacccgaataactctttgcaataaagaccatatgttattggaaacctatgtatcaggtacagccttagagtctggggctaaaggaattgcataaattattcattcatatactcaaatcttgatttgattatccattggaattacccaaaaagcattattgcttcttcagtatcccatggtgcttcaaagttgtttaaataaccatttaaatccagcataccctgagataacacaaaatcactaggctatccacactgataattgtatttgtttgtagtggaatgaatgagaacaattgcaatctacaagctagctagaaatgattttgagcattatttgctattatggactttggggaacattattctattttattaaaaagtatctctactcatcctgtgtaaattattttatcttctaaataagactatgttgtacagtacagtttgtcttcttttctatattaaagtgtgagtccagtaatttagcttccttttgtgaagattagtgaaacgtagccattttgatcacactgtatggaaaataagtaccaattgcatcttacagtgttagtgacacaggcaagcacatatacagaaccagaacaaacttcccaattggtaaaattcctactcagtcttgaattctgattcctaatagctaactcagttatctcccagcagtcttcactacagatcaattgcccagcccttccaactgcatctgagatatgtgtacattatcagtacccatatttcaaagctaaaaattcagttagtttcttagctagtaatgatcaagtttttaaaaaattatcatctcagttttcaccttaccttataccctttgttgagtgtcctttggtatcaagaacgtcatacatattctgctaaatacattaatgttcaattaaagttaatgccaactttgaacactaccttggaagtgttgttatttccataacctgctagaacactttcttagtaatttcttcttcccagaatatgcaagctctgtatttttgggtgagtattggaacagtgtgtgtttgtgtttgtgtttgtaggcatgtgtgtacatacgtgcctgcttgtgtttgaaaacttgatttaaaattactgacagtaatacaatttttaaaattgaatgttccaggtactgttcaaggaggagacaactttcagatggaaatgtcacaagtgggattcagtgcagattactcttctcaaaatgtgcgtatatcagatagcttcaagccatgttgtcatttggcataacacttccagacacagtagccttatacataaaatgggaagacagccatctagggatcagcccttctgattcctagtcacggtcatttagtttctttgtgctgctgatttacctctaaaatttgaaggataataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatggtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatctagaatcaaaggaactgactttttctggatcatcaatccttagagatgctcatagaagttatggatctttccctcagaaaaaatgtaaatgaatctatgcacggagaattttgcacacaatcccatgaggtttttgtacatacgctgaagtcctttcatgcaccccaaatccagagtccctcaatttactacagtcattcacataacttcatggtctcttatcctcaaagtagaacacatcttttccttacttgctatttttcatggcttgtattttttagtccaacatcttatctttggtacgctctaagatagaagaacaaaaaattaaaaatagtgtatctcatcctcaccaaatctgcctcgtttgatgatttatagcattgagtgtttagattgggtttcaagtcaatccagagtaggcatcttcctttgccctccccacagggctgacaaatggttattttccttccaatagattgaatgtcacagctaaagttgcctcttgtagctgtgctattatcaaatagatggaatataggaatatactggaacatttgagaaggggtcaggaagagagaggaagaaagctgaaagtagaacaggtcagaagagggcctcccgagccgtgtctgggatagcagaagtatctccgtctctcccgtgtcagtacttctgtttctcaagcatgtctcatatccggctgtgagctttccttataaatatgtggagtgagagactcacttctgactcctttgtaaagttcataagggtttaccattggcaaatatatgcctttgaaagggaaatttgaagatggctctgtacctgtcctgtactacaggttattacaaaggtttgtctgtataacatatcatactaaataaagtccaaaataacacagccaatgggaaggcttgttctctagcacaaatatattaagacaattctacaatatgtcaatatatgttcatatatatttcatcatttttaataaatctaaacaacttatttcaatgttttgcctaccctgcattcttatgttttaaaggtgatttgtttcaatgatcttcatttttcaattattttaggatattctgatgctgggtgcagtgggagcttttggctggagtgggaccattgtccagaagacatctcatggccatttgatctttcctaaacaagcctttgaccaaattctgcaggacagaaatcacagttcatatttaggtaaggcatggtaataattggctcagcaaacttaagttcccttgctttaaaccagctctttgttgaatctcagggtgagttcagcaaaatccttgaactgtcatctaattatcatatttattacacatacatatgttgtctctttgccaatcgggccttaaggcataactacttattggaatactatattatactcactagtttcttctggctggtcaagtggttgtaattcctggaacatgattgtgttcctccaaaatggaaatagttcccaaaagtcaatacagtaagtgatagtcttatagtattttagagctcttagtcttcttgttcttataataagcagccactgattttgcagacttactatgggacagttcctgagctgctagtctatctacataaacatttaaatctttccaacaagtctttcagggatgttttgcctttgagagatagcaagattaacaacttgtctaacgttcaacaacctagtaagcggcaaatccagaatctgaacctcagcctgtttccaagacctgtgttctttctactgtgcaacactaccttttaaatacatttattcattcgttcaagaaatattttttgaatgccaggttcacaggtggctgatgagaacagcgtggaatctagaggcagttttataggtagaagtcccacctgcaaagggaagtgctgcaggtcaaaggacaggagcaattcatcttagaaaaaggaagacatgtcctcagtgatgtattcaggagcactagaaactttgcatcacatctaacacaaaaggatctctggtcacctttactcacttcttttaactttattttgctcagatagtcaatgttaatcactctgttgctccttcccttttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccaggtaaatctcactgtttagcaggtgaaattaattttaggggcaactgggcaggtggggagtcaggtgaacagaaatggaaaacaacatggcctgagtgcctactctgtgattggctctgtaatctgagtttacttagtgtattccttaaatcatcacaacaataccaagaagacagccctcccttttgacaacttactgggaatttagctagctttctaaggtcacacagcgtccatggattgagctgtcattaaaactcagtcctttctggactcagaggctgtcctgaatgattacatccccttcatgtttttgactccctggattaataatgcatggatattatttagttgtgatggcaggcatgtaaccactgctttgtaggtaagcacacactaggaacaaggatttggagaggaaataatgagaagaagggagcagcacaacattataaggactgaacttttacatctgaacctgtcagaatgtcctgttggttttgaagattctaaaagtaaaacaattatcttctctgccactttcagctgatgggtgacagtttggtagttagaccctatgatgaatcccagatatggcccactacagcaaagatctgttgctagagcaaaggccagctgattgcttcctgtttccttactaaacagttttgacccaggggcttgacacacatttaaaatgagcatcactaatccctgacaaccaacaaaaagtggtttccttctttaagctggagaaacttacaaagatttctcttctctgagattaagtgtgatcctgctgttcctatggattttctaggagtaagaagacccgagttcttgacttccgtgaccacaaattagctatggtcacatacttttctctcttttttaatattttaaagaagttcttctttaatttagaaaataacagtgacagtgttatggaaggaatcatttcttagtcatttctaaatcctcaaaaagtgttcacataggcatgcattgaacgttgttgaatgggatgaaggttcaaagtctcagcttttcttattttaatttatctccaccttgtcctcctgtcccaatctatccagcaactacttacctgtctcatatcatgccatgtacacttacatcatcatatgtgctttcccacttccctctgcctagaaaactccatgtccttcttactttgcaatttgaatgatattttaactttctaagccttcctgactctcctgctctctgatcactcagcctttgggacttgcctctattacaatttattttactatagaagcttaattatttattctccctgcctctacccctcctgccttttgctatgacaaacctcacatacctacaaaaggtttgccttataagtatgtctttgaccccctggcatcagaaacacctggaatgctaatttaaattgctgtgttctggatcacatcctagacattacttcagaatctctagaaatgggtctcagggatctgtatttcaaaggcattttcttggagattcttgtgcacactaagatttaagaaccaggtgttagatggtgttagaacctgagggaaggaactgtgctctctgtcttcatgttccaagcactttgcaaatagtaaacactcaatttttgtgtattgaatgagcaagtaaatgttcagtgtaatattagaagtatatgaatcctaggaattctaagtttaacatgttttattactccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagaggtaaaaaaaaaaaaataaactaatagtttaatttgctttagtactggtaatttaacttgcatttggaaagaaaaatttattattattgaatgataatttgcacagatagtatggtttacatttcatcatttttgaggatgtccccattaagttatgattttaaaaatcacattaacaggaaaaactagagttgaatgtatagtgtactgccattttccatgagaggtctttgaatatatagtctcttatgcaaataaagccattataagtgcacatcgtttattgaaatatgcacacacacaaacatttgtgtatttctctagtatcacatgtaattttttgcgataaagacaacaataacagggcaatgctttcttgttatcagttgacagtgaaaaacagaagttttaccaagcactttgtaaattccttgtgatctcagatgcttcctacattagtttgtcaggaagtgtcattgcttagtgtaacatttaggcatgtatccaactcttgaagtttcaagtccttccacaaaaaaacaccatacattaacatggcaaagcataatttttccaatttgtggactgaactctctaaatccatgtatataagtgtagtgaactccatgaaataaaaaaagaaaaccaaattaaaggcacagattgacatagaaaattatatgctccttagtatataagaaaaggagaagctgatgttaaaatagtaaatactatgtttaagtattgtgatattttgtaccacctgatttattgatatttatgtaaaaattaatcttttaacagaagtaattaattaaaacaattctaaagcaattatacatataaagaatgtgtaattgagtatcaacaaaggctggacctagttacttgttgaaaaactgacaaatccccccttctttaaatatttcttacttgtgagatatactgaattatcattaattgttgaaaatgaacagatcttttaataccgtgtcaaacgcagtaaaaatttgtataagattatattagaggagaaagaacactgacccagtttcatggttgagaaacattgctttcttgtgaagtcatgaaatatttccatacttgatcataaaattgaagaaaaaaactgtgttttacaaggaaacgtcttttcctttgcacagaattatttaatgtttttaataatggagatattaacaatctcattttctacttcctgtaccactataattatgtcactatttggtaatttttacagaaagcctaaattaagatattgtgttttattttgttctgtgtctgctttaatttcattcaagatattagtaattttcaccagaaaaattttaaatcaaaaggttggaaatagatgaagatcgtattattgagaggaaaatgagaccaagaaatggatgctgttcagctacagtaaagagaattatctcctttgaccttggtttatgagcagatatttatgaccttactgaaattcttatttataattctgatcataaatagttcaggtttaaaattctatccatttttaatattaaaaaattagtttggtcatcgattgctctgaattttattttcttttttattttatcatatttctttcacttttttaaatagatggggacttgctctgtcacccaggctgtagtgcactggtgtgatcatagctcactgcagcctctaattcctaggctcaagcaatcctcccacttcagcctcctgagagctaggactacagctgtgtgccaccactcctggctaactttttacaaaaatgttttatagagacaaggtctcactattgctcaagcaggtctcaaatacctggcttcaagtagtccttctgcctcagcctctggagtctttgggattacaggcatgagccaccacacccagctgctctgaattttaattatacaagttgtaaggtttgctttaatcatccttttgtttcccctttgcaagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccaggtaatccatgagctgttatggtgatgtatgtatttgtgggtcttatcatattagacatagaaagcgtcatgtaaaccatgcaatccgtccgccttattttgtaacttcattctttcactcagcaaatataaagtgagcctctactgtgtgcccaagcactgttctagagtctggggatgctataagaacaggacagacacaattctgatctttgtgtgccttatattatattggaggagacaaataaaaagaaagaagtagataagataaagtattccagatagtaataaaggaatttttaaaaaagcaaatgaaactaaaataggaaataaaatttcagcaataggagtatcaggtggttgaaggggtgactaatgaggcctcactgagcagccaattttggagtaagactggaaggaaaagaactaggaaattaaccctgtacctgaacttgcatcaatttgctccaagtccactgatcttttcactggtttatgattttttattaaagatttatgctgtcccttcgatgaaaatgtggctgtaagagtgatgcagagatcagataataagatgtgattaaaaaatgaatctttagaatttgtagagaataaacacaatctgggacattactatatagaaaatataataatgaaattcagaggctgccattttctggttcagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtgagtcaggaagagccagacacaaactaactaaaaattacctgctaagaaagcagaacagatgtctgtactggtattatagaaatgccacatgcattctataagactatagggaatcgatgtatcatagtttgcacaaaggaataaatgtgtttttccaagtaggaaaaatagatatatttgcttaccattagaaatatagttctctcctcatatggtgagtaaaacagtacatagaaaacataaagttctggaaatggtatccaggctatttctgaatgttatcttcctataaatagccttatctcagcatacagaagggaaacctcatgagagtgcattcaaaaatactgaaaattcagaccacacaagtaaagtgtaacttctatgtgactgaatggtatattttaaaattattagtcataaacaataagccattatttaggtttagctgacctctcattgacctccacaggagttgaagattcagagagaacagtgtgaaggtcatgtgattcaaggtcaaaaataagtatattgggccggcaagggaatagaatcagaaagaagttgtttattcaatcaagaatctccattcatttgtctctgtcaaaaaatgtgctttaaatgtacaaatatttgaagaacagaaaaataatattcattgattattttttatttctgagtttaatgatactatttacaaatctcacttgtgcttttaaagaatgaagtacattatttttattgcagaatgaaacttttatgtggaaaaaataaaactcaagaataatacttaagactttaaaaaaacaagaaaatatatttactgaataaatcagttaaaatcatttcagagtagcatatcaagagtaaatacacatatcccagaacctaaagtataataaataactaatatgttaaacatgtattgtgttagtgatgcagtcacaaattaaaaaaaaaattatctctgtctgccatcttagagctttcaaatatatactactgctaaagtgctttgatagagagtagagagaaaaattcagtaatgctggtactgggtcctctatgataaaggatataatacgtgtgctcagtaataacatccatccatctgttactctttatgtcttttaggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtgggtgcgtagatctgaaataatctgtatagaaattggttggcttacagagttttagtcctgaatataacatattttggtttgtaggccaagagaaataagggttttagttatagacacttaagtttccttacactggagatgcccgagaatggttcactagtcatggaagatttgtttagatcttccttccacatctctagaaggttctgctgcagaaagttgtaatctctatgacataaccaagggccctcctgcttccatcctttgagtttctcttacctccatttctcttacttaaaaccttgagcatacacagattatgctgaactgccactcaaatgactatatcatgttggctatgccatgatctatataggacaggttcagtaaaagtatcaagtatttttcctgtcgttgaggaattaataaacatgaaataatgaaagaaaacatgaaaagcaatatataacttttacccagtgttttaaatgttctaaataatacagagaaatgagtaaaagtctgaattatgtctcatcagatggggaaggatgaggaaatcattgtgggcaagcatcagcaggaattgttgtcttttctcttgggctggccaagttgtctttcaaggcctggcagaggtcctgcctcctcttcaaagctttttctaagcacactatctcaccttcatctcttctgccccaattatctcaccatgctcaatgcatagcttgcaatttaacacttgattcaaagctaccttctttcattaactgctgcttcatgggtcccaattcccattccgtcagaatttggctttaaacttcagaacttgtagttcctataggaattcaattaagtgacaaacatattaacttaaagctgaaaatacagaagcaggttatttgccataattcataccaagatacaaataagatgagaacacaaagcaaaattagattcaaatcttaacatgctttccatattttcctacttttcatatccatttggaagttttccatgcagatgttcaaagattgacccaattttgagtagcatatgtcacttgacctgccatgtagcacatctaactgagcacacatgatagttaagtcaaaaaccgttgctgcataaacattgtggctagtctgcctaataggttaacttgggaaatatattatttggcagaaacagcaaactggtcagctcttctggccccgaagcatagaggtgtctcatgtatcttccctttttgactatacttcaacccttatggtgatgcacactcaaaaattctactttcagagaatttccttcccatccacaggctgccgagggtttctggcctttcttactattgggcatctttccctttaaatcttttttcctgatgccttcaggtccacaaagacaagccaagtgaaatgattgtgagctcatttgtcacttcattgcttggcaataatagtatgtaagacgtgaatcccatcttcacaactgtggaaagtgaatttataaagcatatggtttctatcatttattgcatcaggtgcacacttcactttaagattaataacatagcccatgaagcgatgtatcatttttataaagctgcttgaaaaaaaaaggaaaagcattataatgtggactaactttgtcctaactgcactcacctccttgccattgtttttcctttacatcatcttcacaacttatttttagtttatttaattctttaatattttatctatctttgttggcattgttaagtcactggagcaagaaaaattgtacaacatatatgatagatttttttcaaggtaacatgtagaattcatgttttgggaagtatatacaacctttaaaatattgaaaataataaagtaagatagaataaccccaaataaggcaataaggcagctgatgctgtgaatggcaccaggtgttctctctcaattttggacacacggccagtggactttagttgaaggtaataattctgatagtttagacatcggctactgacatcagttattatcacataattttttttcatgagttggtattaggaaacagaggttcaaagagggtaagtaaattgccccaagtcacagagctcataaacagcagaattaggattcaaaccaagtctgcctgactgagactttattgctgcagtgttgcatgcatttccctatgtgagcatctagaataggtcaagcactgtccatgttcccttagagtatctcagttaatcttcacaataacaattaattcttacaactggatggaagcagaaagaatatgagctcttatttcaaaaatacccaacttttacttctgactagccatgtgaacttaggtgaattattttacatcacttattctagtacattatttgaaaaataagataataaaattcactttccagattcattgtaaaacttgtatggcatacatgagaatgtgtccagttgcaggcgctcagcaactgttcctttccattctgtgtctccgtgttatgagtaatgaaacccgtgcttgtgggagtgagcaatttgcccaggttcatcacagtaggtttcctggcggcaagtctagtttcctttccactgctcccagccacatttctctgaatcacatttctttgtatgcacagtcacctacgtcacatcagagctagaatgacaaatgctttgtggtgctagctatggttcacaagccaccaatatgaagactatttccatattttcttgatgtgagatactttgtccaagaagacacaataaagcaaagatgctttttcctataagttgatttgaaataacatttctttatgattttttttatcatagccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggtaaggcctcaggaacatcccttttgactttatttcttcctaaagacgagagagtggtaaaagtcaaaaatggaagcttatgagttagaaaatgctcacccttccaatgaatgcctttcttatgtaattccataaataagaagcatatttactttatgctaatatttatggtcacaatctattatataagtcagcaacatcaaatttcatttagaattgcaatgaaagggctaaaaatacaattcttaaagaaatcatagatacagtgttttcttaaatgtttaacagagagaactttccattggcaataaatgttattttgatattttcctatcagggaaaaattttatttattgttcagctactgaaaaataactccaattgtggtttctactattagatttaagttaacatagatgaaatatagtagattatgagataacaattatttgttctaatcgtatgctgtaattactgtatttaacatggattttgaaaatttcccaagtgagaaaaatgcttttcaggagaaaacttccagccggaaatttattttataaatgatgtgaatatttccaccttggaaaccacataatggcatttgaaaggataatttactcaggaaatcacttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcaacccaaatatttctgatgtaaatggatggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaagctgtttttctttaaagtttaaaaaaacaaaatcctttttcactatttgatatcaatgccagttaaagtacatcctacttgctaagcccgcagccagccaaggaaacatctcctcatagtccagagctgtcatggtagacaggcccccagaaggaataagtccttctgggaggacttctgggaggcccccaagagttaagagtaagtcctgcctgtgaatggactaaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctctaaattgtaaacacatttggaatcattttcttgttttaatgttgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgcagcctgaaaattcttaattttctaaatgaactacaattacatatgcataaagttcactaacacttaagttccatgacagcagggatttttgtctttcttgttcactgctgtgtttccactccctagagcagggcctggcccattgtatgtgttcaatatatatttgttgaataaataaataaaaataaagtaaatgccttgtgctcatactcaaaaaatattaccaatacatatgaagctctgcgtatagctgtccccgccatagacactttcatctagctccccctgtgcaaatgattatcttgaattgtgtgtttattaatgcttttctttattattttgttaaacatttatatattcctagaacattgtttggttttgtactttatgtaaatagaataatattctatgtattcttctgtaatttgctttttcaacccaagagcaaatgtatggatcttttttcctttttcgtagattcctttccacaaagactgtggtgaggacggactttgcatttctgatctagtcctagatgtccgacaaataccagctgctcagtaagttttactttaaagcttgttgtaaaatgtagaaataaaagacatactagattactttattcaaacgaatgtttatagagtttttctacaaaagaaacattcataactcataaatacctttaaaaactaaatttcaatgtctaccatccacataggagtaaaacaataagaaatataaaattatctgtatttaaatggttccattccctctaatacaatagcaacaaagaacaatccaattgcatttacttatttgttgtcagtatcattttgatgcaaagatagtttattacacagcaattttctcagtattctaagtaagtctaaagagtttagttttttaatgagtgaaattttaaaatactggcctttttatttaacagtaatggcttttcccccctcctttttacttttaacagagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggtatgtgatgagaccctgtacttacttccaccatgcttcctacttatagatcactgtcttctctatgtcctctgagttgtttaaagaagcaccttaaccctcaacatgatcaatctgaactttgtggcttccgactagttaaactgcatgagaacatagtctggctctatatctagattctgcttgacagcttgggtcagtttttcccttatcctgagacttggcagcagtagccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatgtgatcttaataggcttagagttctaaacctaacctgaccttggtgtttaaacaccctgtgccaagtggcaactacttcctttaaagggaaaaaaaaacctgaagaaaactaaaaaaaaaaaaaaaaaaaaaaccctcaaattacttaaaatacagacaaacaccaacatatgattttactttcttctcttgaaaatgcttcaaataaattgagaagaacatattcctaaagccagcatttcaaaatattgaattaaagctattcgtgcatctgaaaataaaaactatcatttttttctggggaaaaaatacagtatttaatcttttctttgttttgttggatgttctaggtatctttagggttagcaataaaagtagtatattagccacctgggcagtataaaatttcaagtcttgaggtataataaattatttcagtatgaaccaaccttactgctaaaatgccactgtacctcttttaccaggtgcgtgcatacacacacaaatgttgtatgccaattgatcattgttgtttccttggtcttgttcaggttgatgggacagaagtaacatgccaggtggctgcatctcagaagtctgttgcctgcgatgtaggctaccctgctttaaagagagaacaacaggtacaacttgcatttcatcctccaatccatacaagccctccttagcacatatgctaatttaccaacataacatcttgctatcatgatttgataggcatcacaaaataactagctgcatacttaggggaagttttcaatatctaaatgttttctttaaattattaataaaaatgggattttctccatgcaattcattccaaaaggtacacatactatggaaagttctttttgtctaaatatgttgagcaacattggtcaaagcactatacacagagtcacagagatcatttattaacccctagtaacaagtttcacatcagctcaaagcttccaaattcagacaggtatatacgcctggataacttacatgtgtcacttggaagtcaagcttctctaattctaatgtgaggcatagtaaaacaaggtggacaaataaagatattccacaaatttgaaagcttaaggtatataaaattcagaatcaaatttgagtgagtttacttttatgagaaacattttttttttcacgttggcctctgagtatgaagcatcatagactgagaaattttaattttgtctttaggtgacttttactattaactttgacttcaatcttcaaaaccttcagaatcaggcgtctctcagtttccaagccttaaggtaaaacataatgaagtcatgaatggaatgatggatagctttgtatttctctttaagtaatttcctaatgtttctttctatagtgaaagccaagaagaaaacaaggctgataatttggtcaacctcaaaattcctctcctgtatgatgctgaaattcacttaacaaggtaggtgaagcagtgggtaacctgctatcactgacaccaactctagatcagaagatttttggctcatggctaaagaagtcctctgtatgctcattcttaactgaagaatttgaattaaaattcttgtcaactaaaacaggagtccacagacatattggtccctaggaaaaccttgagtgactcgttaggcttattaaaccaatgagagtagcccagaaaggcagagaaagatccccgtagccacacatcacaggcacactccacattgcaggccctctgagtagctgcaaacattctcaaaatgttgaaacagaactctcaaaggtcctgagagttgtcttcactttcttctcactgcctacttcccattgtatgtgagatctcaagcagtatccccattcctggacattgaagccccaagcacaatgttttgcacagagtaggtccacaataaatattgaatctagtcactgtttgaatattcaaatattggaactagatcaagtctagtttctgagggaaaaattcctcacatatcagattagggttttcttccagccaggtggaaatgaggttttttccaaaggatgttatccataaagaaatgctttgttccctgtttttacctgcccaaagcaagcaaacctgagagcagtggtgtaaatgtcactggttgatacaggctgtctttaattgttcagagggacaggtgtcttggtaagtgggtaacacacaaattccacaggttctaataggtcgatatcactttaactcacacttagaagtaaggtgagttcatggcacagacaaactggaacacagttgtgcagatgcactgggcacaggtgatgccctcctacaggcctgggaaccagagttctctacctggtgaagcaataggacagcttcccagcacagatcaatgacccctgaatagcacactgcagcactttcccaagaaatccagtgacagcaggtttgtctaacttctaccacatcactccagcccctaagagcatggaatctgtagatcatccaatagctctctgagcaaaaacaaaaaggaaaatatgtcatcatgtctagagcttgagccaaacagcaaagatgaaaagaatgcttctgtatcaagtgagttgcaaatagcacaagcagaaacaaaattccgtccaaataatacatctctgaaaaagtcatcagtaactgcagacttcaaaggatccccacttgctaaaataagaaattggaaacaaatgcaaccaacccaaattgatgttaccacattacctgaattttttccttcttatatttgatcctttcttctaaatattttttgtcaatacagtctttttattattctactctcctacaatggccaatattttcccagatatttaagaatgaaataaatataagattgaaatgagactttacttttactaattatcatcttaggcaggtatttttgtaatggcaacttgaattcaaatgtattctaatgttctttaaaatatatcctcaaaaaaattaacgtagggaattataaagaacaaaagttaaaatgggtcctagtcctactacctagaaaacccaaacattggagaaaggtagacagtgagaagtcatccctccccaccttccctagtgccactccccataagagactgttttcagaatatcttccagatacagggttgcttatctaccaggatatatgcatgtaacacacacatacacatatatatacacacacatgtgcacattttattacccaaaaggaatgataaaacactcttctgtaccttgcattttacataatcttagaaaagttttcatatgaggacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcgataatagtattatttctgaagcaggatccccctgagtatagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaatacatccactcaagtctccctgtgacatattttccttttaaggatatggaaaaaatcattaaggcataaaagagggaaagacaaggttttagtaaagaaacccaaaaaattctacttcagaaaatatccaccccaagtttttaagaaatagaatcaacattctataattaacgtaaattgtccagtgggaataaatggaaaggatatgcacagtgttctcagacccctaccctcactgctcatcccctaatcccccacgcaaagaagctaccctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggataggaagaacgaataatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccacaaagaaatatgttttcaaaggaatttatgttagtcttagaaacatacattggacgataagcccataggcaagcatttctttttatttggtgcttttgtaactaaaagtaaaatttactttaacctaagctataagatacttaaataaaagaaatattaaccttcaagaacaaaagcaaactaaaatatttggctttacaaacatcatccaacagatctaccaacataaatttttatgaaatctcttcggatgggaatgttccttcaatcgtgcacagttttgaagatgttggtccaaaattcatcttctccctgaaggttggtaagcctgtcataaggatggcaaatccaggagaaagtgagaagaaaaaaaatgagtctggaaataaaaggagaaagtaaaaagaaattgaaagagatccgtggttctcaaacttgggtgtgcattacaatcacctggaggaattgtgaaaccacagatgctgggctttatctccagcgtttctgattcagtaggtctagggtgggcctacacatttgcatatctaacaagctcccaggtgatgcttatgctgctggtccaggtgccatactttgataaccaataggctagatcatagttaagtaaacaactgggctttgtgcatagttatgtgtcttgggtaagggatacttgatatattttgaaggcaaatgttcaacattaaccaacagagcattactataaaggaaggtattgctgtgggtaaaagtctttggcatataattattatgccaatttatcctcagagaccacttctgtttgagtttaccatttgtatacaaatctgtacagtaatactaggtagtatctaaaaatatttttgaaccaaattctatttactattagtaagcgattattaatctaaagattactaccagttaaagataaattaatttgtgaaagaataactattttatattgtaattaaagttaaagaaactttggaaagtaaaaagaatttatccactatcctaagccaataccattttatttttgttcatttctcacttgtttgttacatggttgcaactctgcaattttgtgataaaaaaaatctttagaagaatctttatgatctagatactacaatagaatttataaaatgtggatggtatttggcaactacattctttaatggggcatctattcaattcgcggtaataacattcatagagtgtgtaataagtatacaccagccatggtatcaagtgctttacatatgttatcccatttagttcccagatcggttatgagcttggtattattattcccagggatgttatttaaaatatttaaataaccagtagtgtatgagccctggccaattagaacagaaacccccacccatgagaacagatgctgtaccagtgccctgtgccagcacatacatactgaatttctgatcatctttattttacaaataagaaaagcatagagaggtcaagttccttgcccaagccacactgctaatcagcagcagactgggacacaacactccggcagcccagctccacagatggcatttttaaccatttataccacatgtctcacaaagtcacaaattacttacccattaacattgtagatgttgagtttttttccattgagccatttatgcccagtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggctgactttcatttggactcagtcttaccacctcgtagttgcccttcatcaacacggggttactggtgaatttccttgcatcatgtacatcctgttgcagtactggcacattttattctctacataggtaacaacaggaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagggtgatcatgtctgacattttacagatgggaaacagatggtaactcctatgcagcctgggtgccaactgactagcagttaatttcatattagaaaaaatattgttacaagaaaacaaatggctgagtctagggaattgcaggtggcagaaattattccaaaaaccccattttggcctggtgaagatctgactttgacaggccctgtgaaggctgggaggtaaggggctggacctatatggggagcatagcaggtcttcacagctgtgataaggagctggtcttcaagcagccagcctggactttcgcctggtaatactcaaccctggctgttcattttaatccctctgttcgctcttttaaataacagtgcccagacctaacccaggcaattaaatcagaagctctaggggtaagattcttacaccagagtttttctttaaccacccccactccatccacaccatggttctaacacgcaacctgggctgagaagcgctgctctagccaaacctcttgacattggctcatcttcagtccaacagttgtattattcaacagttgtattatttctgtagtgtgcataggaggctacagaaaaatcaaaatcctaaaatgttccagagaaaattaccctgaattattcacagtgtttagctattgcagatttgcctcatcatatgtgggctataaaaacctagcccacctcatcagttcacatcaggagcatttaaatacttgatgttcacctagagattatatgaagtgtggccaggtcagtggcgttgaaagaagcctaacagcccttcccagacccctacaagtgacagtaggatttcctaacatgttgaaaggaacatcataaactgttttgcttctgaagtctgatcgggtgttcttcttttataggctggtgacatcagttgtaatgcagatatcaatccactgaaaataggacaaacatcttcttctgtatctttcaaaagtgaaaatttcaggcacaccaaagaattggtgaggacaagttaacgtgtgaaagctcccctcattcatttatttcacctgtgatcaggacgctgcttttctcctaccagctgatatcatagagctttcttattttgcctttgatgcttatatgagtcaagatttagaaaatattaggttggtgcaaaagtaaatacgattttgaaacccacaatttacgtttgcaccaacctaatatgtggtcaaatctaggttactggaattatcttatgccacttcttacaaaatataagttccagactttatgacatcagaaaaactcatgtgaagctattgtgtttatgcgttgtgcactttggaaacaaggcaaagagctgtgaaggaactagctgtgtgctacagaggagaagccccttaaatcccccttccacataatactgatgttttttatttagctgtgaaatatgctgctgcacttctctgtttttcaatattttgttatttcctgttctcaagctatgcctgcttctttgggaaagagactagtctagcatctggcatggtgctcggcacatattaaatattcaaataaagtaaacctttagtaagcaataactcctaaacaaacctcagctctcccctatgaacaatattggaattctcctggttttctttaattgcagttgttttattttgtgaaggatggggaaaacaggaaaccagaagaataaaattatttcttttaatgtgtattaatctacaagtaggtaaatgcatgctgtaactgaagtgggccacgctaccttttggccttgaacataggccaatgtgtcatagattttcaattaatgacttcattttttaatgcagttttacattcatggaagaattgagtggaaagtacagaagttcccatataccccctgtcccacacagcctcccccactatcaaaatcccgcacaagagtggtatatttgccacaatcgatgaaactacattactatatcattatcaaccaaaatccatagtttacattagggttcactcttggtgttgttaaaatccacgctgtggaatttgacaaatgtaaaatgacatgtatccaccactatagtatcatacagtgtatattcactgccctacacatcatatgtgctctgcttattcatcctgcccgccccactagcccttggaaccactgatcctttttctgtcaacttgtttaaaaacctagggagtctataattaggtttaatgacaaattgtagtacattttgtgcatgtttactaatttatttaactagtacattgttgctaaacaagttacagttttggggggggttggtttttaggtttttttactcttagaaatagtagtgcaataaacaggcttggggtactttgttccacatattgctgattatctcctgaggctatctatacagacaggaaatggatggggtaaagagtgtgcacttggtacattttgagatatagtcccacaatcccttgaaggagggcgggagagttagaactactaatagctcatgagattgcctgtttccctaggtgtgtcccagcactgagttttatctagctttaaaattttagcatttattttttaactcttactaacttgctctctcttttacctttgactcaatactataagaactgcagaactgcttcctgtagtaatgttacctgctggttgaaagacgttcacatgaaaggagaatactttgttaatgtgactaccagaatttggaacgggactttcgcatcagtaagtatcagttttatttgttagatttatcaatagcaaggaaacataagtctgcactgacaagttcttcccctttgacaaaataagtattctggctaatgtctgcaatggccaaataacccagagcattttaccctgaaaggcagcacacttccatcgctttccaatgcccatccaatttagcagtgcctcagagtcatctgggatacttgtgaaagggtctgtttctcagactccatgcgacctaccacatcaatgggaatggtgtcagggtcatctctgcggccctgggctacaaggggcagcctgctttgtccccctctaggggttcctccactctccatcttcccagtctcctgtgccacacccaaatcaaaatgtctgtgtctctgtctcactccttgagctctcagttaattgtatgattgatctcaaaccacctagtagatgaatctagcataaagatatgtcttcctatattacagccaggtcatcaccctgctctcctgttttacccttttcctgttgggagagcccagtgggcacatgactttctaaatcatctcaatccccatgaaagtttgaagaaaaagccaaaacaatgtcattgtttttttccatatggcaactgtgagtctgctctagttatatttgctttcagcagggattttggtagctagaatttcagtctggcatgaaaaaatataaggatagacaggcctccttaaactggactgcttgtgtggctagcattccttttactgacatgggctccaattgaggaagaaaaacagaaattagtctgaaacctcctggggatctttgtagctcttactagattttttttttctttttaacaaataaatcagttcccaaggtgcttacaaccaaacgctactcatttttttttctgtttatcatttcatgatctctccaataaatccacttcctgctatagagttttgtaaaactggagaactcagcaccctccaaactcatccctggagtcaaatataagcaatattcttggacaaagacatagaagaaaacggaatagtaaaagttagaacaaaatgcagaattgggggaatggggaagtgaggagttgaatatttcttctggcttgcttgcttgcttttactttgttttcttgttagttgcatttgctttcaagtcttcaggacaattctaggtcctttaagacgtgaagcgtgccgttagttgttatcaccttcccagctgctgcagtgtggtgctcagttttgctccattggttcttggctccttggatttgaggaacaaatgttttcatagcaaattttgccaactggaaggaacactgactgttgcacatcaaaatgcacacatgccagctctgtaaaacacatttggattttcttgagtttaagactacatcactttaactgtgaaactttttaaagtaccttcccaacgatcttcagaagcagtttatttctgggagtaaacttcctagaaagtgtagtatttatgctgctttaatgtggctatggtggttaaactaagaaaacacccttgagatgtcaaggtatgtcaagtgacatacaaggattgtgtcaagtcctacatatcttcctccttcatgaaaagtcaaatgtttatcctcaccttgcttccagcaatttaagcagcaaagtggatgtttctcagaccacttaggagatccagtctgaaatatggatctcatttcctgtatttgaacccattaatgcactgccttttgttgctaccctttctctgatgtagtgcaaggcaacttaacatttcaagtaatttcattacaaagtgattgatcagggctccaaattgatgatagagttgctgccatttgtagggagaagccttgttgaacgctagcaggtgcgttacttcactctccagatgtgtgtggcatgcttacctctacttgttaaccctgcaggatattgtatgcctgtgagaagggcctattttgagaatgctataagaaaaattctttcatctttagtctttggggattatgaaaccagcatttacttaactgctgctttttttcttaaacttaaaccattatcaatactcttaatgtttcccccaataatatgtttaagagactggtgagcatggttaatttctgatccaatcatctatattgagaaaattaacagtaaccagagactgagccagtggaaaggaaataaattgctcagtttttggaaatacattctttctggctcccagatattgtttagcaaattacctcacagagtatgtccaataatgtgccctagtaaccagaaaaactgagtcctagtagccacagcatgtgaaagcagctctaacatctaagcgctgcattccgcttcacagtagcatcagacctaatgtagagaaaatagtgaaatatacacatcaataatgtttctattgaaaaaatagacttttttttttcccccagacagagccttgctctgttgcccaggctggagtgcagtggcttgatctcagctcactgcaacctgtgcctcctgggttcaagtgattctcctgcctcagccgagtcgctgggattacaggtgcccaccaccatgcccggctaattttttatattttttagtagagtcagggttttgccatattgaccaggctggtcttgaactcctgacctcaagtaatctacccacctcagcctcccaaagcgctgggattacagatagaagccactgtgccctgctgaaaactaggctctttttctgtaactagatggaggaatgaatgtaaagttatttcgaattagtaagttaccagtgacatcagcataaaatatccttcctatatacctgccccaaattaagtattatttgatagaaacacttagataggaaatctgaagttatactgatgtgatataacaagctgaaaggttcagggccatgggtggtcaagttcaagtgcacttttaaacactatcattttacacacatgtacccagaaggaaagttctcttaccttttaaatgttggttttccattccattgtgtgacttattcaggtaagtatacaaagatgccaagtttacaattttctctcatgtcacaaacttattttttaaaaaatctgaactgtgatcttcccagttagaaatattcatttttaaatcctcacttttcaacccagttctcaagttcagatctcctcagggagatattttaacctactcatgtctggatcccaccccagagagttgatttgtggtggcaaggtgcagacagacatgtattaaaattacccgaggtatttctgacgggcagtcctgttacacagcactggtttaagcacacacagattctggatgggtcttcagaaccatttgctcttgtcacattccaccaggaaataaatacataaatcataagcatgccagcttctctgcatttgctgctgctacgataaaacatattccttattcttatgttccagtcaacgttccagacagtacagctaacggcagctgcagaaatcaacacctataaccctgagatatatgtgattgaagataacactgttacggtgagcatatcacacccttccctgtgagcctcagggtctgtgatggcattccacttctaaaagcctgggatagtcactcttcttacctacatgtatgtagaagtatcttactaaaactttaaagatctgatgtttattatgttgagattttggcgagggtgtgtgctacttaaaaagttcagtgatacacttgccttcctccatgccccccactcatgtcagcaaagctggctttcctagaggtggtgatccagtgagaagtacaacaaaaggggctctatgttctttgggactccatggtgtctcttctcatgactaagccagcagcaccagttcttcctttctcctcctgcttacacaaaatggtctggagcttaggccacaaaacttaatcatgcttatttaaatcataaattgtattttgaaaaatttttaaagaaaggtactgaagcatgcttaataaataatgcatttattagagggttttaaaaaatagttctccttacaactagacactgacactgtgtggcatgtccattcattagatcttacattcgggaggactataaatggtccccttgataaaaaaaaaaaaaaaagcttttacagagaaatgtactttcacagaaaacaaaggctctctgttctaagagctggcatgagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactcctctggcttggtcaaaaagttatggccccatgaactatgggcctcctcactccatgcctgagagtgaagctcacagcactggagccccactcttgtccaagggaaaatgattctacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattagattcctcttttattggtttcctctgagcaatactaataaataacagaagccaattactaggtgcaaaagtaattgtggtatttgccattaaaagtaaagaaaggctgggcacagtggctcaaacctataatcccagcactttgggaggccgaggcaggcgaatcacctgaggttgggagttcgagaccagcttggccaacatagtgaaaacctgtctctactaaaaatacaaaaattagctgggtgtggtggtgcacgcctggaatcccagctactcaggaggctgaggcaggagaatcgcttgaacctgcgaggcagaggttgcaatgagctgagattgtgccactgcactccagcctgtataacagagagagactctgtctcaaaaaaaaaaaaaaaaaaagtaaagagaaagtacttttaatggcaaagactgcaattacttttgcaccagcttaatattactcagttgtgtctatgaaaaattttttaatctaaacaataatttggataaatttttgaataaggtatgtaacctaaataataacttcacatgttcctaagtatctgttaatttatttgaatgcctggcccacttaaaaatctgatccacaaaatgctatagtcatgggtccatagggatccgtggttccctgggttagaaagctgtggaaaagagagaagtaggcttatgactgccattaagcagtgagctacaagaatttatcatcactttattcataaattgataaagccttacattttagctcttgaagatacaaatgaaaggaaatacagtcaccaaggccagttgcaagtttagcccagcccataaatttatgacaaaaagcagctcatctgccattgcaatttaatgttacatcaagtaaataaaacacatattatcctcttcttttgcttctaaatacagctctttaggaatattttctaaagagaatgcttgagacactttccccaattaattaaatttcccctaattaattaaaaactgaatatacagttttactgttaacactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgaggtttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagttatatattttactatttttatcttatacattcactttgctcacatccaagactcaatttaagaagactgaggctataattaatttgccataagtgtccagtctatgtttctagcagtgaccacaaggatcttcttttgtaagactcttaaactgccttcgaagttttgagacagtgtaaagcattgctcctcaaagtgtggcccagggacagatggtgctgcatcacctggagcctgttaaaaaacacagatctcaggggccactcaaaactattcaagtcaaattgtaagttctacagcatccccaggtgattcatattgcattgaagttgagaagcactgctctaaagcttaccttttgaaataaaatgtgtgcttggaatagagagggaaaaaaaatcagccaaactgctgcaacatgcaaaagcagagtcatctgcacagtttaaaaaaaatcataataagcaggaaggtttaaatatttttaaagagtaaatatgctgaaataaatatgctgtaagttataaagtaagtacacgttgggctcacagactgccatcgctgtacagatggcagagtaatgcaaagacagggtggaaagtgtgtgtgtgctgccataaatagcgatgcaccagcatctccattcatgtctgcggcgctctctcacatgcctccctgcccatcgcagttgtgctgagccgtctcaggagggcagctcactgcagcacaaccatcaataagtgtgtctgctatatatctcacattaaaatacaatcttggagagctgaatgtgggaattgcagctacttgggaggctgaggcagggaggatcctttgaacccaggagttcaaggccggcaacatgagaccccccccctcccagctcttaaaaaataaaatgttagagaaagagagcactaagttttatttctttgtttttcacagagcaggttaggaaatgctgtacaggttaggaagacctgtattaaagcaatcatttatatcccatagttaactggaaaataattttatacttactttttaaaaagtacttctttttatttattctacatcacttgttaaaaactacaaattgcattttcaaaaactccttcctgatcctatcataatcttttaatatttttaaggtgtcaattaaagattggacatcatcttacataaaatcagggcctaattttcatttcggaaccactacagcctgactttaaagaaaatggctactaaactgaacttttggttctatgcaaaattaaatctaagtaagactcaagttgctaagagcaactttactataacttttactatggctctggctctactgccctctgctggatgatccaccgaactacatcacacaaatcattcttgagagatcttcactgtaccaggtgctcagtaactgtgtaagatgtctaaatcacttatttctcaaaaaaggctgaaaatatattgtgactctatacatcatatccaaaggacaaaaatgtccacaaaataagtcactcattgaatatctgctgttactttcattcaaagatgataaaaatcaatttcattttaccacctgttcaaaaatacttgaaacataaataatttgaatttcctatttcttaagtgaacttacctagcaatcatgcaaagtcacggctttaaagtgaccaagaaacactgcaggcaatctgattaaaggctaattattttttttagattactcttctagttacttgaagctaagttacagagatgatagaaaagctacatatcagagtgacagtagccccttaatatctgaaccaccaattaactctgccactcctaagtaagcaagggtcagtaaagatcctatctaagtcaagtgcaatgcactaaaatctttcaaggccattccatcccagttctggcatgccccaggttaactccttaacctctctgttggagactttaaaagcataacagtctcagttccaaacttagaataaagcctacttaatgaaggcatgattcttttaaaacataaagaatgttctatgttctttaaaaacatcattaccctcaataaggaacttctaaagaaatatctaagtaggaaagtcttgaaatccacatatacctatcaacattgcatatgacataacatccatttaacaacctatgtccaaaatcctagaaatgtccagtgacccagtaaccccatgataatgtgcttttagatataatgcaacagccaacacccaccccttctctccaatggggacaggcggaagctcgatggcaagccagagtgacactgaactgtgaaggtaaggctgagaccaaacaggcaacccgaacccggcagaggaagtaggcggagggtttgtctgcccttccagtatccttctggcccaatctctccagacggactaatgaacaagcatcaactgatgtaaccaggtgattcctaaagtcagtgtggctgtcctatgggtcccagccacagataagatgcagagtgttcctcaaggtattttaggttggcagaaaaagatcactgggtgggtgcctggcacaaaacaggcattcaataaatatttgttgaataaatgggttccttaggtaaaagatgttttcactacatataacaaataggattactacgtttcttatttgtcccagacataagaaaaaaatccttcaatctaagtgtctgaaagtatagcttttgttcttaatatgcataatgcaaattttgtgatgatgccgactgcccaaattttgcctgtattttattattttatgagctatgtgtttacctgaaatttgctgagagtagaccttaaatattctcaccacacagaagaggggactatgtgagctgaggaatatgttaattagttggattatggtaatcacctcacaatgtatatgtgtatcaaaaatcacattgtatactttaaatacatacaatttttgtcaagtatacctaaataaagctggaaaaaaaaatttaagaactatatgggacttatatgtacaagtctatcaaaatactataaagcttaaccagttaaaaattggggcattgtttacctaaacatttcaacacaaaccaccttgttgctagttagctttatgacaattttgtgctgatttgtatattgatacaaaattaacaactaataaaaaacaacaaaaagttttctggtaagattatagattctgaaatcccagaaatctccataatgagaactattttaggcaatttaaaaaaaaagaaaatactctttttaaacttttgaaatcatgggttttagtttattatttttaatatatttctgaaaatgtataatatcaagactgtctgataatgcttttttaatactttccagttctgccaacattcctgtcatgcatccttaataacaatgctctcccagaaccgggatggggggcggtgaggtggggttggtgggggagtacgtttctgagctagttaaagtcactgaggagggcccatacctcaatgtgtgttgagttacaattagaaattagtcatggaaggacatgtctaccacagatatctttcctcacatttaaattattccatttcttcctacagtcctccttctatctttagttccattttaaataacccttcatcctacatacccatttatcttgcttcctttttctcccttttgtcccactagtataagagattgtgcttcagtaaactatcctgatgtggagagaaaaaaatcaaaatgtgatcaataataatagtttaacaaagttaagattgcatgctctaaaaacataagtgattaactgttggatgcccaaaagcactctttgtttcctttccaagttgatgactcttcgtatatttcctaaaaaacaaaatcataacaggtattaaaaatagaccattctactatacgaatataaaatatatttgaataaatcagacaaatgaatatcacatctatttcaatggctcctcttttaacaatcatgacgagagacatcatgggcaaggttacataggggaagacagaaagtctttagttttaaacatttttttttctttccaaacatacctactacttcaacatttctaaatatgcttttccaaaggcagatatcttcattagctgttgaattaagtggtcacctctcagaagttcctaaacaagtttgagctgccctctggtatgagctgttctttgacatatgcactctacctacctgccacccttccctatatcacagatgatctcaaagcacaggccgagactagaaccagactagaagttacatagtttgtggaaaggaggggtaaggagaacatatcactttctcttctcactctctagtcacattccatttctgtagggagaggaattcaaattcaactgtcctctgaactcctgcacttcctcggactctctatggacaaacaaaagcaaaatacgaagcccaactagtcctcaaagcatgaaaacaagaatatgccccaactcctgctcattacctgtatttctggggttgctcccatctactttctgtccactgactgtgcaccctttcctccctggtgaagaaagctacccctgccttccaggcttgcagctgatcttagaatgctcttcctacctctcgctctctgggggcctgcctcctgttgtgtcagccttgttcacagcaagggaacaatatatctgagcttcactaagtttcctttcacacatattctatcctctaatccctacgtattctaacaatgggcttcaattttattctgaaaacatggtcatcaaatttcccaggccctggttatgagtccaacttgcttatttctaccactgactgaggcaggtcccctgggaaggaggggagaagtgccctttaaaagccctggctctctgctctggtcttttcatctactgagctgttcattaactcctcagctttctgtcaaccacaacgctgtaggcaattctagacaattctagacattgaatgtgcaaccacagaacaatcccactgttaatgttactacaccaggggagaaactagggagttgggccttttcatcccatcagaatgctctatttaaccagagaattacttgcccttattgacagaaaacatgccagaagttcctatttctgtttttaaatccactcactgcattttctcagagggagcaatatctcaccatttttttttcttccctaaaaaggacctctaggaaaagcctctttcactttaaagaatttctattttagccattacctaaatagctaatgcattattctcactctccaacagaaagaccctctaattcaagggaattataatccaaggaaaataacttcatgtatgaacccctccaacagtccagactaggaattctcactgttatcactcattgaggcttactgtgtgccatgcattctttggggcacatatttttcatgcttaacaaatcttggaaagaagatatttcacagataaagaaaacaagatactacagtcagtaaaaagtccataaatatggggggatttatctaaaaattcctgagaaaaatcaggtccacatgctaaaatgtgttattttcttaacttacctttttccatatgggcaccttggcttttaaagtatcaatggcatagctcacagcttcaagagatgcagctctgtgggctgaggacacagcaatgattatgcttgcttctgacactggaaccaagctttaacaagatgaagagaaaaaaaaatcaccatcatctctgaatctacgtgttaaagaatctgctagacagatgaaaaaaaatccaggtatgcagtcttagaattatactgtagttctattttacgtaaacatacagttagaaaagagtaattaattgcagtagcattcagcagaggcagtagatgaggctgatgctacagctaatttgttagaatctatccactaaaccctcctgatgggcaccaaggaaaatcctttcattgatagagcaaacatctgactcaacaaggcacagtgccaagtaatgcctagaaatacaaagttatgtcctaacgagtataatacaaaatttaaaataatacatatcaagtaataggagtgataataaccattaataaaactactggttattaataacaaactagtaactaacagagtatgatagatacagtctcaattactggcttctttttaaagccaagaactcttctctttttaggggtacaaaaaggcaaaccactctaatgactttcgaggcatttatatcaaaaagaatctgtcacagattgtcatagggcctgcaagtcttggcacaactgcagtttgttacagcaacagaggcaacaagagctctcccaatatcaaaactcactaggcagtccctaaaggtactaacagccatccctattgtcctccaaaaataatacatgaatattcctctcatggtaatatagaattactaagaaagattcaagaatcagagttagtacaaagatggaaaacaattacacttaacttttagagtgataaaggaaatcatacccaagtctatggaacactgctatgtgtttgactggccatttctgcctaatgtcactacaaatctttctgacttcattttccgccatgggtagatatgcttcatattctaagctaatgacttttttcccttcaaagttatttcttgtagtccctttaaaaatgaaaaaaaagaaaaagaaaacaattaaaataaggtttttccctacaaaagaaatagcacgttaataaaaaaggaatatttttaatagtaaattaatagtaaacaagcagcataccaattcttctaaaactactttgaaatcttctaaaaacaaaatttgattaggaaaataaaacagatcttcacaaagatgagcactgattaagcaagcttactaaaaacactcacctggcaaaccgggcaatattcctcttctgactaatagatacttaaaaggaaaatatttatgttcccaggactatcaagtacatttttaccttcaattttggaaaatctagaattctctctcctaacaatgacttttatcctacttttcaaaatgccttgtaatttaatataggttaatttgaaggttactaaaacaaaacaagaactaaaaaaaagtctacccaccatcatcggtaatcttggtttaaagttcagtatttcaaactcctccgttaacactgaacatggaaagcacatgctaatttctattgtcttatacagtgatagatgcaatgaaaattacaactcacctacaaatagggatattgcaccacagagcggagaaatcaccaactgtgagacttcatctactgaaagtttctcggcagtaaagtttataacatctttagatttctcttcaacttcatccatatctttcctagaaataatacattaacaaaccttaacagaagtcctaggggtaaaacactcaacaacttataggctctttcaatttatatttttttctacattatgtcgatgtaaaaggaagaggctgtggcacaaaatatagtttacatgagtcaaatcaaggacagtggcccaggatgcttctaagataccttggggagttcctttggggagcactccctcggcctttgttgcaagcaggtttgtaaaggcaaagggaacaaaaagtgggctgatacaatgatacaaagtttcaccaagaattctcactggcatacagagataatgttgatcactgattggctgtacactgttgaactatagggtgggtacaagttagagtgtccagcatatggactttatggtttcttagcttcagctagtctgcagccctcataataagtggcttcaagggaccagtggctcacacctgtaatcccaccactttgggaggccgaggcgggtggatcatttggggtcaggagtttgagaccagcctggccaacatggtgaaaccccgtctctactaaaaatacaaaaattagccaggcggtagtggcacacatctataatcccaactacttgggaggctgaggcaggagaattgcttgagcttgggaggtggaggttgcagtgagctgaaattgatcatgccactgcactccagtctgggcgacaaagtgataccccatctcaaaaaaaaaaaaagaaaaaaaaggtaatgatgcagcttaatggggagtgacatgactgccatttcattccagtgcctttctgtgcctcttaatgttttatctgacgggctcacattcctcagataaaaagtttcttttctttttttccccaccattaaatgtgttaggaggcatgatttgatctgaatgataaaaataagcaagtgtaaaaattaacaaaactcaattatgtgtataaatattcataatgaatcaggcatgacataaaaagtaatccattattaacatgatcactaaaatataatctgtctcaatgccaatatattccaaattctgtaactgctattcatatctcccatcaagatacagtggaggtattgccactttcacctacatgcccatcccctctcaccactatggtaccaagcaccacacctaaagctgtctttttctttatccaacaaaaaaggaagaacagaagtgacagtgattctactggaactgggttcccttcacaaactggcaaaaccccaggtaagtaactgaggaaataagggaatgaactgcacacttacttactaggtattgtgcaaagccctttgccatgcatttctcatttaattcctcaaacattactacatactcactaagggccagagactagggccaggcactagatatcaatcaggggagaaagaagctcaagctcctttcctcagcgtgcttacattcaaataggagaaacaaagcattacaggagaaactcagaattacaaatagggataacttatggaagtaaataggcttcagagacagaacctggggtctgggggagatttctctcaagagcctctatgaaaagttgcgacctgaaagataaggaggaagtcttgtaaagaaaccagggcacaggcccccaggcagagagagggagtggccaatgccaaggcactgggacaagaaagggtgtgatgtgctccagaacctagaacgaacggagagaactgggcaggctgaggctggacaggtaggtagaatcttgcaggcaatgaggaatataattattaatcctgtaaggtttcatctgaattgaaagacgagagaaagaaggctcagagaagttaaggaactcactcaaggtgctgaaattccaaccaaggagtactagttaagccaatgttctttttcctatctcctttccaccacggaaacagcacaattctttatataccactggattccaggatttttcatctgctacacaagccgcctaagtgtcttccacctctttttcttgcaataaaatataggtaatataaatatggtctacgagtttcaaaccatactgagttcccacaacttctgattttacgagactactaaaacctagctggcaggttttaaaaatgcataataccagtcctgcgaaacacattcaagtaacacacaatgcttttgagtaatcttcgtaaccttttcaaagaacagctgtaattaccacaaatatccctttaatggtagcctatagttttctgaataaattcgaaattccaaaaaactgcatttttagaacctcctgaaatcatggtggtgatatggtgaccacagtttctaaatagcattgagatacatatct

SEQ ID NO: 145 - DNA, 4780 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggttggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaagatttgtttggctgactggcagtaacctagtgaatttctgaaagatgagtaatttctttggcaaccttcctcctcccttactgaac

SEQ ID NO: 146 - protein, 1177 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVKVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 147 - DNA, 7886 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaa

SEQ ID NO: 148 - protein, 1179 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVKVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 149 - DNA, 72821 bp, Mus musculus
  misc_feature (1)...(72821): n = A,T,C or G
ttatctctccagtccccccgcaccccagatgactcttaaatgtctgcttcctacatgtgtatccccagtaggtcaggactttcatgattccaatggaatcaaactgtaaactttaaactattacagaagtatttgacacctttctaggatttggtacgtgtcagccgtttgtaacaaaatgcctgacacgggctagttttaaggagtaagaggtttatttagctcagagttttggaggtttggagttccaaatcaagtggtcatatgtgtttggcctctggtgaagatagcacatggaatgtcattgaggggggtacatctagaactaaatggccagatctccaactggagcaggggactgggtgtggccaagttcaaactttgcttttagacttttgtgagaagccgagagagagagagagagagagagagagagagagagagagagagagagagagagagagagagagaaagagagaggctgtatgcaagcataaggacctctctctatgctccacctccccgagggccacctcagaggacaagacatgcaaaatcttcagtattcagaccattacaaggcatgtgatccagagctcctgatccagttgggttcttaggggatacctgaacccaactaggaaaagctgattgggttatttaacctagaagccattttattcgtagtgctgtggattagagtgttgggatataaaacagtcactctgctgttaaactaaaaccccctttccaactaaacaccgtgggtcttgctgagaatgcatctgagaaaaggacaagacgggccaggaaaaggggtcagccaccatcatcaggaactttatcctaaatgttccccatgaacattgagcggatcctaatgtgatcctgaaaacaaacacagactccatcggctgggactgcctgcaggaaaagagaaactcggtttttaagtcaggatgactaggcgggtttgctaatggatggtacacaggaataaatggacaacgggggaaccatgattcagaatgggagatgaaaagtacaacagctaggagaacatctggaacggaaactgtatcaagaaggggccctcagacagagaaggtgatggcctgataattacccagcatttccaggggccttggctagccttttaagcctattcccgattaccccattgataaatggttatggttgctgtagctattataggtgggcattggggttgggggtggggtgattgtctttgttaaataagaagcagctggaatggcattcactttaaaaaacctgagtttaggaggctacaaggaagtaccgggtaagcttcttccaaccattataagacaccaacaaggagaaaacaaatgcaatggagagatttatactgtcttggtaaatagcacaccacttttttttttttttctttcatgaaattaatcttatagacagtatgaattctgaggaaagggaccggcttgtttattgtgatgatgcatactacttcaaaatgttgttgttcaaaataccccagttatcttgtgtctctgtgctctggggctgggagggtggtcaggggtcagctggcaattctctactaggaagggacattaacttcatggtgctcagctgagagcaggctgttgaaacatgagggtccctcacaaagctgggacttcactgctctctgtatggaaacttatcatctatggctatttaaaaagtcaaaacagaggccgacacgcatcattccatcctcagtacttagcctgttaatgtgggaggcattacatagggcctgcaagccataaacaaaattataataccaagattctcaatggtagcaaatcaaaatgttttgctagcagtgtcaccaattgagtccagatcactgtagtaggagtatatatgtttcttctttaagtattcctatagataagacactaaatttaactcaaaatatgtcttacacacacatatatatgtatatatatacacatatatatatatgtacatacatacgtacatatatacatatatatacacacacggcaaataatatatttgcattattatatacatattatatattatttactatatgatatataataaataatataaaatataaaatgtgtcattgtaatgtaatatattacatgatatatagttgcatatgttatatatccaaatatatatttattatatatccaacttcatatttataatatatgtgatatatgtaattatatgtaatttataatatatgtaattatattatttaatatattgttatatatccaaatatatatattatttggacagtaatgcctcagaaattaaccagtgcttcttcacacttttacatgttttatgcttatgatttcaatatcgtaatttcagaaagtctatgttgattcagtatggagatgatttatttcttagttcttcatctaaatgggacccaacctttgactcaatgttttggttacaactgaacctcagtttttttttttttttttttttttttaaagatttatttatttattatatgtaagtacactgtagctgtcttcagacacaccagaagagggcgtcagatctcgttacggatggttgtgagccaccatgtggttgctgggatttgaactccggacctttggaagagcagtcgggtgctcttacccactgagccacctcaccagcccatgaacctcagttttaagactcgctgagataagcattacttctcagaagaaatagtgcattgtctaccccatcacatcagcaaaggaagcttgtctgccttcaggaaaaaaaaaataacatccaactttatcttcactcagcaatggaaggcaacatggacgcttccttgggtttgcatgcagtgtactgagggtccactgtccccaagttttgactgaccaggccacaaactcaaaagaatatacaagtttctctttaggaaacaaaacaggagactggtccttgttaaattttaaggcacattgcaaagtcctcctgaggttgcactccccagctccaagttctttatgaagcaggccaggggtgtcctcacattcaaactcagcctcacatctgagagagctaaaaaatcagattcacatctttcacagagccaggaaggcacaatcaattatttctttggttggttaaatattggctttgggttctccatttgagatcttgtcttcaaatcttccacagagccaggaaggcacaatcaattatctctttgcttggttaaatattggctttgggttctccatttgggatcttgtcaaacccttggtcctatctccctaatggttctagtgatgacctttgatgatcgccgtggtctcccaagagttttaaatgcacgtctgtggacactagctcagcaaatgatcccctggagcggcgacaaacaaaaggcaaggaatggcatgtggcccgtttgcaaaagccgatttaaatcccctttgtgatctgcagcgtctggtgctgatcagagaactgattgtcatctagtcacactctcagaccaacccagagaggggagtttataaaatagtaacagtggggcccacaatcttgtatacccctaggccaaacgataatagcaaccgaaactaagccatctaaatttccttgaaatgcaagctctaaagaaatacacttagggtttttttttttttttttctttgttttttttttttctttcttgccagtatgaagaagttgaaggaggcagtcttagacaaatgaacttgtgaagctccagtggcttcaaaaggatacactgctttggggtgggggtggggtggggtggggggggaggggcannnnnnnnnnnnnnnnnnnnnnnnnnnnnnnnccatcaatgaatttcttcctttaagctttataaactactcagtaagtcttgacagccaaacttggcttctcccagtcacacactgtccttttgtatttacaacacactcgtgttgtttttaaaacctgatgtgatttttatctggagagcggacgtcctcggtgttgttctcactgcatggtgggtttcctgtagctccttttcacctggcagctgtcttcagagagaaggatgtgcgagagctcttgagtgacctagatctgaagactcttgggtggttggttaccttggcaacattcagtgctttagctcaagagagtaaacaggagggctggcgagatgagttcaaatcccagcaaccacatggtggctcacaaccacccgtaatgaggtctgacgccctcttctggtgcgtctgacgtcagctacaggctacagtgaacttacgtataataataaataaatcttaaaaaaaaaaaaaaaaaaaagtaaagaggaccctctattagctcatatatgctaagagggtgctaattaatttgaggccacatttcagttattaggaaaggaaaggataattctatacagcaaggccagaaaagttatacagggaatttattccatcatctgactttaaaagataccaatctttttttttttttttaagtgtaacagagacaaggccaaaccatacaaaatatatctaaatataaaagtgtaacagaggtgaaagcgagtcttcaaatgcttagcaaaacaagaattatatttctttctcaacttcctttgctcaaagaaataggaccgcgggaattaaccgtgggtgtggcaagtcactgctgccagttgataaatgggcaaaaaggaccctaggaataatcttgggtttggccagtcactggtgcccattgataaacgggcagatttcactgaaatgacacttcttctttaagtagggtcagctcatttgcaggagagcgaatctgagatgaattttgtaagactaattgagaaaggtcagttgaaatcagttctaagaagtgcttgcaattaaactctccccaggtgtggggaagtgcctgctgggcagctgcaccggtgtgaattagcaagccctggctcaggaatttgggtttagctagcccacctcctggattctgggaaggtcacactgtgcaaactataagcttcaaggtctcatttgagtttgctgagagcggcttagtcattataaaaatacattttctggctgcaaatataatcgccctttcaggaagaaatactcccacgggctaacagactatggaaatgatagtcatcaagtaattggaattttcctgggattcttaagctagaagaaacctgtctcctggaaagagattttacttagctttgacaacttgtcagaccactttacggaagatgctggagacaggattggcgtgagcaccccttaaagggactgtttaattatacacacctgctttctagttaaccctaaatctcaagccaggaccctgaagatgggtggtcaatggagctctttgttcctcttcccgttgtgacacctttgactaaagatcctttctctgtttttcagtacactttgtgtaaaccacctattgagggcaggacgatggcttaccttgatggggtcaccagagtccagtgttctaactgtaactctgaaaacaggaagagtctgtgggtttgcagcccacacacaaatggccgtataagtaagttattacgtgtgttgcttatttttttttttttttgtgcagttccttttgaacatagcatctggcactcaggcgatatttaagatgagttgtttcatttatgttctttcaagaccagcttacagaagccgtattttgttcgttcgttcgttcgttcgtttgtttgtttttgagacagggtttctccctgtagctctgtctgttctggaactagctatgtaggaagagctggccttgaactcacacagatccatctacctctgcctctcaagtgctgggattaaaggtatgtgccgccaccaccaggccataagccatattctttcctgaaattccccctcctccatgtaatattaacccaggaacatgaatatttttatatgcatataccaactaaaatttaatggtggctccctggaggaagcacagttctcttgttcagtagtttagtctatcaggtaagtttctttctgcaaaaagtgttggcatttaggctccgccccacagttacctggcaacagccagatgtgcctgactcactataaaagggactgctttctcccttctctctctctctcttgttgctccccattccccttcccctctctctccacatactcatggctggcctcttctctctctctctctctctctctctctctctcctttctctgtctctactccctcaattctcttccccattccctgaataaactctattctatactataccttcctgtgtggctggtccctcagggnnnnnnnnnnnnnnnnnnnnaaatgcaatggaaagatttatactgtcttggtaaatagcacaccacttttttttctctttcatgaaattaatcttatagacagtatgaattttgaggaaagggaccggcttgtttgttgtgatgatgcaaactacttcaaaatgttgttgctcaaaataccccagttatcttgtgtctctgtgctctggggctgggagggtggtcagggggcagctggcaattctctactaggaagggacattaacttcatggtgcttagctgagagcgggctgttgaaacatgagggtccctcacaaagctgggacttcactgctctctgtatggaaacttatcatctatggctatttaaaaagtcaaaacagaggccgacacgcatcattccatcctcagtacttagcctgttaatgtgggaggcattacatagggcctgcaagccataaacaaaattataataccaagattctcaatggtagcaaatcaaaatgttttgctagcagtgtcaccaattgagtgcagatcactgtagtaggagtatatatgtttcttctttaagtattcctatagataagaacactaaatttaactcaaaatataagtcttacacacacatatatatgtatatgtacatacatacatacatacatatatacatatatacacacacacttggcaaataatatatatacattattatatacatattatatattatatattatttactatataatatataataaataatatacaatataaaatgtgtcattgtaatgtaatatgttacgtgatatatagttgcatatgttatatatccaaatatatatttattatatatccaacttcatatttataatatatgtgatatatgtaattatatgtaatttataatatatataattatattatttaatatattgttatatatccaaatatatatattatttggacagtaatgcctcagaaattaaccagtgcttcttcatacttttacatgttttatgtttatgatttcaacattgtaatttcagaaagtctatgttgattcagtatggagataatttatttcttagctcttcatctaaatgggacccaacctttgactcaatgttttggttacaactgaacctcagttttaagactcgctgagataagcattacttctcagaagaaatagtgcattgtctaccccatcacatcagcaaaggaagcttgtctgccttcaggaaaaaaaaataacatccaactttatcttcactcagcaatggaaggcaacatggacacttccttggatttgcatgcagtgtactgagggtctacggtccccaagttttgactgaccaggccacaaactcaaaagaatatacaagtttctctttaggaaacaaaacaggaaactggtccttgttaaattttaaggcacattgcaaagtcctcctgaggttgcactccccagctccaagttnnnnnnnnnnnnnnnnnnnntgactgcacagccaccaaacacattccttcgctcctctttatttttataaaacacaacatgaagtacttgtcatttggggggaatctttatttttttaatcttatttgaatttataattatcaaggctagcttttaaagagtaagaggtcatgactgtagtgatggctcagcagttaagaactactcttctagaaaagactagggtttgattctcagcatccacatgatggctgacactgtttgtaactcaggttctagggatccattgcccttctctggcttccatgggcaccaggcacacatgcgatacagacctacatgcaggcaacacccacccccacccgcacacaatgtattggcatgctgtggcatgcattcgtggaggctgagatagaggaactgcatgactccagggcctgggggctagcctcagcaacacagccaaattatgtctaagacacaccaaacaaaaaactccagaaaagacctgtcccctggagagatggctcagaggttaagagcactgactgttcttccagaggttctgagttcaaatcccagcaaccacatggtggctcacaatcatctgtaatgagatctgatgccctcttctggtggtctgaagacagctacaatgtactcatatataataataataataataataataataataataataatagacctgcccccacctcaggcaagcattccatcacaactagtatttgctgtgttacacagagacactattatcttcatagagacctcaaacaaaaaggtaaaaattgctacgggtcgcgtttaatgccctcagcgtaaatgacatgacttttcttcttctccatgtataagcccacagttttccaggaatctcacctgcaaccccatttacaacaaaaggaaatgtcttaactatccggtagaacgcttgcagtccatgttttgatcttatcagactgtaactccacgaaaggcgcccctgtagccaccctacaaaaaggagggatggggggaggggctcttagcagcccctttgagttgtaacttgggagccaccaaaatggtctttatggttactgttaaaacacagctctgaaacccatgcacctggtcttggatgtgtcttattgttattagccctcatatttaaatctactctgagaaaaccctctttttaattaactccagctctgcttcataccacatcattctttaattccttccttcagttttacctgagtggaggttcctaagggacaaagggctactaagtagggcttgctgagtgccccggatttaaggctcactagttttaacctagacgcctttcccgctgaataggaaaacaattgttttgaactatctcaatttatttgataggagagtaagaaacttcaacctccggccccgcgtgggtaagagataacattgtattccacaatgtttgacaaagatgaatggccttctgccatttacacagaatccccttaacttagtttttgtttggtgagctctttggcgccaggagagctgttgccgcaagcaaacaaagggaaacacactgtggggcctagggactctgaaatcttaatccggagggaactggccaaaccttcagagggggagggtatgcacgactaatagaaagctctgagaaacattaatttaagtaccgggcttgggggcactgaatagcgccctcggtctggtaagaagaaacctttgcacatccaaagatgtataggagcagaactatccggtccttttcacctgtcacatcaaagtaaatgtgtgaacccatccaacggatggaaagaacactctgtggggagttgcaacccctccgggaggtgatggggtacacacacctggctggctccaggagctaggtccctccccaacctgtgttagccagagggtgggggcgggagaggattcggcgccgaggttgcacagcacatccgggcgcgccggtagcgggctgcgggctgcataattgatggaaggccggcgcaattgcgctgggagcgtctcgggggtggaggccagggcggccgggcccctcccactcggtttattctcgagtgtcctgtccccaggactggcagtgggcgcccagttaccagcaagtgtacacagggaccaacggagacggatcgcagcaagctgagggtgccttagcgacctcctggacagacccgcccgcgccatgcgctcgcacactggcctgagggcgcttgtggcgcctggttacccgctcctccttctatgtcttctggcggcgacgcgccctgatccggctgagggcgatcccacaggtacctggggggttcggggggctggcgcggggagggctctgggttcaccggaagaggctcagtggcggcgaccctccagcccgacgacatcccttgccgctcgcgcaggggccgcggggatgcaggcgcaggcggctacggagcggagaggggggtggcctttcattggctgggcgcgggttacccaaggaggaaacgtgggagcccgggtggctccgcatccgccgggtatagggatgatcccgtcccagtaaagctcagtttgatcctgggagctggtagtgagacagggtcggatttttcctaggaagtgggcaaatagagtgcgtgggttcgtgcgggggagactgggggcttctgctagtgtggcatgattatgagtccacattccgcgaggccggctcccttcattagagccacagcgaggctctcgtatcacctttcctcctggcaggtgttgaaattgagtatgatttttagagcagagggtaaaaatcgcgatagccagccaactcaaacaagcccagataagaaaattagacgtgtgtgttgtcttttcataacaatctttataaaaacaaaacatttttcaagggtgttgggttgcgtgtttacggcatgcggacagaaggatttccgtgaaaaacattaccgggtcaagatctattttgccaccttaactcacctttttatactttatgtgttgcaagcgatccaatgcttttcagtgcaagttcctgtgtctgtggcaggttagctcccatttaagtcaccactaactttcttaagcagttgaaagactggctttactgggaactaaatccagacattattccacacaaggttttgcgctattataaattatttccatgaggttatagcatgtagattggttaaacatagtataaaagaaaatggtcaaaaggacacacacacacactgttaacttggattcttctagtccctagattttcttgttccacatgttttccatcataatagtttaggacatgaccttaccaggcgaacctggttcttcggtcctcttccatgcatcatttatcatatgcttctgaaaaatatagcctctttttctaactcgcttcttttgcctccccgcttcccctttccgctcccagctccttccctccccctctcttcctttcttcctccttcccccttccttctttcttccctctgcacttccctctgctgttgtcttcctcctttccgtgagcgtgggcctgcgtggacagaagcacctccaccttggaactacaaatccagcctacactattgttttgagattcagtgtctcttgggttagttctagaagtttgccttctccacttggcagtggtgggaactttttccccaagagctttaaaaagaccgatctccaggtcttgccctagaaacaactgattcttttagcatagaagtcagcctggacattagcagtttggaaaaattctcagtgtgagtcaaagcaggcaaaaatcacgagaggacccaagggtgtattgttgctgacgtcaggttgaagttaatgtacccccctggcttctatagagaagaaacttggaagcagatgaagctgtaaataaacgtgctgaaagtcaggggaacgtgggacttccttggaagactcagctcagacgaaagttacaaaatttgaatgccttggtatctgaattcccagcatccatttggcagcttccaaccatctgtaactgcagtcccaggggatccgtcctcttctagcctccttgggcatgggcatagatgtagggaaaacactcatatacataaaaacaaatagctagatggatagatgaaaggataaataaagtggtgaggcctctacaactcttcctagattcagtattaacttgaatgagattcaacattgtctttactaaagcaatacagcaaggtttattgagtgcttatgtctttatactttggactatttagaaataggtgttctgctaaaagaagatttttgggggccaatatcaataatgtaagttactgtactaatacagtgtcagaggcactgcactgtgcagtgtgtagcctgatggattagactttattttccctgatttcctttctttctttttttaaaagatttatttattttatttatatgagtacactgtagttgtctaaagacacaccagaagagggcatcagatctcattacagatggttgtgagtcaccacgtggttgctgggaattgaactcagtagctctggaagagcagtcagtgctcttaaccgctgagccatgtctccagcccctccctgattttccaaagaggaagttgggcagtcagttaagcaattgcctagtgcgtggagttagtttagtagtaaagcagaaggtttaaagtgagtctccctccatagcccgttttcttaaacacagctctctcagagatcactgcacctacctgtgtgagtctgtatgtgtgaaaccacatgtgcatttttttgagtcttggaatgaggtcaaaggtaaggcccaggggagtgagtcgctggcttcttcaaggttctttcttgaaatttttgtcgttttctttattttgtggatgcaaatacatgtgtgctcatttgtgggtttggcaatgctcatgtgatcatgagaggacaacttgagacgagttgtttctccctcaagggtcctgggagttgaactcaggtcatgaggcttgccaccctgtgccttaacccgatgccctggtttttcaattaaataagagatctaaaaatagctttgtaaaaggaacaggtaagcacgaatcttttgacataatttttaatattatcataaccaacaaaccaaggtgattttttttttgaaacccttttaatggagtaatttggaacaagcattttaaacttccaaagtcatagcctgtatgctgctttgattaattctcttccctactagactctattgtcttggtagtaactgctcgttagaatgaaccttacttatatgtcagcatctccctgccattttgtttgtagagaacactagcagtttttgtctctaaaggtgtttaaactggttaaatgaagagatttattacaagcccgtttttaattgggatatttctgatgtttaaaaatttggtcatcactaaaattatgtaaacttttgttaagaatatgttcaacttactttgcatcctggtactccatcaccctgcccttagctctttctcttcatattttcctgagtggccctatagtatttggatgaacggaagcaggaggaacccttacctggggggtggaactagaggcacacatcctagtgaggatggcttccccctaaaaggacaaattgaggttcaaggttaggctcagtacagtgaagaagacactccactgcagattacctcatcccagtctcagagcaaagcaaggcgaccaggacttctacacagcggcatgtggacagttaatatctgacccatgctctagggcagaccagtacagaaggtcaagcctttgggggtgtggagtacagctgtgtggggacagatgtggcagctgtagtggggtgtcatatatacatgggagttgatcctagaacaactactgtgctatgtagtatgtagcccgatgaatttgattcattttctctgattttaaaagaggaagttggtgcttcagttagagcagtcaggaaatctgtcgaggaaagcaacatgcagggtttccatcttgggaagaggaaaataaagaggagaggatgagcggagaagggaaaacttttatgttcttcgtgaattcatcactataaatctcctccattgctttttatctgtgtcacatatgtacaaatacatgtatagtatatatgtgagatgcatattatacatgtgtttcatgtgataagtatgttgtgtgtgtgtttgagtgggcacacacatattggtagctctgtccactggtttctaaaaactaagtatacttaatacctagatgttggctgggagcaccatttttaaataatgttgtagaaatggctgctttcttccgagctggggtggggaagtgtgtagacctgggtgccagaaaacaatggagtccttgaaggatgatgagtcatgtctggaagaggcaggagccagatcacccagagaaatcctagtaacagatgatggtggtgatgagctgagaggatcttgctgtgtagctgggcctggccttgcccttgtgagccttgcagattaatctcccgagtactatattaatggtgacattgctaaacaatgttggaattcataagtccagactgataagtagtaattaaactagggggaactctttgctgatgcacaaagttcgtcgtagttttaaaggaatttcctagagaaatcttacaaattccaaaggagaagagtaaccttacattggggaactgtggcaatataatcaaacaatcaaagtaaaaatcatcactactaatattttttaaatgttttctttttatttcttcctcctcctcctcctcctcctcctcctcctcctcctccatattggttccctagtgcaatttggtctgagatgatatggtaagaagagcacagaattacctcagtggcattgctgccaggactgcctatctcaaatctaatcatattacagtaggcctgaattgtcctaagggtcaaggctgaagaggcgaggccggcctggtaagagcagagctgttgcagacaagaatggagaagaatggagaggcaggaagcattgcttctggcccggcccttctgcagacagacatgcacactggagagactcggcaggagtgtggccagagctggcaatgcagaaatgccagcttcctgagctcagagaagcctgggtggctttggggtgtttcctctgcaggaaagactagggaaggccatggagagggctgatttatcttgtcagcagtgtaccactgacatagcgcagcgggaaatgtcagttcttgacatgtcctataaacctgaaattgtttgaagaaaaacaacactaactcagctttttcagagaaagcttgatttaacatagggattccattaaaacagcagttgagaactgatcatctgcatgtttggttttttatatatatgtgtgtgtgtgtgtatataatgtatatataattaaaaaaatttatgtgtatgtatgcatgcatctgtatatgatggaaccgaagagtgctttggattttgtttttgtttttttctttttctttctttttttttttttttttttttgagacagggtttctctgtgtagccctggctgtcctggaactcactctgtggcccaggctggcctcgaactcagaaattcgcctgcctctgcctcccgagtgctgggattaaattcgtgcaccaccacaccccgtagaagagtgcattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttagcacacatacactaacatataagaaaaacaagaaagtcctttataacagtttattaaaaataaactcctgccggggtggtggtggtgcgcacctttaatcctagcacttgggaggcagaggcaggcggatttctgagttcgaggacagccagggctatacagagaaatcctgtctcgaaaaaaaccccaaaaaacaaaaaaacctcctgaaggtaaccatcatcattcaggtgtaacaatatttctgtgatgttataggaaggagagacttctttaaagatggtgctcttcattttaattaatactttttcccccctgttttctaagttactgagttatattggcataactaatgtatccacttaatccaagacagagtctcctctgttttatttggggtggggtgggggagggttatatatctgtggttggcctcagactcactggtagctaaggatgaagttgaattccggatagctctgccaccacctcccaagtgcggagatgacagacatgtaccatcatgttcaggcacaaaacctcttttggtctttcagttacacaagtcaagaacctgagatggaattttgattgatctgaatgctcagagtgcctttgccatatatctaggggcaaggagcaagccatagctggtttcctgtgttatgcttcggtgatccaccaagcaatgggtttctttctaaaaagatccttatagtagacccaagcaaggttagtcacccatgaagactgacttaataatatttgtgctttaagttatttgtgtgtaaactgtgtagaccagaccagaccatggagttacaggattggttgcaggttatgaaaagcagcatactgattaagaacagaggtaggggatcggtctacttcaaagccaagatttctcagcctccgcatcatttatttttttggtctggaataatgcttggttgtagagctgttattgtggaatgtgttaggagagtatataaaagtccacattgtgcttgtcattcaactttccttttttaaaactcaactataaaataactatctataaactcttgtctggtaaatctcatattatctgaaatatacttgttacctaactggaaggttatttatctgtgactcttaaaggttgacttttaaatgataccatcaggacaattcaattacagctcttctttatttttattttctcaacaaactctgggatataatgtccacaatgcaaaacaggggataggaatactagatacttagaatctggaagtttaattccaaatgcattgttcatgagcagaattttacctggtaataatctggtttaaagctataggtaaggggctggtaagatggctcagtgggtaagagcacccgactgctcttcccaaggtccgaagttcaaatcccagcaaccacatggtggcttaccaccacctgtaatgagatctgatgccctcttctggtgcatctgaagacagctacagtgtacttacatataatagataaataaataaataaataaataaataaatcttaaaaaaaaagctataggtaagtaataacatgcagtccttgggttacatataatattgcctctaggaagaaataagcatgattttcacacttaatatttatcactagtatatcttacctgttccaagttgtagtgtttttttttttataattgtgtatttataatactgtatgttaggatgttaaaatgaggatttattcaaaataatctgaagagcgtgtattggtagtagcaataaagtatataggtgagacatagtaataaattaccacttgtttttctcagtactgtggcttgaatacagagtatttattgtacatgctagacaaattctctaccattgagttatgccattttatacaaaaaggattgaatctgaaacacaaacatgtaatgaagagagagcgagctctgtagttaacctgaaatgcactcttcacgcagaggagccagctttttcctcacccacctggcagctcatgatcacctatacgctcagtgggagggagctgatgctattctgttctacacagacttctgcatgcatgtgatccacacatactcacaaaggcacacatgcatgcaaacacattcttaaaaaaatatctagagaagatgcaatgaagagataatgggaaaatattggttttttttttataattttatttttctaaggaatggggtctagacagagtattttacacatgctcagaagtgtccacccactgatgtatatcctggtcttctcttattttgagacactatttcactgcctccaaggatttgcctaggcagtccttgaatttgcaatcctcctgcttcagcctcatgaataaactacactgatcataggccctgaatcatctggcctataatcatcatatttagaggaaatagttatttgtgtaggagatgcccttgaatgaattcatttccttacttaagaaaaaaaaaatcgctgcgccgccgccatggccgacgtggaggacggcgaggaaccctgcgtcctttcttcgcactccgggagcgcaggctccaagtcgggaggcgacaagatgttctctctcaagaagtgtaacgcggtagccatgtggagctgggacgttgagtgcgatacctgtgccatctgcagggtccaggtgatggatgcctgccttcgatgtcaagctgaaaacaagcaagaggactgtgtcctggtctggggagagtgtaaccattccttccacaactgctgcatgtccctgtgggtgaaacagaacaatcgctgccctctgtgccagcaggactgggtagtccaaagaatcggcaaatgagaggtggcccaggcgttcctggtgtggttgctgaccctggacaaccttgccatcaagttactggacaaagactcaacactgcaggggattcatccttgagagagagaggatgctgtgcgcctttgagactcaccaaaggcttgctttattaatttgtctgtttagttttgggaaattctctacaattaagataatttgttaaaagtggcctttcctacctctgtggtgtgtgtgtgatacgtatgcatagaagagcgagaacaccagaaaatgatctttgtttatctgtcagtatccacgactgtgggaacattgtgttcacaggaagaacattgtttgtgtttatgcttgagggttaaaaaatagataaacaaatgttacagtaacaaataaaatgcattgaaaagccaaaaaaaaaaaagaaaaaagaaaaaacaaatcttaaaactgtgcattgttttctagcatttcttctgtcttatacccttcccagtttgcttcctttaaacaaagcacaaagtccagtgagtgaaaatttcatagttttagagggactgtaacatttagttcatttggtagtgtttctaccatcagttataagcccttctactctagcaagatctattttaatatgtaacacgtggaaaacacctacatggaagacatttttcacaccatgtacaataggtaaaaattaggttactactcagttctttgaggcagtatcttcatgcaccatctctcctgctgagggaggaagaaaaaaagtcctctaatctctagaacaaccatgagttgttattcttttatgttggtgttttgccactacctgtaagagaaagccaggtggaaaatgtccagaaatgattaagaagagggtgattgtaatacctcaaagaatgcatgttttaaacttggcaccgtctcccaatgttgatgggacttctaatcccttccccctccccccccccccccccaagaattgatgtttactgtagagacattgccagcaaagcattgcgctgtgttgaccccatttggatagttcaggtcacaagccactggccaacttggcttgggacatgcaattcttacctctctattttattttattttattttatgttatttttttgtgactcagcctgattcttccagggatacagccaaaccacatctgtctgggtcgtcccctgccagtttctgctgcgtacacatgcttgctaaatcatcccttcaatgccagtgccctccctccgagaggcagagaggtttccacactcgcttctttgattgcagaaaatgtccagagaactcccttgtactctcctagtgtctcctcccctgcttttatactgtagcatttgttcctgctgcttcctaaaggaattcttttgcaagttcattggaaggagaatatccgataaagatcgatgctttagttgggcaaaggtggcacactcttttaagaccagcactcaggagatagatgaaggtctgagttcaaggccagcctggtctacagaaggagttccaggacagccaaggctacacagagaaaccctgtcttgaaaaaccaaaataagatgataagataaaaaggttgatgtcggggctggagagatggctcaggggttaagagcgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttgcttgcatcgggtggcctgattttccttttcttggtattctttcagcttctgtgagctgaggtttttgtccagccccattgagccttagagccccctcctcttccttctttctaatgtaggtcccagatcggttctttcagagtaggtccctggaggcgaaaaggaaaatcgctccagccgaagtctcctgattatgctcattccttactagagtcggtttacactctgtagattccgtgctcacgtgtgaaggacataggctcgggacagttaatactagaaataagtgcctctctgaaattttaatgagtcttaaatcaattgtgatccaaacagctgctttcgcactcattagcttttagggattcgcttaccccatctcactccttgtcagcacacactgtataccaggtgcttttatccttccttggttaagtggggtcagagggaaaatgtcacaaagcgccctcccttatgttttctgttgttgtcactctcctgtgactggctgtgtgaatcagaataaccgtcatcagactgagtgaggtttgcccctctgaaaaggtctcccttcttgtttcagagatagggcatgcgatgacatgcgagacatcttagtgttcagccaggccaggaaaagaaaactttcaaatgaggggatagatgcttggcaaccttcaaggtcaggtggctgccacataacttgctttcctactcatttttaacttcctaaggagcactgagtagtttatggcctcttctttgaacttacccaatatgtgctgtgccccaaaatgggaatgaataatttttattaggaaagaccagacccctttatcatatgtgtgtttttgttatatatggtctctctctctctctctctctctctctctatatatatatatatatatatatgctatatatgtgtatatatacatatacacacacatatatacatatatatgtatgtatatatatatatatatatatatactcacacacacatacataccctaacacaacacacatatacaccctaacacaatacacaatacaaacacacacacacacccaaactctggtcattaggctaggcagcaagcatctttacccactaagctgtttttcaaatagacaccaagtcttggcgaggatatctaaaatgtaaccacacataatttgtcttacagatccaacttttacaagtctacctgttcgagaagaaatgatggcgaaatactcaaacctttccttaaagagctgtaatatctcagtgacgggtaagtgggtcatgcctcaaaatgccaaaataagtttgaaaaggttttaaaaataagtcatggctttggtctttcccagcttgggttttcaatatgacaaatgattgtagaatttttaaattagtaagagcagtctctgtaccggttaatagacattacaatagcaaaattagaatctaaactccttcaacctgttttattacattagggactagtattttgcttttttaaaatgtcatatacagtttttgcctatttcctagtcttctgagctgtttctctagtctttgtttcatgtgactagacaaactgtgtgtggcagattttccaagccattgtcagtgtgtgatgagttttttgttttgtgtgtgtgtgtttgtttgtttgtttgtttgttttttccgatagacattgttgaaaattttgtgcagctctttgttgttcgcagatgtttgtattacaatgtttgggatttattcttgtaaaagtcaaatctgtattcctgtgttgtttttgttcattgtgtgtgtgtgtgtgtgtttgcatacacatgtggggccgcacatgtgtgtatgtgttggttgcctatgtgagatgaaccacttatttgggagggatacaggggagagatcttttgccagtcttgcagaatggatttcagaacacaagtctcactcaaaacaacctggtgcctggaaatcaaggattaatgctcaaggctacaacacgaaataccttatttattaacttaaaccaggcgaggtatttacataacctgcagaaggcttagctcttagctactctttattctaatcgttcaaccgaaaccagatccctgctcttacggaaagcacagttgttcacagctgcccgttgtttattgccttggtttgtgcatgtcgctctgggttccccctgcacttcacttggttcccttctgagcatcctaaggactggcacccaggcctggtcatgacttttgtgtacttagctgtttgtccatcttctctcttaaagatctggctagtctgcctgtcttccccgtaaaagaaagccttgtttgctgtggagacacttgaagattttgagttgagagcttttcttctgttgcaacagttcttatgaagtaaagccttttttaaaggtctgaattaatgtttacttgagaaaagcaaagatgtgacattaattttggcacactcgagtctttgagctgtgggtgtatcttatgcgggcacattgctctcatgttgggagctacatttgttggtacatggaatttaagcttgaaccatacgcgtcatcttacttccagtacacttttaaaggaaccatctcgggctggagcgatggcttagtggttaagagcactgactgctcttccgaaggtcctgagttcaaatcccagcaaccacatggtggctcatgactatctgcaatgagatctggctccctcttctggagtgtctgaagacagctacagtgtacttacataaaataaataagtaaatctttaaaaaaaaaaacatatgttaaaagaactgtctcatgaaaattggttgatctgaaagcccactcaccacatctccgtagcgctgttattagaggttgtgggcctaaggactggagtttgtattttccacgaaggatacattttgccaataatgatttcaacatcaccctgtttgtagatagtcctcatggcgtctccatcttgctgtgactctgcttttcttttctcctctggccattttggaaattgggcttaattttttttttttttcagagagagtcaaacataatacgttagttacaagtcctgggccagaatgccaactttggctgcgttccataaatttacttaatgagaaagggaaagatgtggaccctgtgccggggagaacgaacaagcatggcctttggtttaaagacggaacaacgacagcatgattactttttttttttttaaacataagatccttttttatttgcttgagaaagtcatggtgttgactgtgtgccacagatctttttttttttttttcttttctcttaataggacttagccttcatagcagttcttttaggtgagcactgctgttatttcagtttgtagatgaaaacagagacacacaaaaagattgaaggatccgactaatcccaagtgagaactggcttttgaacccaggcagtctggcgccagattctgtgctgggccaaataacttcttaaggccaaagtattcatttcttttagcagtatcactaaaacaactatgcttgttattaaggtgaatgagagagtagctttggggtgatatattcaaaatctatgaaaagaaagtcatattaaatgctttaactccgtcaagtttagagactatttcctgaataatgggtttgtggaagtggaattgatgttactaaagagggaaaaatatctttcctctctctgctatcactgggtttttttttaagtaatcttttgataatggactatttggcagtcattacttatattcctgtaatcagactgtttctatattgttactatcagtgttttctcttctgtaccttgtactgtgtttttagcatgtcagtgttgtagtttaaacaacgagatgaaaatcaaaacatcagctggccgctttcttgatctgcctggtgatgcagaggtgtgcatttacattgctgacccaacccatattgtgtttaccagccgaggtgtgggcagctgacctggcaaggtccccaggagggaaggaggaagcagagcggcagcagaagctggaggtgcttgtatgctaatttagctgcgttaaggtttggtaatgtcactggagatgatgaaatgcagccctgttgcctagccacaggcaggcgggacctctcaggttgcagggtcaggagcttgagcagatggactgtgtgtgtgtgtgtgtgtgtgtgtgtgtgtgtgtgtgtgtgtgttcctgtgcagctgctctcctggactgcttgcctcagggaagaaggatcctagtacgcttcagtggcctgaagcacttagtgataattttaggatcgagttgtcaagtattacataaaaactggtcacgcgcaaagaagaaaaatgtgagtgagcactgacattcacaaggagtgacagaggacgcagtccactagagcaccagacaggaccgaagcagaagctccagcaggacagaagtggcacctgccctgcatcctggttctcagcagcagaaatattagcattgttgactagagaggccttgcatgtggaagtctgtttggggcattgaaggatgtggaatggaatcttagacctttatgttgacgataaaggctgtatgttcatgcagataaatatgtctttgtgctgcaagtaccagagggagccctgtgtcctagtttcttgttactacagtggagtgggtaccagaagcagcctagtcctgaagagggggttgctttactcaaagttttggaagcctggataactttcagtctctagtcagtgtccatggaaaatgcatcttccatgggaagcaggcgtgcgggaggaagcatctctgtgtcttgaatctggacgtagggagagctgtgttctaacaggctggctgcttggactgctcataagaaggcagagttttgtcaagagctacttaatcccattgcagggtttttagtgatctgaggaccacggattaagtcctgcctctttttggtgttttttttttttttgttttgttttgttttttgttttttttttgttttgttttttttttttttttcagacagtgtttctttgtgtagccctagctgtcctggaacttgctctatagactagggtggcctcgaactcagatctgcctgcctctgtcttctgagtcggggatgtattcttgatttcaggccattatgttttcgttttttagagtcatgcaggtacacagctgtgtgaccacacacaaggtaggagcagaaattagaagccccagaaagctgatcctgcctgggtagacatacagtggaaggcttgacttaaggggaaggctgccagccccaaaggaggatacgttgtcttcttcactttagctccgtagagtgttaaaagctctgggctcctattgctgtcaattacaaagaataaaatgcaaagaagtcctccaaagccctccccccaagcccccagattatttatagacctcagagaggcttggggcacaaatttataatagttgcctgattgaggctccaccaagctgtgaaatagcacagaaaggaaccctagtgggtgcctctccctcagaaaggcaatgaagagcacagcgggaagcctgcatcccctccctggctatgcagtgactgctggggatatgaacataagatgtcaatgagctccaaagcacctctgatacactccacagccactgcggccccatgctacaggaacaccccgtggagacatgaaagaggaactgagagaaccatgcttcatgtctttcaacaccagttcttgatgctctaggctcaatacatatacactgctagcttgtctcttcccttattttgaacagtgtaaatggatcagttggctagggtattcctcttgatgagcttgctcgcacacatctttctgttctaacttatgtaacagtgaacaccctctagataactccatgggcgtagcttcgaatgcgttccccgaagaatgctatgaaggagaactactactgagttagaaatgaggtgaacttttcgtagggactgtggaattatcttgctggctatctgcacagtttgtcctttctcacacccacgtttctgctagtttctctctgtcttcactaatacgagatcctatcagattccctgaactgtgtcctttgtgagcgtaaaagctgaagcattttgaatttaaacatgcttctcttcgtgcccatgtatatttgtttattaataccttttactgatttcctatttgttttgaaaaaaaattggtggaaatgaggtaggactaaagcacatattccttttgggtatgctttttataaaagctaaaatatgtctgcccattgcataatttgtgtgcgtgtgtacgtgtgcacacttgcatgtggaagccagaggttgaagttagctggcttcatacacatatagttgtttgcctgcatgtcagtccgtacaatacctgcatgcctggtgcctgtggaggccagaagagggcattggattccgtggaagaagagttgcagacaattcagacactatgtggctgctgggaattgaactggggcccactggaagagcctgggagatttaccagcatgtattttaggtgggtggtaggacttggaggtcaggccttcatacttgcaccatggcacatactttacagatttaggctctacctctacctagtaacttttgtagtccagttttattcacccattgcctttatagcttttacccttcacttaaagattttgtgaagagtggcattggaaatatggtaaggcttgggttgagtctgtagactattttggtcattgtcctagttcgggttttactgctgtgtactgacaccatgaccaaggcaaatctcacaaaggacaacatttaactggggctggcttacaggttcagaggttcagtccattatcatcaaggcaggaacatggcagcatccaggcagacatggtgcaggaggagctgagaggtctacatcttcatccgagggttgctagcagaatattggcttccaggcaggtaggattgaggctcttaaagcccacacccacggtgccacacctacttcaacagggccaccccttctgatagtgccactccctgggctgagcatatataaaccatcacagtgaggaagcttctctgctggtctgtgagcacgcagatgtctctcattgcctaggattttcttcagttttgacatcctgatcccagctgccctccctacctcctctccttccattcccagcctcacatacccccatccctcttccctcttcagagaagaggaagtcccccttgaagaccaggccaccctggcacataatgtcacaataggactaggtgtatcctctctcacttagaacagacaagataatccagctaggggaaaggtggcaggcaagagagtcagactcagccaccactccagttgttaagggacatacatgaagacaaagctgcccagctgctgcctatgtgtagagggcctaggtccaacccatgtgtgctctttggtggttcagtctctgtgaggccccaagggcccaggttagttgactgtgtaggtcttcttgtggtgtccttgacccctccagctccctcattccttccccctactctttcagagggatccctgaattccgcctaacatttagctgaaggtctctctgcatgtgtttccatcagctgctcagtgaaacctctaagaagacagttatgctaggctcctgtctgcaagtatagcagagctatcaggaatagtgcacttaaattaaaaaaataattacatttattaaaatgtacatgtatatgcataaatgtgcaccacagagtacatgcagaggtactcggagtttctgggtactataaaaaaaaaaaaaaaccaaaaaaaccaaaaaaacaggctgagcaagccaaggggagcaagccattaagcagcactccttcatggcttcagcttctgccccaggttgctgcctctctctgtgtctgctctgccttaccttcaggacagactgagccaggactcttccctaatgctgcacttggtctgagtgtttatcaccgcagtagggcgcaatctaagacagtgtgcgtatgcataccgaactgtcccatccaggtggagaaggtggaagtcgatccatctcagtttggagatgagttagtggtacggaggttcttaaatgaagagatagagaattatacaatgatacttcagtttcaagagaaatagtgggactggcctaggtaccctgagggtaggggcagggtgtgctgttctgaaccctggagggttgcctgttgttaggtgacagatcttctccctgtcatgctttctcttccagaaagcttgccacagctcctctcccctctgcagtcttcctcgctggaccgagagtgtcactgtgaaactgacttctccctcctctttcccagcaagctcaagacaaccttgatttatcattcctcttaccttgatttatcattcctcttaccagtgcctcgtgacttccggcatacctcgcctggcctagcctatgtgaattattttggtaaagctggctttgccgtcactgtgtagaagccatccttgccgatttgtgtttccctttttgttttgaagatgcccatgtacaaacaaactggatttaatcacaaggcatatgggttgtgaaggtttccagagggaaggttttgatttagtaaaagactctaagctgcaggcattttcctagctgggaaggatggaaccttttaaagaaggagattttatcagggtatccggatataactggggacgtttctttggaagggacactagactcttgcctctctgctgcctcatctcgtggatgtgtgaagcagagtgaactttcctcctgaagttgatgattagcaatagaaggctgaataacatggattatttttatgttattgagtctaataaataactggattccataagtaataactatcagttttcacttcaatgtataacgtaatttgggagaaagataaaattataactcaagtgtaatgttgttgttttctttttttgttttgttctcttgcttttgtttttttattttgttttcaagacagggtttctctgtgttgccatggctgtcctggaactcactgtgtagaccaggctggctgcctcaaactcagagatctgtctacctctgcctcccgagggctccccccattaagtcaggagaatgctgagtataggactggtggcttccctttcctaaatgaggtattggctgtatgctagtgtggccttcagactttctgtaagatttctggctattttattcagaatataggagatagcatagacctcactgatttatgcagtgaaaagtaggttggagtattgagggtccttatcttctatttattttcaatgagtcactctatctttttagttatatacatcatagtgcatggtgactttccatgctatatgacttttcttgaaagggagagggagaggggagtaaaaaagtttcattttccttaggcagcacaccatagtcggttaaaagacgattttgcctaagtctggcttggtaaatcagcatgtttttgtggggttaggtgcaggagcatgggtgagatttccttatgtgtgactgtctccacggcaactgtgtcactcctaaagctcacctcaatgtgggtgagcattcctggagctctctcccatgcttacaagaaagtacaaaaatacctcaacacagatagcagtacgtacctagcactcatacctagcagtacttaccacatctgtaactttggggacagggaacacagatagccgtatgtacctagcacacatacctagcagtacttaccacatctgtaactttggggacagggctgtgaagcttctcccactttctgagtttctagaactttctaagttttggtggcttctgaaatcttatgagttgccttcctccctcccggagggagtgcctccattaatcannnnnnnnnnnnnnnnnnnnatttctggctattttattcagaatataggagataacatagccctcactgatttatgcagtgaaaagtaggttggagtattgagggtccttatcttctatttattttcaatgagtcactctatctttttagttatatacatcatagtgcatggtgactttccatgctatatgacttttcttgaaagggagagggagaggggagtaaaaaagtttcattttccttaggcagcacaccatagtcggttaaaagacgattttgcctaagtctggcttggtaaatcagcatgtttttgtggggttaggtgcaggagcatgggtgagatttccttatgtgtgactgtctccaaggcaactatgtcactcctaaagctcacctcaatgtgggtgagcattcctggagctctctcccatgcttacaagaaattacaaaaatacctcaacacagatagctgtacgtacctagcactcatacctagcagtacttaccacatctgtaactttggggacagggaacacagatagccgtatgtacctagcacacatacctagcagtacttaccacatctgtaactttggggacaaggctgtgaagcttctcccactttctgagtttctagaactttctaagttttggtggcttctgaaatcttatgagctgccttcctccctcccgggggagtgcctccattaatcggacttttaaagcatatttgaaaacactatatagaaatttccagttatattgttgcagggttccaaatggtcagagttgatgtccctaccactcctcttttttttttttaaagatttatttatttattattatatgtaagtacactgtagctgtcctcagatactccagaagagggcgtcagatctcgttacagatggttgtgagccaccatgtggttgctgggatttgaactccggacctttggaagagcagttgggtgctcttacctattgagccatctcaccagccccttaccactcctcttaagatgacaagctgccaatcatttctgccaagatcttatgtatacaagagactattgaggcagctcaatacattggattaagagctgtgtctttatttttattttaaaattcnnnnnnnnnnnnnnnnnnnncatgcttacaagaaagtacaaaaatacctcaacacagaatagcagtacgtacctagcactcatacctagcagtacttaccacatctgtaactttggggacagggaacacagatagccgtatgtacctagcacacatacctagcagtacttaccacatctgtaactttggggacagggctgtgaagcttctcccactttctgagtttctagaactttctaagttttggtggcttctgaaatcttatgagttgccttcctccctcccggagggagtgcctccattaatcagacttttaaagcatatttgaaaacactatatagaaatttccagttatattgttgcagggttccaaatggtcagagttgatgtccctaccactcctcttaagatggcaagctgccaatcatttctaccaagatcttatgtatacaagagactattgaggcagctcaatacattggattaagagctgtgtttttatttttattttaaaattctttttaaagataaattcatggcatgtactctaggctgatcttaaaagtgtgatcctcctgtctcagcttccaaagttctggaatcaccgaatttttaatctatctcagaaaccgagtacatttctacattcttagagctgtagaagtcatgggtgttttgcaacaagatggcagagatgtgttcgttcctcttgtgcaatattagggaacttgaaatgttgtttcttgagctcacagttaatttcttggttaaccacaaaagattttcaagggaggggtagagttttctgtgtagttttgatgctgtgattctgtgacaggaagtaaaggaagctgcagaaatgatatgaaaagcagtgaaataataggtggcctaggaaaggctgtggaggagaaaggctaagctctggtttgcaccatgggagagcatttagttgagaacgtaagtgttttaaacacgttcatctgacagctatcgtttcgctccctttggtaagcagccgtacctttaaatttcctttgacgtctgttatttcacttgaagtcttgagtttgaaaagttaggaggtgaagatgtcgatgctatttccataagaactttggatctttcagagtttgtatgtgttgttggtgaggggagactctgggcttagccacacttacatctgaagttcagtgttgcctgtatcttagtcaccttgggtgagagtctcctctctaccttatctgtgaagcagggtggctgcttacctcataaacactgctatgaagatgaaatgatgcagaccaggcagtcagcatgcaagtcctaacattgccagtgagctcttacactttccacacttagatggcaagacggtgcttactgagccccgctctgtagagcgttagtgctttctatagacttcctctgtatcagcccattttgatgtataacagcacgaggcaaggaaactgggggaaccagggcggtgttcaggatatagttgatggtacaacctttgcctaacagcctaagatatacaaggacctggactggatctccaccagaacatacacacacccacacaccctgcacgcacccactaaccactaaacaaaaatcaaaacaataacattaaaaagatcctttgctacacaaagaaaaattgttaagttaattgttttttttttgtttgtttgttttgtttttttttttttttttgtctgctgtaacaaaatgcccagcaaaagcaacttgaggaagagtttattttggcccgtagtgtgagagggcaaggcagtgggaggctgacgcagctgttcacgttgcacccttagtcagaaagtggacgtagatgttgggctcagtttgctttctctttattcagccttgcatcccaacccatagaatcatgcagactcaaggtggctcccgtcatagcagtgaaacatctcagaaacttctgacaaactcgtttgtctcccagcgatcactattctatcaggttctggttcatgatcctagctgaccatcataccggagcagctagacaatctacggtctggtgttaaaggtgcagcttggatacagttataggtgctcattttaaatggaagaagagtaactttcaagagaatcgaggcaatcatgtcctcccggctctggtgaaagataacgaaggcctgtgggaaagaaggttggagaaactgaggcagacccatttcagagggagaattaagactcctactgcatttgagttagtgcccaagggaaggggaagctattggatcaacctagacagactaggtctgaagttccttcagatatgcagtttagatactcagaggacatgtgggtcagtggccaagagtgatgttttgagtggaactcttgcttttcaaatagtgttttaagggtattagaggttactcattggatttagcacaggagggctaaactgagaggaaaaggaaagagaccagaaagcaagtcccccaaagcaggaatactgaaggagcaaaggaaaggattagtacgcctggcagacggggaggtttcctgggaatgaagggaaagtagaggggatttcagagaataaaagaccttggcaatatctgatgtgttgtagccagcagataggttaaatgagaactttggggggactgagaaatggctcagcagttaagaacagctgctggtctttgtgaggcccctgattggtttggttccgagcatccaaatggcagcttacagccttctgtaactccagttccaggggacccaacacactcttctggcttcagtgattaccagacacataatacacagaatacatactgacatgcaggggaaacaatcgcacataaatactaaaaattaaaaaaaaagagagctttgaaaagtaacattaaccaatttggctatcaaacttctttaaacattaattaattcagagtgtacgtttgtgcacataccgcgtgtgcatgtgtggaggtcagaggacaatttgtgggagtctccatcccgtctaccatgtgtgttctggggatagaacttgggatgtcctgcttggtgctaagcctgctgatttgctgagctatcttgctgacactaagctattttctagtgtatgaaaggatattttgtgtggtatattgggtattgaaattgggaatataggaaaaaaaatcagacagaatagctaagttttgaatttaatttttaccaggagaactcagttttaagtgtacctaagggctaaatgtgacaaaaatatgtagaaaaaataatctcaagactaaatatagttgaccctgaaatagccttctggaatgtaggtggctctcagcagatatgctgacataagtccttcagttttcctcagtttctttccatataatttgactgctgttaaggtctttcagtgccagggtgggatggaagttctgttcagcaaatcttcagttaaaaagcagttccttctcacagagtggctcactagccagctatactaacttcctttgcaaactctggcctgtactgcttaagaaagcactctgtgaagttttaggtgtacttaaatgtcccaaggcatgtgctcacctcagttcttatattttgcctctgcaatccttacaaatgaactaatcgaggtcttggggaatgagtgtatacattagagtgccctctcgtaagtgcagcgcctcccatacttctttagagcaactatcattgttccaatatttgggtagcagcttcctaggttttctatattgttttaattctcaagtaccatagttattatatcccaaaatactatagttaacattttttcctgttggttggttgctattgcttatttgttttcatgacatagtttctctgtgtagcactggctgggtgttctggaagtcacacaatatttagcttttttctgtttttttttttttaaggcattttattcatgtttttaaggtatttgtcatctcagcatttctggaacattgcttctcccgtttttacatcatctgcaagaaagaactagattctttatcttgcagaatttctcaatagattttgttgattgcactttaacaaggcctttctgtctctacttccagtaagaggaaaacagacttttgatttgcaaaactctgtctatggagatggatgcctgaggttcaaatcttccaaagtcaaccgctctagatggtcctcactacaatagcgccttttaagaaacctttctctacagcacagggaagtcaagcgatgtacaaatccacaactttaaacatatcatgttttgggggcatccaagtccgctagctgtttggaagtgcacagttaattacatcttgtacttaccatcctgaccttgggagcattagaatattcaaccatatcccatacctgttaactgtcctttgccctccactctgagcccaacactactgaatttttggtcaacttgacacaaactagaatcaccggagaggaggaaaactcagttgaggaatgacatcctttggattggcctgtgggtatatctgtggggcattgtctgcattcaccattgatatgggtgatgttggccctgggcaggtggtactagatctcaaatgaaagcaagttgagcaagccagaggctgcaagccagtcagtagcattcctctgtggtctttgcctcagttattgcctgggtccttctttggcttcccttgatgttgaatgtaatatgagccaaaggaagccgttctcctcccagttgcttttggtcagaaagtaaactaggatcctaggatactctgctcttgtgtaaaatcgactttcctttttttaaatctcacacaaataagctgtgtggatttaaatttgtatttaaattcttgggcttggcgttttgcttaacacaattttctctacatttatgtgtttagcattctgatagcaggagagggagagaaaggacatttttgggaagggggaaatgaccttttgtaagggtaaaccacctgtaggagacatgtgataattttatggccatataggctcaggcatggtgcaagaattccctttcgatgagtgttccttcctcccaggaggggactttagggcatcaggatttcagtaactcaaatacttttcacacaaaataagttttgtattttattattcttctggactagttcaggagtatatatgtatatttgaatagccatattcttcttagtatattacagttttatttctgtgataaatatattggagtaacaatgtaaatgaggcaggagtgatcttgcctcgggtctgggaggtttcagtgcaccgttctctggctccattgtttctggatcagtcaggcagagcaccacaatagaacaacattctaatatgtcggaatgaatttgctctcctctttggagtcaggaaatggagatttagaatgggctccaggataaagtttatattcccagggcacagtgacatactctcaaagcccacatttggcgacatagttactccagcaaggctacatctgcccaaacagcaccattaactggaggccaaatctttaaatctctgagactacgtggactatttatcatttgcgtcaccgtgagtatcatgagaattcttaggaagccacctgatttgctgagtcttcttggcagagtaatagcagtgggttctcacctcgagctaataactgtgtctggacacacacaggttcttggacctgataatgacaccaagtaaaggtttcattttgaagagtggcccctacatcttgtcatggttacgcccatgacatctgtgcactgctgtactgcttgatatatcttgccacttgtaattctagctagcagctcccacagctagattgatttcttctctctttcaatagctttcatagcctcttcagcactataaaagttagccaatagcttagtgtgaagcttccaggtcagtcccagcttgatttcctccccacaacccctcctgcccaacattccactattcaaatagatgatgtctttcacaataggtttttattaagttctggagcataaccaaggacaatggcaatagaatgtcatttgagggtctttgtgaccttactggcttaacaacccagttataagagataagttattcctcacatggaccagcatcctcctaaacagagaaaaacaaagaaaaatcatttctaccaaaatcaggaataaaacaagaacatgtctcctgttcaacatagtccttgatgttagtgttgtctatgcatgcgtgtgtgtgtgtgtgtgtgtgtgtgtgtgtgtgtgtgtggtgtgtatgcatgcacgtgtgcttctgtgtacatattgatgtcaagtgagagagataagagataaaacaggatggaaaggaagaaggtaaaagtatccttatttgcagacgatgtgattcttacacataaaggatcataaaaagactgccagaaaatgacacttgataaacccattcagcaatgtagcaggactcagaattaaaacaaagaaagcagtagtcttttttttttttttaaagatttatttatttattatatgtaagtacactgtagctgtcctcagatactccagaagagggcatcagatttcgttacggatggttgtgagccaccatgtggttgctgggatttgaactcgggaccttcggaagagcagtcagtgctcttaaccactgagccatctcgccagccctagcagtagtctttctatataatgacaatacacacaccaagaaaaaccttggggggggggggggaaacaatatcattaacattagcttataaaaaccttaaaatatcttggaataaatccaacccaggaagcaaacaactttaatgcagtgaaaattcgaagtcactgaagaaagaaatccaagaagatgccaggaactagggagacttcctatacttgtggttagtaggatgcagattgtgaaaatggctgccctaccaaacaaccagtctatcattcagtgccatccccatcaaaagtcaaatgcaattattcaagaaactggaaaaaaaaatcttaaattttctatggaaattcaaaagccccaggagagtcagcagttccctgtcattttatgaggacagagaatgacaattcaatctgcacatcttgccataactgccaagactatctgcttgctgggcagagttcagtctgcgcttcagtttgagcctgccagtgtgcggtctagcatttggagtatacctctcagtagctccttgctctgcatcactcagctcttgagaattagaggagacagatatgacagccttaggcttttgtgcctttattaaagttgcaagaaaacttttcttcagctttgcttatgaaggagagtaaggaagggagctagaacgaagagcattaagtatctgtagctgtgggctggcaagatggcccagtggttactctttcagaggtcctgagttcaattcccagcaactaactgcatggtagctcacaacattctgtaatgggatctgatgccctcttgtggtgtgtctgaagacagctacagtgtactcgtatgcataaaataaataaaaaactcttcttttaaaaatagtatctataggaaatcactgttaagtatttaaatggtttgtatatatcttgtttctataagctgtatgtgtgtgttcatgtagtgaatttgcctacaaatgtaatgttcataacataagtccttgttcttgtgtgttgagcagaaaagtccaatgtatcagtagaagagaacgtaattttggaaaagccttctcatgtggaactcaaatgcgtgtacacagcaactaaggatttgaacttgatgaatgtgacttggaagaaagatgatgagccccttgagactacgggtgacttcaatacaactaaaatgggcaacaccttaaccagtcagtacaggtttgtatagaagtgtacagaccgccagccaccgccggtttaactacacgttttgctattcactaaacatttttttccttctgcaatcatttaaatgttctgctaatattctaattttcagaatttctaattttacagaattatttctgttttaaaattttgatcgatggctgtcttcattttttattaagtattctgggaaataagcttgtattaataactctaattatctctaggttcatcgtttttaatagcaaacaattgggaaaatattcttgtgtctttggagaaaaggaactaagagggacctttaacatccacggtcagtatttataacttcagcattatgttcttcgatttctcatgtcccttgggttttaagtaattactatagtaataaatgtagatcagaggaaagaaaatcatttgcttttccttgagtatagtcttacctccccttccccacccccctttctttcttccatctttctcttttatttcttagtttaaaatacaaaatttagttcacgggccagctgccaaggttctcataaatccactatgtgccttaaattatttattaatttagccctctaatcttctggttttgagaacagtcatctagatgatgagttcctacatcctgatgactcagaggaccataaaagtctcatacacctcatgatgcacagtggtacctgcattttgtgccattgagtaggggcatttcaaaccacagtcatgtgtcttccagcgacagagatgcaattgtgaactgcagtgttgggtaatttcgccccctgtgttctttctaagcctgcatagtgtagtccaccacagaccttgggtgtgtgtcagactctcctcctctgaaccatacccaggaggtcacggcactgtgtaagtaagcaagtggaacataaaaggcacacttttaatggataaattgactggactggcaatggagaggcgaatgtgctagtgtagagttttaaacacagcacacttaggcactgctaaatttaatttaaaagtctttctaatagccaggcagtggtggtgcacgcctttaatcccagcactcaggaggccaaggcaggtggatcttcagtttgagaccagcctggtctacagggctagtttcacgactgccagggctaaacagagaaaccctgtattgaaaaaccaaaccaaccaaccaaaaagaacctttttaattttatagtttattatatttaacttgtagctttttttttcagcttcttttttttttccattttttattaggtatttagctcatttacatttccaatgctataccaaaagtcccccatacccacccacccccaatcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcataatgtcgttccgcctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggaagtctctacatggaccatcctttcatctcagctccaaactttgtctctgtaactccttccaagggtgttttgttcccacttctaagaaggggcacagtgtccacactttggtcttcattcttcttgagtttcatgtgtttaggaaattgtatcttatatcttaggtatcctaggttttgggctaatatccacttatcagtgagtacatattgtgtgagttcctttgtgaatgtgttacctcactcaggatgatgccctccaggtccatcnnnnnnnnnnnnnnnnnnnngtctcccactattattgtgtgaggtgcaacgtgtgctttgagctttactaaagtgtctttaatgaatgtggctgcccttgcatttggagcgtagatattcagaattgagagttccccttggaggattttacctttgatgagtatgaagtgtccctccttgtcttttttaataactttgggttggaagtcgattttatccgatattaaaatggctactccagcttgtttcttcagaccatttgcttggaaaattgttttccagcctttcactctgaggtagtgtctgtcttttaacttgtagctttttattctgcaaattaaatttgtttttaaacattagttgacctttataacaatggtctaaaccacactttatagcaatctaaacattttatcacatttaataaaccttttggaccttcataaattatttggttagtaaagaagacactcccattgagtacattgctattgatgccgtctgtttactgaacttgtcctaccagccactcttcagagccacgctgttgttgagaagatctttgttcggaagcatgcccttggtggtttgctcacttttggctttggttttgttagtacagatttgctgatgagcagataattcggggtgaatgttcccatctcttgagaagaatcctttctgtgtcagggcccatggtgggagaatgaatcaaagtcttgtaaagtaaaagttttcatggaagttcttgattccttttttctcatctcttctccattcacccttccactggtaatgggaatgttgctgctgctgttgctgttgctgctgctgctgctgctgctcctcctccttctccacctcctccacgttggttcactggtgactgaaatggcagtagcattttcttcctttttacaatttttatagatacctagctatgacacatcccactcttcttcattggaaccaacaattagaatatgtgcctcatcattaaacaaaacattagaaggtctcagtgtcataataaagactaattatttgagttagataatcactttcatgaaaattccaacattttgtggtagattagtgaacgaccgtttgcaggagtttggtgaatggagtctgttgccatagtgattgctggccctttgtgtcatactcatttaccagtgatctgacacttctggagtctgagtagcttctgacaacataaggatgctgtgctcagggctcatctgtagcagaatggtgtgcttcctcactgtgaccatctactcccatgtcccttaccaagtcccctatgtactcacactcaagacttcttgcattttcttttaattatttctgcttggaaattgtaatatatcctcatggttattcacttaggtctttccagttacagaaagtaacatcatacttgggttccactgtgtgctttttatttagcttcttgcctctgttgtccgatttaacttatgcagcaatagtcacggtatattttcctcctcctcttccttcttctttcatttctttcatccattcttcctttcttttccttcctgttccctcccccttccctcttttccttccaatgaacaatgaccaaaacccataggttcttaaactatgtattttaaggttgtcttttccagttttgtgaagagtggcattggaaatatggtaaggcttgtgttgagtctgtagactatttcggtcattgtcctagttcgggttttactgctgtgtactgacaccatgaccaaggcaaatctcacaaaggacaacatttaactgggactggcttacaggttcagaggttcagtccattatcatcaaggcaggaatatggcagcatccagacaggcatggtgcagcaggagctgagaggtctacatcttcatctgagggctgctagcagaatattggcttccaggcaggtaggattgagggtcttaaagccacacccacagagccacacctacttcaacagtgccaccccttctgatagtgccactccctgggccgagcatatataaatcatcacagtcaggaagctactctgctggtccatgagcacgcagatgtctctcattgcctaggattttctccagtttctttcctcagtgtcttcccgttgtttttcgtttgtttgtttgtttgtttgtttttggttttggttttccagtgtaagggccctccaccacctttggttagttctagtttttgtttggttgtttaaagtcattgcaagtgagattgttttgttgatttgatattgggatatgaaaagctagtcattttctctattgatctttgtgtctgctcttttgttcaagttattgatcagaacttattggagtgtacagggtcttttaagtcccctccccgcccctgctcaacttgtatttccttcatttcttcctcttgttttgtttttctagatagggtttccagttcaatatcgaatgagagtgatcgcccttgtctcattcctgatttttagtgggatgcttttgagttttccatttaggatcacaagaggctttggaacaacaaaagcttcctgtatatattgtttttatcatggtgaggcatctgccctgtattcgtagttcctttatggttcttatcacagtgttgaattttgtcgaagaaatgggacaaaacaagagggggtggaatatgtacagtatgagagcagaagaaacaatttgaggggtgatagaaggagcctagcaagagagtatgtgggagatgggagagaacaacaacaaaacaaacaaacaaaaacaataaaaaccaagaccctagagtataatgctgtgaatgtacaatataatcatctatgtatcccatccccgatgacatgttgatgggcccagtcttgaacatgtctgctgcggaacccagaagttatgtgatttttatgagaaacaattgtcgtggctagaaggtagcaggttatagcattccttcccattctctggcttttacattttttccattctccttctataggagagccatggagttgctgatatagaaataatatagtgctggtaacacaaaggtcacttatttttggcctttggccagtgatgagtctctttgccttttaaaaaagaaaccttgggctggaaagataactcagtggttaagagctcggcctgctcttccagaggttcccagttcaattcccagcaaccacgtgatggctcacaaccatctgtaattggatctgatgccctcttctggtatgtctgaagaaagtaacagtgtactcatataaaataaataaatctttaaaaaaaaaaaggctgagagcagcattgatatgtacatatttagatgtagatacttagaaggcagttcgagaacatgtgtgtttagtatggcaattacaggttccccctccagggcctctgacttcccagccacaggatgtcttcctgtctgtctgtctgtctatctatattttggagacaaggtctcataaagcccagactgttctccagtttgttatgcacccaagaatgatgtttcccttttgatcttcctgctttagcatcccaagtgatgacaggcatgtaccaccatgcttacctccattccacgttttaatcctatctcttagggcttcaaaaacctgttactttaaacgtttgcttgaagcaatttaattcaactccttaatgcccacttaacactaatgtcacttgtaagtatgcactctatcctgcagatacttatgacattaataacctgggttgttctggagagtccttgctaaaaataacagttctctggaatttaaatcaatttataattggttattccttggagaaataattttatttgaggagactttaaaggcatctataccacaatttatttcatagttgttatttcattaagtctgttggtcttatgtaactgtgtgcatttttgtaaatatcatctacatggcttgcttatggttttccttagagagaatggtctttatctacaagttaatatgtataaaaagctagtttcacgttctctcatacgttgagtgagactattctttctcttccccattttattttacttttgctgtaaaactgcttgagtcaagcccagctcgtgaacataagaccttgggacaatttataccgtttctgtcctgaggggagctgatgtgttactgtgacatggtactgatgagtgtggaaaaatatcttctgcgacccagtccgagcaggagggcaggagagctgctaagatgttgagaattgtgtgccgcccacaaaggctggcatgggtgtttcttagtggtctgtcaaatagtatgagcaaaagaaagaagaaaagaggaaaaaaacccccaacttctgtaaaatgtattaatttcaaaaatctcatgacaagctaggcagtgatagtgcacacctttaaccccagcactcagcagccagaggcaggtaaaatctctgagttcaagaccaacctggtctacagagtgagttctaggacatacagacatacacagagaaaccctgtctcagaaagcgaagacaaatctcatagtagataatgcaaaactttaatgatgagattttggtaatatagcatgtattgagcctggccctggttcagtcacctgccttccctgagaatttccctaatagcctgactgtcacccatagttgccttagctgcctttggttccaatgataatgtctagttgcccttgaaatgagcatgactttgggccagtgttctagcctgtgaaggtacaagctcaaagctttatttttgtaacttttggacagctatgactttgactaagtagattcaatccaagatttccagatgctactttgagttagaaatttcaccatccggtcctgaggcctccccatcccccatgtgtccaactttactcaaaatttcaaaatactaagaagggacattagaatactatcgccctgcccttgtatcaatacgtgtgtttagacatgagtagtagcccagaacaaactgatcctcagtatagttaaaaaaaactcctaggtccgaagtggtagcttcatgcctttaatctcagcactctggaggcagaggcatgtagatatctttaagccagtccagtttatctagtgaaatctaggccagccagaactacccagtgagtccctaactcatttcatatatatgtgtgtgtgtgtgtgtgtgtgtgtgtgtgtgtgtataaaattcaattctctacggctattgatagtcacactgagccaagcagagatggtgggaagccgggcagttttagaaaacatatgttgttcaactaagttctaaatttctgtttgacggttgagacacaaaagagagtaagagagaaaggattttgttttcaacacttgagctgctctctgtttctgagttgtcacccgatgtcactgacttgggctgtagccttttcccagcattcagatgggaaaagtgtgaggtcacagtcatggcttcttatccagctcttacagattgcccggttgtcttgactagccctcctcgctgccagttatgtgtcctgagcatctccttcacaaagccttactgaaaaaacagcagtttctcctgttgtggaaattaatcccaacccagggtttctacccgtgttggaaaatttagttcccagattaaaaacacacagcctttatatttacaccaagccttaaacagtacaaaagctgggcagctgcctaccctccatgctgttagaatctaccttcctgttgataaccccgaattattacttactatgtttcatctgggatgctctgaactcttaattgtccagcccctggggccacagtttctttactcttaacccatggcagcttctccttcccccctgcaccttcttctcctcatggttcctttctgacccccaagcctgggaaacctcaaccccacctacatctcttctgcccagctactgactgctggcatctttatttaccaatcagaggtaacttgggggccaaggtatatgtgtgcagactcatctctggaacaaccaggtcttgggggcccacacttagcattaagaccaaacctcgacatcctgttccctcaatctctgtcaaaacttgtcaatcttttgctcatatttcaacacatcatttcctgctaaagcatggcctaattttgagacggaagcatggcgtgctgactagttttgtgtccgtttaccagaagttagaatcattttgaaagagaatacctcaaatgagaaagtccccctccacccccaccagattggtttgtgggcaggcctgttgtgcattttcttgattgttggttgatgtggaagggcccttttcactgtaggtggtgttaaccctgggttgttggtcctgggtgctgtagaaagcaggctgagaaagccatggggaggtagtcagtaagcagcactcttccatggccttggcaacagttccttcctttagcttcttatcctgctctgagttcttgtgctgatttctcttggtgatggagtatgacctccatgatgagagttgtaagctgaaataaaccctgccttccccaagttgcttttggtcatggtgtttaaacacctcaataagaaaccctaactgaaacacgtgccaggtttagaaaatagagtatctaaaagagaaagagcccaggagagcaaacactgaccctgaccaatgctgggcttctgaatttgcccttcaggacgctgttaacttaaccatgggctgagcctggcacaagaagtccatgaaccaggactctaaaagaacctcccatttctgctctccacctgggccttgagaactgtagctcaattccctctcaggtttggaggggacctcgtagcttcagaaaatggtgaggcaagtcctgatctataggtctctaattggtacctcttctaaaatattggggggctctctatgccctagagtaacccatcagccctcaaacatggtgctaccataatagagccgtacgtaatgctgcatgcttcgtgaagacgtctggtgaggtggtggtgtgtgtgcagctgggagcatgagggtgctttgtcaggatttctgattgtagcttagtcccccgctttacagtctcccctcctcacagcaaaaccacagattgggaaatgtgcataaaaaggagccaaatcatgtgattgttggctagccaggaatacaagccttgcctgtattatagtgaatctaatctgttttctacaacctgaactgtgcctagtgttgatgactcagagaagaaggtgtgagttcatctgagtagggggaaacagagtagatagcgatggtgttatttatttctctaaatttccagttctagaaaacagatcagccagtcagtgtactaccataccagcaagtattgtcagttctgttctttagggccagactcgggagtgttgaatgaaagaaaggaattgacgtagagtcttacagagacctcggtccatagaccattgtccagccttaggcagctcccaccaccagtttttagtgaagaaattgatcctgccataagaaaaaaacaaggcagaataaaatgttctaggattctgcttagttgagcctttaccgttttgacatttaatcattttcttctcctctataacttaaaatatatttgttatattagtatcaagacagatggtctgctcttccccttggatctgggaattgcttccagtttcctcataatggttggtttcctccatgttggagccatctggatttataaacgagttctgaggtgattgcagtagacaaaagatgcgggactaagcatataggagaagcctgttttgaaggctgcacacctatctgagagatgcctttccccttagccctttccacctaaatccatttagattaaaattgctttcttatttagttttttcttttagttttttttcttttttttattatcaagttactgtctgctttttctctgtattttctcattaaaaactatatgttgtaagggaggtatttcttttttactcttaggattcaagtatcccttctgtttcacatactacataggtctagaaggaaggttgttctgatctttcaagccagctatgtttctagttattggccaggacctagctgggcatcctggtttaaatcattaaaactcctgctgaaccgaaccgcagcacacgtgcctaatcttagaaagtgcttggctgtgtggcctgaactgtagaagagtctgtctcatggcttctaggaagagttgtgtcctatatggtatttggatggactaggggtctcctcagggtctggagctaatgtttcttccctcttctcctttctctcctctcctatttattcatctctcttcagcatctccctttccaggtggtctgggtgaatcgtgcagaaactctcttgagcgttcgtgagtgacttcaggtagctacagagctcttaagatgtacgagcgtatacggtacagccgtcctccctccctttcctctgtagagctcatttctcctctgctccgcaaaggctagctgacctaaaaaccacaaaggagaaaaattatcttacgacggttgctaatggcactacatataaagggcacagccattaattacaggaaagcgtgattaagggagctgtatcaggacataatccaataaaaattggaatgttgtgacagttatcatggactgagcactttccatttggtgaacccttgtttagcccaaaaatgccctacccatatgtatatcaaggctgtcacgtatgtcaatttttctttcctggttctaaatcttttcttcatcattgcattattagagcagatatttaaattttaatttttctgactttgggttccttggcattgttactaattgtatatacttcagactttcttgtctaagagatttaccacaattagcgttagtatgttgttttgaaatcatgtggtaaactatgtttctaagtctcttgtttgctgtgatttcattttcctcccgacagtgctggcgtccagtgtagagctttgtgcacactgggcatgccctccacatcgtgcctcatccttctgccccttgactttcctttgtccctttgtggtaccactttctctccctctgctggctctttacaaatgtgcatcaattgagactattttctagcctggaaatgttgcttttttgttcatgcacttaagggttaaagctctgaagagactgttgcagtatctcagtctgtgggaggaaagaacagctcctttttatttgtttcaaacatttaataatttgttgcaaatgtggaatggttagagttctaatcactagaggctttccttccagttgtacaccggcagatgattctactgaagtcatccatctgctactattagccactactgcctatgcctcctaaagactacaagttggtttcattttatgtacaattaaaattgcataaagagaacaatccagaaatgacgtgggaaaaatgtccataaattgagtacatttgttttgcttacacagtttccataatatacatcttcctgatttttatcttagtacccaaagctcatgggaaaaaaaagtcgttgatcgcttacgtgggggattctactgtgctgaagtgtgtatgtcaagattgtcttcctttaaattggacttggtacatgggtaatgaaaccgcacaggtaagattgtatttcctggggctagtgagacagatcccttagtgagtgtgcttgccctttaagcaccaggactagagcttggatgcctatatccatgtagagagtgagacacacttgtaatccaagcattggggatgcgagacaggacgatcccagaggcttgctggcctcccagtcaagtgttgctagggaactccagattcaataagagactcgctcaaaaaaccaagtggattgaagtttcgaaggcactggatgacagtttcgaaggccttcatgtaatccacacacaaaaacatgctcacacccttacagacaggtacacccacatgtaaacaaaaatgacctttttttccctctgatttgaagaaaaccaaacaagaaatcttttagttcataagtaagagtatagctgacttaaaattcctcggaaaactaatatttctgtcctaactggtaattaccaagtaaccacagtgataaatggagctgtccttgggcattctcgggatatcaccatatgtgtgaagacactcttagtgctttattagctcatactcaactgttttttttttaaaggttttgcaatttattctttgaaagaaaattctttgaaagaaaattaaaatttattttcagaataggcatgatggtttgtgcatataatcccagtactatggaaactgagacaggagggttgctctgtatttaacttagaccaaagaaatgaaaccatttaaaaccaaactagccaaagctgaatagcaaggccctgctacaaaacaaaattaaaattaaaaaaaggagagaatccttgcctggtgtaggggtatatacgtgtagtcccagatccgagggaaggtgagcaggagggtcgttgggttttcaagccatggagagagtttgatggtatctcagactctataacaaagcaaaaccaaaatattctaacctagttgactaggttagaagtaagtttaataaaaaagcctcactttttgccgattactagagaaacagaaaacaaaattccaggttctttttgcagtttgtctcctgaaatatctgacacaggatgcaatgtactatgaccatttaaaaaaaaaaaagaagggcaatttggtcacttaagcttaggtcttggtttctcttaggtcattggccttttagggcactgtagacattggaaaggagtggaatgctgcatcttaaggctctatatatccaagacaattgacttcatagagctgataggaagaaaacagtaagagtgtccaatgagtaaattatcgttggcttcctatccactcccaggttgccacaaagaacttgaaacttgggacgtgttactcggggggtgctcttatcgtgccttggtgctactgagtattcaaattaaaatcctattgaggaaaaaaactgtaactctatgtggagcacatgaagcaacaaatcttttaatgaggtgttaaattcctcctgaaacaaactggacactttggaagaaaggctgggaaaggaacatgtctaggtctctgataataatgctttagagcttcagaaaatgcctagaggcagcttaaacaatgagtcctctgccttttgtattattgctgattaggacagggtagctggaaatgtttctaacacttaaattgtaaaaacaaatatccactgtggtatttggaatagatagtctaatgaatccatgcagatgtgatagcagacaaactggagcctaagtcaacttacattaatgtcatagaatgctcttctctgcatccttgtgcttttctgtatgaatcatcctttagacttggcattgagcctggtcataatcggctgtgagacagggtcagcgaaggggtcacaggtcaacattttgggtcaagaccatttcaagataaaagtcatcattattgtcagaattagctctgaactttcttaaacttcagcccttggatttattgtctctgattcatatggtagtttttgtcatgaatattataggccatgctgcctgtctacctagagatgggcaacggtcttttttttccctcttcctaaatacatttgcagagaattcttccattggataacctctgagaacatttgtatacagattagcgcttaattgaacatctcgggcaagtaagagagtagcgaaggcatcaaaagtcctgcgaattaaatttaatttaaatagattaagcatcacagcttctaggtatgagtgtgaggaaagcccaagagatctcagaagccagtcagcctgggagaaaaagaaactgggacacgaaaaggaggaattgggatctacgacatcacagagcgctggtcactggagctgctactgaccattcatgtagggaactagtgttgtcaggttactgttatatcttcagagaaatgactagaggcatatggttttgtgtctgtctttgtggacagatagtcatacatgagaatgaaaacccaagacgactgggcacgattttctgccttgaattctcacctaatagttgctaatgacgccctagccggctacctgtaggttaagacattcagggctacatcctcacagctgaataaaatctttttattcttgcttgctgctggaataccagaaccctgctaggactttaaaggtctgttttatataatgcctcataaattttaatatgcccctttctggtaaatggttttcttggctctttcagccttgctcagaattagatcacatgggacgtgcatctctttgcattatgtaagggttttaatgtctcctccttgccttaggttcccattgacgctcactcgaatgaaaagtatatcatcaatggttcccatgccaatgaaacaaggctcaagattaagcatcttttggaggaagatggaggatcctactggtgtcgtgccaccttccagttaggggagagtgaggagcggaatgagctggttgtgctgagcttcctggtgcccctcaagccatttctggccatacttgccgaagtcatcctcttggtggccatcattctgctttgtgaagtgtacacacacaagaaaaagaatgacccaggtgagagttcttactttttttctatttcgttatcacttaactatgatgcgtaatatggctttgctcagtgtagtcacttaaaagctctggggaagggctggaaggctggctgggtaaaagcagtgattaaataagtgtagaaatttgagttgaagtctgcagagcgtatgctgcaagcctctgtgatctcagtaaaggagggaggtaaaggtaggagatgtctagaagcttaggctaatcagcccgacatccacagtagaaaagagcaagaagatcccgtcagggtggacatcaaggccgaacagacacctgaggtcaggctgtgaccgtcatacccaggcactgctcctgcacaccggcattcacatgtgcaagccaaaaaaccatgattgattaatataaatggtattaaagagtgagtgtgcgcgcacacgcgcacgtcggggctcgtgcacatgtatatttagaggtcacaacacagacttgagtatcttccttaggaacgctgtctacttcattttgacatatggtctttcactgtactgatagtcacccattaggctggagtggtgagccactcagctctaggtctcttctcgtttccctgtccccgccctggcattcattacaaatgtgcattaccactcctggctttttatgtgcgttctgggaattgatcttccggccttgctattctgcgccaagtgctttatgactaagctatatctatctccatttcaaaactgttttatcaactcttcgagattcttaataaaagtcaaagctgcattagtgttgtttacaacccatatctgttgggatgagatatccttgataaaattgtcgtttattctgtatttattttctgatttttatactgttaaaaaaaaaaaaaacagtggcaggctggagatatgtctcagcgattaagagcactgactgctcttccagaggtccagagttcaattcccaacaacaacatggtggctcacaaccatctgtaatggatctactaacgtatctgaagatagctacagtatcacatatacataaaataaataaataaataattctttaacagtaaactaaacggacttcagtgacatcacagttttgaaaaaaaaaaaaaaagcctcacgttgccaaacagctcttgattagagatccaggtaaagtctggcatcgtgttgagagggagcagagggaggcatagctactgaaggcggcaggtctgccccttccagtgaatagtgttgttagaggcaggtccaactgaacgtgtaaaagtagcaccatgtccttaactgccatgtctttcctgtttgttctcatacagatgctgggaaagaatttgaacaaattgaacagctgtaagtattatttttttatttttttttcacttatacaaaatgtagattaattaagtaaaatgtttgtagttagaaacaagaagacaaaagatgctgatgtgcatgcagtttcctatatatatctgtgtgatgctgaagtttggtacacagtctacccctccatcacttactggtctgtacttcttgttttgtttatacaaacattttcataacgctactactctatgtaccttcgttgaattaagttataagtataaatggttaggacagacttttgtacacaataaccagaaatgagtattaatttttaagtgattctttaccttggttgtatttgatcactgatgaaaacattcttaagactataatattcttgaggctagagaaatggcagagtggttaagagcatttgatgctcttgcagatgacatgcgtttaattcctagcagccacatagcaacccacaacggtctataacaacaggtccagaggatttgatcttccctttgccttctggaggcatgagcttacaagtggaacacatatgtatgcaggcaaagcatccacaggaagaaaaatagaagaggaaaaaaatgagtacaacagtgtatgaagaaaaatagaaggggaaaagattgcagtgtattcatacaaagaaaaatagaagggaaaaaagagtacaatgtatccattgtaagaaaactagaagggaaaaaagattacagcgtatccataggaagaaaaatagaatggaaaaacattacaatgtatccatacaaagaaaaatagaatggaaaaatattacaatgtatccatacaaagaaaaacagaagggaaaaaggagtacaatgctcaggccaatggaatcccaatgcgcaggcccaatcagatcccccagatcagagccactaaggttggggccaggcatctgagtgttcttggtgttcaggttctgccgcactgaaaatcgctggcctagagttctgtgagaatcacattggagtagaacctgaggttagctgggaataaaatggccagggaatctgctttggttgggggatggtggaacacttctgctcttccaaaccagagaataaaggtgcccaaggcaggggctgcaatctgccagccagccagtggctgtgaaccaagggttaagagatcagactaagacagctgagaggtgcccatgaaaggggaggcctgcccaactgttaccaatctaatcccagatggtgggcatgacctgtcagccaattaaagagcaagaattatttggggcacataattcttattcttctttgataagagtcctcaagtaccatccactgtttggctgtgggtgtctgcatctgtctgagtcagctgttgggtagagcctctcagaggacagccatgctaggctcctgttctttacatacttgtagagtatttgatgtattcaaagaggcattttgacccagtttattcataggaggtaaaatgaaccaataagatatatgctctcaaaattataagttgaactttaatccttaaatctttttgatttttttttttttaagatttatgtattttatgtatatgggtacactgtagctgtcttcagacacaccagaagagggcatccaatctcattatggatggttgtgagccaccatgtggttgctgggaattgaactcaggacctctggaagagcagtcagagcccttaaccactgagccatctctccagcccatctttctgatttcttaaagtnnnnnnnnnnnnnnnnnnnnataagaacaggtccagaggatttgatcttccctttgccttctggaggcatgagcttaccagtgggacacacatgtatgcaggcaaagcatccacaggaagaaaaatagaagaggaaaaaatgagtacagtgtatccagtgtatgaagaaaaatagaaggggaaaagattgcagtgtattcatacaaagaaaaatagaagggaaaaagagtacaatgtatccattgtaagaaaactagaagggaaaaaagattacagtgtatccacaggaagaaaaatagaatggaaaaacattacaatgtatccatacaaagaaaaatagaatggaaaaatattacaatgtatccatacaaagaaaaatagaagggaaaaagattacagtgtatccataggaagaaaaatagaatggaaaaacattacaatgtatccatacaaagaaaaatagaatggaaaaatattacaatgtatccatacaaagaaaaacagaagggaaaaaggagtacaatgctcaggccaatggaatcccaatgcacaggcccaatcagatcccccagatcagagccactaaggttggggccaggcatctgagtgttcttggtgttcaggttctgccgcactgaaaatcgctggcctagagttctgtgagaatcacattggagagaattcaggttttgctcttttactgctctctcaagagtagaacctgaggttagctgggaataaaatggccagggaatctgcattggttgggggatggtggaacacttctgctcttccaaaccagagaataaaggtgcccaaggcaggggctacaatctgcgagccagccagtggctgtgaaccaagggttaagagatcagactaagatagctgagaggtgcccatgaaaggggaggcctgcccaactgttaccaatctaatcccagatggtgggcatgacctgtcagccaattaaagagcaagaattatttggggcacataattcttattcttctttgataagagtcctcaagtaccatccactgtttggctgtgggtgtctgcatctgtctgagtcagctgctgggtggagcctctcagaggacagccatgctaggctcctgttctttacatacttgtagagtatttgatgtattcaaagaggcattttgacccagtttattcataggaggtaaaatgaaccaataagatatatgctctcaaaattataagttgaactttaatccttaaatctttttgattttttttttttaagatttatgtattttatgtatatgggtacactgtagctgtcttcagacacaccagaagagggcatccaatctcattatggatggttgtgagccaccatgtggttgctgggaattgaactcaggacctctggaagagcagtcagagcccttaaccactgagccatctctccagcccatctttctgatttcttaaagtcaaaaagtgtgacaaccattcctataagtaaggatagttgtactgtgccctgtaatgtctgtttgtctgcctaactcctatcatgccctgtgtctcaggccactcctgtgtagttagtaggtcctgggactacatccattgttatgctgacagtggacttccagcatgtaatttaatttttatttccacaatttaccccacctactgcttctttccaacatcttaagaagcaatgtcaacgtgactcgatctataatataaaaaactgccttttactttaaactggaataagacacatcatgtgttccctcctttattacgttgggtccatcactgaaaatgtcatttaggtatacattaacagaggtattttaagatcaattagatcaacccttgctgtgatccattttagatactctagaatttagttaggaactattttttttccacagaaaatattttcatatgttatgtctgagatattttacatacactgtgttttggtatgcattgtcccttttactttcttgttaaaatgatttaaagataaaaatataatatcaaaaccaatgacttctcttaagaagagtaactcatttatttgattcattgtctgaccatccaggacatctatcctccaattgtgacgtacatggttaggtggctgacttcactggttaatagtaaccatgagccccgcaggcctgttcataatatccccactgctattcactgtgtttggtgactttctcattcagacatgcttaagaatctaaagcacatacttgtagttttgttctgatgcaagaggccaggtgtagcttccaatttaatgcagtagccatcaaattatgacatctgcctcatacaaacttccaaagctcctgactgttatcttgcttgcttcagaacaatgtgagagttaccgttacgtacatgcccatggccctactcttgcaagtctttattaccatgcctgtggcctgttaggtcctccctaagcaatggcgtatggaaaatcattgttcttaggcagaacaatgttaggaagaatgaattcagtatacactgacattttagagtttccattcagctatgatgtgcatactacactgacttaattttatacatggtgaacatctggtattttctttttgtttttgacacaggaaatcagatgatagcaatggcatagaaaacaatgtcccccggtacagaaaaactgtaagttacttctaaatgatagtaaaaagattatttttaatatattaaaccttactctttttctttttagagagatttatttgtttattatatgcaagttcattatagctgtctttcgacacgccagaggagggcatcagatctcattacggatggttgtgagccgcgactgagcaggcagtgctcttacctgctgagctatctcaccagccccaaccgtactctttttttttcagattcataaaagacccagttcacttgtccttgaatatacttgtttatacagttttaggaaaaatatagagttttacaaaaataatggtatccagggctggagagatggctcagcagttaagagcactaactgctcttccagaggtcctgaattcagttctcagcaaccacatgatcacaaccatctaatgggatctgataccctttttttttttttggtgtgtctgaagacagctacagtgtactcatatgcataaaataaataaaccaacctttaaaaaaaatggtatccttttctaccagagaataggtgttaataataatcctgtctcagcctcttgagtactgggattacatgcctgtaccatcatacacagctttatttcatggtctttatatttatataagtatacattttctcccttgggctagtttttttcaaaagtttcatgtaatttttaaattctcatctcaaagtttctgtagttttctgttttatttccttatatgtccatataattgatgcgatgaattcatccaccatagcaaacttccctaattgatttgtaattgtctcaattcagcgttgtttgaacttgctttgtccctagttggcaagctcacttgccaggccttctctgctttgctaaagtgatggtaagctattatatgaaggcatggccgtaacgtgttccttctgctttaactcaggactctgcagatcagtgaatacagaaagagcatctcgccctgggaagaagtacagcgttggagtttgtacttcagcttccttattttagatttttaaaagacaaagatgccctcaacgtgcacagaagtagctttatgaacaatatagtccatctcctacctaaagatgtactttcattttgtaattgctttccattaaagcaaggtcaattgtttcagctgtgttctgtgagctgtaacctagataataaactcccctctgtgggtacagggtggacaccagcaaaatcacttaataatccacaaataaatatcgccgaagatctgtttattaccaaagaatttattaaagagaaagcgtttgccagttgtcttaagtgtttgcctccaccagacatcttacctatagaagtatttatcacagttttcatgtgaagtgtatccagtgttgagtgtgatttctctaggaaatggaaagtatgctttcaatatcggtggctacactgcagtctagacactaagataaacttgtgctctataaataatggtgcaaagtaagggagtttaaatgcttgtgccatggccactacattaccagagcttctcatcttcattgcactcatttctgctctttctatcccaagccgaagagcttcccagccttaagtaggacattttccttgttctttgtcattggggtttggacttcaatagtcttcagaggccagatccacgttgtcacagtacaaccccgctcgctacctgcatgcctttgtggctcatggtttctgggtgcctttatgtgccatctctttcctggtaccatacctggctaaaatgcattcttagtgttttccaataataattcctttgtctagtatacaggaggactagtgcactatctttatgttgctgcgaatgccttagacttaacttcaaaattgtatctgagatactttatgaacttagaaccaaatcacgtcagaattttaatggacatggaaacttgtcaatggttttaaatgaaataaaatgtgccttggatggttggattaaatgtcccttgtgctgctggcttttgtgatacactgcctgggaaaacagggctacaaagagagaccaacttgggatgatagttaaaaacaaaaaacaaaacaaaacaaaaaaaaacatggttcttggtgattctgggattagaggttgggtaaaaagagtccaccggtttaaaaatggaaatgtatagaagtgtatgccttttgtgttagttatgaaaagtgtaagatttctggtggggaaaattatgtagcatcttatttgactaatgtttaccaatatttattagcaaaaataatacataggaagtagttatggtagctccttactgttgtctgttgatgaaacaaaactcagtattttctaataagacatgttaacggcaagtgtggatttttactgaactacaatgtacctcttggtggtagatgttaccttttttcccactttagttttattaggtacacatttgtttatccttaactcatgtttagtttgacaagctcatcttgatgctggcagggcaacagtataagtagcctttaaatcaaaggatttaaaacagtgtaactgtgactggatacatacaaaacccaaagaagtaactttaagaagtttaaagaggattcatctattccctttgccaccactatttaagttgaaatagttttcatgagaaaaataagctaccaggaggtaaaatgatctgaaatacttatgtaatactctgaaatgttaacaggcatctgtgctatttattattctaagaaagataagttatctcagtaacttggagtagaaaaagttgtcaaatatttaagttcatttttggcccttcagattctctctggagtacttctggaaaaattattccatcactgttagatgacaatggaatgcttctattaactagcttcacggtattgaagagtggattgtctgaggaccaattgtaaattgaatgtaaaagaaacaaaggctgaagcaggaaaactatctgagtttataaagtggacacctgggaaattctgttaatcttttcaatagatgggattttcagtgtaataattagatttaatgatgccataaactttccagataatcttaaatttgctttacgttaaaatatatttccttctgacatccgttttcccctagctagttagtccttcgggctcaaacctaaaattgtttacgctcttttcttccttattttgctggctattaatacctgttcctctgactctcctaatctttcattaatcctcagggcctctcccacctcgccttcaccagctgcaaggctatggtctaggtttccctaccttagcctcgtccatacctccatttttcatggtgcttctccgtctttccccttaaacacaaaagactcacactgatgtactcaggtcaggccaaaccttatgcagctcaattttgccatttcttagaactacgnnnnnnnnnnnnnnnnnnnnattctgacttagtgctgggtacaacagggaaagtgttacaggtgtcatacaatctatttggaggagtgtgaagcttagatttttaagaatcacttatacctatttttaggaaactaattttaattatgacaattaggattgcaaataaaatatggaaaagcaagttgtgttaagcccttcaagcgtgatacagggtacaccacacacattctctggtgggtttttgtttctattgcccttaaagtcccatggccactgtgtatgtcacacataaacccaatttttaccttttctttagtaaggtaacaaattggctctaattatacaggattttagtggttatatttcttggtatgggaagttgagatctggcatttgtgctcgcaaatccaccccccaagttctgtacagcacctcagaattcatttcagaatttaatattatcagcagcatgtcacaaaaggttttaatatattttgatcatccaaagcatacttcgtatccaactgatctgtagaagaagataccctgtcatgtctaccagtttgctcctggtcctcatctttaaggcacttaattctccccaccccaattccttgctactaaacttccccatatgaaaatgaatctttctaatcttccgaatgggtgaaaataggaagacttgatcacgttgggattttaagttacacatatttacacacttacgactttagtgccagcttattacctatgaatttattctactctctcatcaagagaaagacctgaagctatgtgccccttcttcctttgttctgaacctagataatgacacgttctattaatcaagttccccattaacggtgaccctcctattgttgagtcctggtccctgacatttgttgtatgtgccatgtgctaggcactcactcactgtgaaacgtgcttagaagtgtttcgttgaatcctcagtccatctcatgacataaagacttgctttctctttttcatccatacgcaattccaagtttagcgacgttgagaaaattgtccaagctgccccgatgcacatgatcagaactgaaatccacatttggcctcagctgacttgacctacgttgttcaactgctctgaactgataatttattacttcctagaaaatgaggatattatcaattatcttttgtcttttaggtagccagtcatagcacaagatccataatcttactgtagttggggagaccgccctgcaccccccaccccctttacccattcctgtggccccacgatggtgctggggaatgaacaccaatttaggactttttttctggcttgatttgtcagtagtaagcatgaatataacatttatcatccacacactgaaaatgaaaggggatactatatacagcttcactgagatgtggagagtggcccctccggtctcacatttagcccatggcgaggagctggcttctctgtggatgctctcacagtgctgcagcaaactggaatgattgatggcaatcagctttcatggaaataactgactgtaggtaaggcagggaaatcaccaatttcagtaaatgtcaggtgagtgccaccatggcgaagtgcctataatggcatcatttgcccagcttcaagttttatttaagtatcttcggatgacagggtttgctggcattcggaaagtgggatgcacgggatgtaagagagaagctggcggagaacattccgcttttgctgctgtgtggacgaactggctgattccttggatttgtgtatcttctggttcattgctgtagtagctgtgagtgagtgtgagtgagtatgtgtgtgtgtgagtgtgtgtgtgtgtgagtgtgtgtgagtgagtgagtgtgagtgagtgtgtgtgtgagtgagtgtgtgagtgagtgtgtgtgtgtgtgtgtgtgtgtgtgtgtgtgtccagaaagtcaagaatggcagattatgcctttactacaaaagttaactgtgtgtcgaaagtcacgtacaaataaaatgggcacaagcacttttaattccacaaatgatttatagtctgtatttcttactcctttgcacctcagtgggaacctgttatggaaacctgtttatagactgttggatatatatatatatatatacttgttttaaggcattttcaagaagaattacttatataattttcatttcagaatgatatcacaaattatttttctaaagtttatttaagaaacatgaaaatattagatttattacatatataattaatgataatgctatttaatgttaaaaaaaagaatagctgcttatattttctaccttttaaaatagatatttaagcatgtttagttttacttaagtcaaggaccattaattatatcttttaaaagttgtgtttcttttacatgtgtgtttaggttcttgtcactgactttctatattatgtaaatggcacacaattatcaatacaggagcactgtgaaaatgtccgtgttgcatacagatttaatgtacaattaagctcaataaaatatactctgtgggttaaaagtttaagtattgggaaatgtattttcaaattcttcattttaaaaggaattagctccttttgtatgttgtgtttttgggtgggtgcttgcggaggccagaaggggtcataggatcccttggagctgtagctgcagacagttgtgagctgtcagtgcagttgccgaaatctgaattctaatctctacgagaaccgtgagcactcttgacccaagtctttcattttctttttcatctttctctccctcccccccccttttttttttggttgttgttgttttgttttgtttttcaagacaggatttctctgtatagcccttgctgtcctggaactcactttgtagaccaggctggcctcgaactcagaaatccacctgcttctgcctcccaagtgctgggactaaaggcgtgtgccaccacgcccagcacttctttcccctggctgccctggaactccccttgtagaccaggctatcctcacactcatagagatccacctgcttctgccttttgagtgctggaattaaaagcatgtgccaccactacccagacattttttttttcattttaaatagtgtaaaggtggttgcatcagccataggaaacattggtttttattcctgtgtgtatgttaaaaaaatttatgttttattaatcaaggtgttatcctcaagccctacacataaaaaagtcttagccgggtctgttttaacatgttaaattgaaagtcagccagaaagcaaattccaaaacagtaaaacatgttttgaaagtttaaattacacacacccatgtccatgatttgttttttgtaaagaggttttcaaatgaactagtacatagatcattttgcttgttttcttggataatttcctttcagctttttgttaccaatttagattgactcagcaaaaaagggctgcaaaataaatggtttaggtttttaaaaagtaaatatttgaaaaaactatgaaaacatctactgttataaaagagatctcaaatagggcagattaatgaattcaataatcccagaaaagataaattatttaagcaagtcactaggttagttgattccatattatatttgagtcctatctttatgaaagtaacatgactagtagctaacaaaataagtgtttcttgtcactagcatgtgagaccaatttacaggaagagagcaattgcattttgtgagtgatttaaaaactaatgccttgtggtcaatttgtagacagacaaaacagacatgtttttactgtgctcttggtaattgcagctgattatgttaggcctcatgaaacaaaaagtaaatgagcctcactgtaatcaaatactactactaaaataaaatttcaaacttgttgaggcatgtgactaatctagctgtcaggagggtgacagtgactttgaagtcagtcttgactgccaggaagatcctgttccccaaaacagaaccggggcaaactttgaagaaagtatatggaacagatttggcaatggtggatatttagatattcacaaaagtgaagaaacctcaaacaataagtgaaatatgcagcaggatacatggttttcaaaatcgaggagacaacataatctctcaaatacctaatgtatatagcctgtatgtgtgtatgcatgcatgctcctgtggatgttagaagaggacattgaattccctgaagccagagctgcacatgagtgtgagctgcccaaggcatgtgagacttgaactctggtcttagggaagagcagcaggcactttcaagtactgagccatgtcttagcgccaagacaatgattttaacagctagaatcagctacagggaaaggacaagctgaacaacagccaatttgtgataagagactatgacatactcttacaagtgtcacgatgttagagtcccattgatacgaccaattcagaattctgcatgtccagaaaagacctttcattagtgcaatgaccatcaggacattttaagtggaggacaacagggatgatcctcagtggtgggccacttgcctactgcctacttgcatcatctctggatgatgttcccagcttcacagaaaaaacaactgaaattcagcgagagacagctgagtgccttcatcactagtaggccaacctggaaaaatgtctaaagaaagttctctgaagagaaagggagcaatgagggattttagaactacagaagacgggaacagtggccacaggtaaaaccaacattttgatgtttctgttgggctggattgggaaagcccaaattgcagaattgcactgcttatcaatgtaatataagtgtaaagtagactgtattttcaccagtggactaaaaaaggacataaggaaggcagagttcccagaattcacttcagctggtaaaatgtcaacaggagtaaatttaagccatgtgataatgcacaatgatctacataatccttggagggcccactaagatagttgtttaaaggcctgtggccaatcattacagatataatgaaactattagtgtttgggtctggggtatggggtgagataagagaggatatatgggagatagtaatcagaatgtatagtgtacacgtatgaaattgccacacaaaattatcaatgaaaattctagaagatgttctagttacccctgtactacagggaaaagccaaaacaagcaagtcgaaacagaagacaagagacaagttagcagtgtcaggactcactaatatcaataataccacaaatctcagtagacttccatatcaataacagacatttgcagacccagaagaacccaactatctgcttatgagacgctgaacacacaggtctggaagtacaagccatataaaacacttaactgaaagaaagcaggaaaggctgtattgattttacgtggactggatgtcagggggagaaaattaccagagacagaaaggaacattaggcaagggtaaaaagaaattgacacaccaagaaaacacatgccaaatgagtaagttgtagtccgtaccaggagatccttagcagtcactgatggaactgaaaggcagatgtataattttagccaaaaaaccgcaacacccatctctccgatggagtattctgcaagtttatcctgagctactgaaaaccacacacacacacacacacacacacacggccatgcaggcacgcacatgctaaagtgcatgctcgtgcatgtatgcgtgcatgcacacacagacacaataaggtgtaacctaaggagacacttcaaaggaaaacttaaaaagtacatttgacagaaaccaaatggaattttgtaaaaacacacagtattcatgaaaactcatatcatgagagacatatgtggctgtaaattcttgagttggcaaaggaaaaaaaaaaaacctcctagtgtaaagaaactaggaaaggaaagagggtccaccataactggctttccttttccagctagttacaggcatggccacataaggcacggctgtctcagtcagcagaagaaagcagataatgaagacaaggggagaaatcaatgcagctgaaaacacaggccacacagaaaatcaatgacataaaaatccatttttaaaataaagataaataaaattggcaagctaccagtaagactgaaaaggaaaagaaatatgtctccaaaactaagtaggcaatcctgctgtaaaggacaataaagggaatagtacaaacaagtctttttacccttttttaattttttaagattataatatannnnnnnnnnnnnnnnnnnntaatgattccataaactttccagagtaatcttaaatttgttttacgttaaaatatatttccttctgacatccgttttcccctagctagttagtccttcgggctcaaacctaaaattgtttacgctcttttcttccttattttgctggctattaatacctgttcctctcactctcctaatctttcattaatcctcagggcctctcccacctcgccttcaccagctgcaaggctatggtctaggtttccctaccttagcctcgtccatacctccatttttcatggtgcttctccatctttctttttaaacacaaaagactcacactgatgtctcaggtcaggccaaaccttatgcagctcatttttgccatttcttagaactacgcttcccctggtcaccatttgccttccattgtcttgagttagcccagaatctgtctctgatgctccccccccatcctgcttactcagcatgttcaggcttagaggaaattctgattatcagtggggcagctcaaacccatgttttttttgtggttgatctccttcctggattctgacttttagtgctgggtacaacagggaaagtgttacaggtgtcatacaatgtctttggaggagtgtgaagcttagatttttaaagaatcacttatacctatttttaggaaactaattttaattatgacatttaggattgcaaataaaatatggaaaagcaggttgtgttaagcccttcaagtgtggtacagggtacaccacacacattctctggtgggtttttgtttctattgcccttaaagtcccatggccactgtgtatgtcacacataaacccaatttttaccttttctctagtaaggtaacaaattggctctaattatacaggattttagtggttatatttcttggtatgggaagttgagatccggcatttgtgctcggtccactaatatctttccatcccccaagttttgtacagcacctcagaattcatttcagaatttaatattatcagcagcatgtcacaaaaggttttaatatattttgatcatccaaagcatacttcgtatccaactgatctgtagaagaagataccctgtcatgtctaccagtttgctcctggtcctcatctttaagacacttaattccccccaccccaattccttgctactaaacttccccatatgaaaatgaatctttctaatcttccgaatgggtgaaaataggaagacttgatcacgttgggattttaagttacacatatttacacacttacgactttagtgccagcttattacctatgaatttattctactctctcatcaagagaaagacctgaagctatgtgccccttcttcctttgttctgaacctagataatgacacgttctattaatcaagttccccattaacggtgaccctcctattgttgagtcctggtccctgacatttgttgtatgtgccatgtgctaggcactcactcactgtgaaacgtgcttagaagtgtttcgttgaatcctcagtccatctcatgacataaagacttgctttctctttttcatccatacgcaattccaagtttagcgacgttgagaaaattgtccaagctgccccgatgcacatgatcagaactgaaatccacatttggcctcagctgacttgacctacgttgttcaactgctctgaactgataatttattacttcctagaaaatgaggatattatcaattactcttttgtcttttaggtagccagtcatagcacaagatccataattcttactgtagttggggagaccgccctgcaccccccacccnnnnnnnnnnnnnnnnnnnncacacacacacacacacacacacggccatgcaggcacgcacatgctaaagtgcatgctcgtgcatgtatgcgtgcatgcacacacagaacacaataaggtgtaacctaagggagacacttcaaaggaaaacttaaaaagtacatttgacagaaaccaaatggaattttgtaaaaacacacagtattcatgaaaactcatatcatgagagacatatgtggctgtaaattcttgagttggcaaaggaaaaaaaaaaaacctcctagtgtaaagaaactaggaaaggaaagagggtccaccataactggctttccttttccagctagttacaggcatggccacataaggcacggctgtctcagtcagcagaagaaagc

SEQ ID NO: 150 - DNA, 2132 bp, Mus musculus
agtgggcgcccagttaccagcaagtgtacacagggaccaacggagacggatcgcagcaagctgagggtgccttagcgacctcctggacagacccgcccgcgccatgcgctcgcacactggcctgagggcgcttgtggcgcctggttacccgctcctccttctatgtcttctggcggcgacgcgccctgatccggctgagggcgatcccacagatccaacttttacaagtctacctgttcgagaagaaatgatggcgaaatactcaaacctttccttaaagagctgtaatatctcagtgacggaaaagtccaatgtatcagtagaagagaacgtaattttggaaaagccttctcatgtggaactcaaatgcgtgtacacagcaactaaggatttgaacttgatgaatgtgacttggaagaaagatgatgagccccttgagactacgggtgacttcaatacaactaaaatgggcaacaccttaaccagtcagtacaggttcatcgtttttaatagcaaacaattgggaaaatattcttgtgtctttggagaaaaggaactaagagggacctttaacatccacgtacccaaagctcatgggaaaaaaaagtcgttgatcgcttacgtgggggattctactgtgctgaagtgtgtatgtcaagattgtcttcctttaaattggacttggtacatgggtaatgaaaccgcacaggttcccattgacgctcactcgaatgaaaagtatatcatcaatggttcccatgccaatgaaacaaggctcaagattaagcatcttttggaggaagatggaggatcctactggtgtcgtgccaccttccagttaggggagagtgaggagcggaatgagctggttgtgctgagcttcctggtgcccctcaagccatttctggccatacttgccgaagtcatcctcttggtggccatcattctgctttgtgaagtgtacacacacaagaaaaagaatgacccagatgctgggaaagaatttgaacaaattgaacagctgaaatcagatgatagcaatggcatagaaaacaatgtcccccggtacagaaaaactgactctgcagatcagtgaatacagaaagagcatctcgccctgggaagaagtacagcgttggagtttgtacttcagcttccttattttagatttttaaaagacaaagatgccctcaacgtgcacagaagtagctttatgaacaatatagtccatctcctacctaaagatgtactttcattttgtaattgctttccattaaagcaaggtcaattgtttcagctgtgttctgtgagctgtaacctagataataaactcccctctgtgggtacagggtggacaccagcaaaatcacttaataatccacaaataaatatcgccgaagatctgtttattaccaaagaatttattaaagagaaagcgtttgccagttgtcttaagtgtttgcctccaccagacatcttacctatagaagtatttatcacagttttcatgtgaagtgtatccagtgttgagtgtgatttctctaggaaatggaaagtatgctttcaatatcggtggctacactgcagtctagacactaagataaacttgtgctctataaataatggtgcaaagtaagggagtttaaatgcttgtgccatggccactacattaccagagcttctcatcttcattgcactcatttctgctctttctatcccaagccgaagagcttcccagccttaagtaggacattttccttgttctttgtcattggggtttggacttcaatagtcttcagaggccagatccacgttgtcacagtacaaccccgctcgctacctgcatgcctttgtggctcatggtttctgggtgcctttatgtgccatctctttcctggtaccatacctggctaaaatgcattcttagtgttttccaataataattcctttgtctagtatacaggaggactagtgcactatctttatgttgctgcgaatgccttagacttaacttcaaaattgtatctgagatactttatgaacttagaaccaaatcacgtcagaattttaatggacatggaaacttgtcaatggttttaaatgaaataaaatgtgccttggatggttggatt

SEQ ID NO: 151 - protein, 339 aa, Mus musculus
GCLSDLLDRPARAMRSHTGLRALVAPGYPLLLLCLLAAWDPAEGDPTDPTFTSLPVREEMMAKYSNLSLKSCNISVTEKSNVSVEENVIKPSHVELKCVYTATKDLNLMNVTWKKDDEPLETTGDFNTTKMGNTLTSQYRFIVFNSKQLGKYSCVFGEKELRGTFNIHVPKAHGKKKSLIAYVGDSTVLKCVCQDCLPLNWTWYMGNETAQVPIDAHSNEKYIINGSHANETRLKIKHLLEEDGGSYWCRATFQLGESEERNELVVLSFLVPLKPFLAILAEVILLVAIILLCEVYTHKKKNDPDAGKEFEQIEQLKSDDSNGIENNVPRYRKTDSADQ

SEQ ID NO: 152 - DNA, 65277 bp, Homo sapiens
caaaaaaccaaacactgcatattctcactcataggtgggaattgaacaatgagaacacatggacacaggaaggggaacatcacactctggggatggttgtgtggtggggggatggggagggatagcactgggagatatacctaatgctagatgaccagttagtgggtgcagtgcaccagcatggcacatgtatacatatgtaactaacctgcacattgcgcacatgtaccctaaaacttaaagtataataataataaataaaaaaaaagaaattgtgctacatgtataccatgggatactatgcagccataaaaacaatgagatcatgtcttttgtgggaagatggatggagctggaagctactatccttagtaaactaacacaggaacagaaaacaaaatattgcttgttctcacttatatgtgggagctaaattatgagaactcatgaacacaaagaagataacaacagactctggggcctattggagtgtggagggtgggaggagggaaaggggcagaaaaaataactattgggtactaggcttcatacctgagtgatgaaataatctgtacaacaaactctgatgacaagagtttcacatgtattctcaaacgtgaaataaaagttaaaaacaaacaaagctgtcattcaagaatagtgtatctagcaaacttattatgaagatgatataaaatgttttccaggcaaagaaaacctgagagaattcaccactacctgattcatcttacaagaaatgctaaggggaattcttccttctgaaagtaaaaatggttaatgtgcaaaaacaaaattatggtataaaacatgttggtaaaattacgttcatgaataaacttgagaggtgaagccagctgggcttctgggatgggtggggatttggagaacttttctgtctagctagaggattgtaaatgcaccaatcagtattctctaaaaatggatcaatcagcactctgtaaaatggaccaatcagcaggatatgggtagggccaaataagggaataaaagctggccacccgagccagcagtggcaacccactcaagttcccttccatgctgtgcaagctttgttcttttgctcttcataataaatcttgctgctgctcactgtgtccgcactacctgtatgagctgtaacactcactgcaagggtctgtggcttcattcctgaagtcagcatgaacacgaacccaccagaaggaataactctggatacaccacctttaagagctgtgacactcactgtgaggtccgcggcttcattcttgaagtcagcgagaccaagaacccactagaaggaataaactcaggacacaccttgccgacccagatgggactttcaccaagtgatgggaaacactcagacaccaacaggcccacccttgcaatgcatcctaagccattgggaccaatttgaccagcaaaccctgaaaaagaggtggctcattttttttggcaatatggcctggccccaatatcatctctctgatggggaaaaatggccacctgagggaagtacaaattacaatactatcctgcagcttgaccttttctgtaaaagggaaggcaaatggagtgaaatatcttatatccaagctttcttttcattgaaggagaatccacaactatgcaaatcttctaatttatatcccacaagaggacctgtcagcttacccccatatcctagcttccctatagctccccttcctattaatgataagcctcctctaatatccctgcccagaaggaaacaaggaaagaaatctccaagtgaccacaaaaacccccaggctatcagttatgtcctctttaagctgtagggagtggggaatttggcccaacctgggtacatgtcctcttctccctctctgatttaaagcagatcaaggcagacctggggaagttttcagatgatcctgataggtatatagatgtcctacagggtctagggcaaacattcaatcccacttggagagatgtcatgctattagatcaaaccctggcctttaatgaaaagaatgcggctttagctgcagcctgagagtttgaagatacctggtatcttagtcaagtaaatgatagagtgacagacgaagaaagggacaaattccctaccagtcagcaagccatccccagtatggatccccactgggacctagactcacatcattgggactggagtcacaaacatctgttgatctgtgttctagaaggactaaggagaattagaaaaaagcccatgaattattcaatgaagtccaccataactcagggaaaggaagaaaatcctgctttccttgagtggctacaggagaccctaagaaaatatactcccctgtcacctgactccctcgagggtcaattgaccctaaaagataagtttattacccaatcagccgcagatatcaggagaaagctccaaaagcgagctctgagccctgaacaaaatctggaggcattattaaacctggcaaccttagtgttctataatagggaccaagaggaacaggctgaaaaggaaaagtgagatcagagaaaggccacagccttagtcatggccctcagacaaaccttggtggttcagacaggacagaaaatggagcaggccaatcacctgttagggcttgttatcagtgtggtttgcaaggacactttaaaaaagattgtccaatgagaaacaagccgccccctcacccatgtccattatgccaaggctatcactggaaggctcattgtcccagaggacaaaggttctctgggtcagaaatccccaaccagatgatccaacaacaggactgagggtgcccagggcaagcgccagctcatgtcatcaaccttactgagcctcaggtacatttatctattgagggccaggaaattgacttcctcctggacactggtgcatctttctcagtgttaatctcctgtcccagacagctgtcctcaaggtccattaccatccgaggaatcttgggacagcctgtaaccaggtatttctcccacctcctcagttctaattgggagactttgctacagatgttaagtatgcttatctaatcctacatgcccatgctgcaatatggaaagaaagggagttcctaacctctgggggagccccattaaataccacaaggaaatcatggagttattgcacacagtgcaaaaacccaaggaggtggtagtcttacactgctgaagccatcaaaacggggaaggagaggggagagcagcagcataagcagctggcagaggcaggcaaagaccagcagaaaggaaagagagagacagaaagtcagagagagagggagagagaagaggaaacagagacaaagagggagtcagagagagagagaaagagagagatagaaagtcagagaaagaggaagagacaaagagggagtcagaaagagagaaagagagagacaaagaagaagtcaaagagaaagagagatggaagcagtaaagaaaaaacagtgtatcttattcctttaaaatccagggtaaattttaaacctataatttataattgaaggtcttctccataaccctataacactccaaaccaccttgttgtcagtgtaaacaagggtgtagcccaaaaacactgaggccactgacaacccatagccttcctatcaaaactgtagctttcctataaaaatatccttaacccagcaggtttcctaacaggggatctaaatcttaattaattaccatacaaaggtccgaccagacctaggaagtactcccttcaggacgggatgatagatgtttcctcccgggagattaagggaaaaagacacaatgggtattcagtaagtgataaggaaactcttgtagaagcagaattaggaaaattgcctaacaattggtctgctcaaatgtgccagttgtttgcactcagccaaaccttaaagtacttacagaatcaggaaggagccatctataccaattctaagttaataaggtcttagtgtgtggtagtaggataatacatgttacactgttaacttttagcaaactgtagttttgttgaaaactttgtaagtttgggatttcaattattctttgctattaatctcaaaggatttctcagacagtttgcaaaaaataacaaaatctatccttactctacaatcccaaatagactctggtagcagtgactctccaaaaccgccgaggcctagacctcctcactgctgagaaaggaggactcagcactttcttaggggaagactgttgtttttacactaaccagtcagggatagtacaaaatgctgcccggcatttacaggaaaaggctttttaaatcagacaatgcctttcaaactcttataccaacctctgaagttgggcaacgtggcttctcccatttctaggtcctgtttcagccatcttgctattactcaccttcgggctgtgtgtttttaacctccttgtcaaatttgtttcctccaggatccatgccatcaagacatagaggtcttacaaatggaaccctaaatgagctcaactaacaacttctactgaggacccctggatcaactcactggccctttggctggcctagagagttcccctctggaggacactaccactgcagggccccttctttccctctatccagcaggaagtagctaaagtggtcatagcacaattcccacagcagttagggtgtcctatttagaggggggatagacagatgaagccagctgggtttctgggtcaggtggggacttggagaactcttctgtctagctagaggattgtaaatgcaccagtcagcattctgtaaaaatggaccaatcagcactctgtaaaatggaccaatcagcagggcatgggtggggccaaataagggaataaaagctggccaccagagccagcagcagcaacctgcttgggtccccttccatgctgtggaagctttattctttcgttcttcataataaatcttgctgctgctcactctttgggtccacactacctttatgagctgtaacaccacaagggtctgtggtttcattccagaagtcagcgagaccacgaacccaccagaaggaacaaactctggatatgccacctttaagggctgtaacactcactgcgaggtctgcggcttcattcttgaagtcagcgagaccacgaatccaccagaaggaataaatcccagacacaaactcagaatactctgatactataattgtagtgtgcaatccacttataactctaatatgaagcctcaaaaagcaaatctatcaaaaacaataatagctacagaaacctgttaagagataggtaatataaaaatatgtaaagtcaattaaaattcaaaatgagagagaaatgaagttaaaatgtggaagtttcattttttgtttgtctctattctttgtgatctaagataaattgtcatctctttaaaataacttgttatatctacaagatttttttgtaaacctcatagtaaccataaggcaaaaacctataatagattcacaaaaattaaaaaacagcaaattaaaacatactaccacagaaaatcacttaaccccaaaagaagagagtgagaaaagaagaaaagaagagaggagtttcaaaataccagaaaataagcaacataatggcagtagcaattccctacttatcaataataatactggatttaaatggactcaattttccaattaaaaggcatagggtggctgaatggataaacaaacaatacctaactacatgctgcctataagaaacccacttcacctctaaagatatagatagactgaaagtgaaggggtgaaaaaagatattgcatgcaactggaaactaaaagagagtgggagtaactatacttatattagaggaaatagactacaaatgaaagattgtaaaaagagataaagaaggttactacataatgataaaaaggtcaattcagcaagaaaatgtaaccattatatacatctgtgcaccaacactgatagatttatacaaatataactataaaaaactgattaaagtaattgaacaaaacattaataaggatattctatgtcatggattggaagaattaatattgctaaaatgacaatactatccaaagcaatttacagatttaatgcaacccttattaaaagaccaatgccattcttcacagaaataggacaaatgctaaaatttatatgaaaccagaaagaccctgaagacccaaagcaattccaagcaaaataagaaaaaaacaaaaaaagctggaggcatcacattacctgacttcaaaatttactgcaaagatataataaccaacgattcacaatattaaagacatggaatctatcaaaatgcccatcaatggtagaatggataaagaaaatgttgtacatatacaccatggaatactatgcagccataaaaaggaacaagatcatgtcctttgtagggacatagacagagctggaagctgttatcctcagcaaatgaacgcagggacagaaaaccaaacaccacatattctcacctgaatgagctgaatgatgagaccacatggacacatacttggccttttgggggtggggtgttgcaggaaggaaagcatcaggaagaatagctaatgcatgctgggcttaatacctaggtgatgggatgatctgtgaagcaaaccacggtggcacacatttacctacataaaaaacctgcatattctgcacatgtaccctggaacttaaaacaaaaattaaacattaaaaaaaaaagctatagtaaccaaattagcatagaactggcaagaaaacagacacacagaccaatgaaacagaatagagaacccaggtataaatcaatgcattgacagccaactcatcttcaacaacagcaccaagagcatacaacaggaaaaggagagtctgtttaataaatggtgctgggaaaactgggtaattacatgtagaaggatgaaataaacccctatatctcaccatacacaaaaataaaattaaaatggatgaaaggtttaaatctaatacctggaactatgactatgaaacaattagatgaaaactttgcggaagtgttccaggacattaggctgagcaatgacattttgtgtaagacctctaaagcacaggcaaccaagaaagaatagacaaatggcattgaaccaggctaaaaagcttctgcacagcaaaggaaacaatcaacaatgatttaaggtcctgtatgagggatttgttaaagtataatcaaaatggaggcaacagtatattcttaggtcaaccactcatagccacataaccaaaatttaagctatcctgatttctctgaaatgcaatttctaatgattaacaaaagttaagctttcctttcttgttagtatgatgaaattgaaccaatttgttacagataaataagtttatacaactctacttgcccaaaaaggaatatgtttttaatagccagtcacagcagaggtcaatgcacttcctcattgatgctttataagctgcactgtaactctcacgtcaagtttcttactacttttgatttgaagtcttctggtttgtgaactattcttctgtatgtataataaaccttcatattccttttttacttgacctgactttatttttacggggtcctccatggcgtttgggtttctcacagtgtggcagtctcaggataatactgtagtacttttcactaggcaggtgtcttctatgagcaagatctccaacagaaaggaagtggaagctcttgtggtctggaacagaaagctcacacaatctctctctctctttttttgttttgagacagtcttgctctgttgccctggctggagtgcagtggtgcgatgttggcttgccgcaagctctgcctcctgggttcaagcaattctcctgacttagcttcccaagtatctgggattacaggcatgcgccaccatgcacagctaattttttttttttttttttttttttttgcatttttagtagagacggggtttcaccatattggccaggctggtctcgagctcctgaccttgtgatctgcctgcctcagcctcccaaagtgctggaattacaggcgcgagccaccacgcctggccagcccacacagtatctcttcagcaatattcagtaggttaggggagtcaaagagcccacccaactcaaggggagaaaacaaaggacccttattccccctttatacgcttcatgatgagagtatcaaagtgcttgttgcaatatttatttcaccaaggaggaaaaggtcaatttggaccagaaaggtcagaaaaagtttcccccgtctgggtatctccaattcttctatccctggttcacctcagagtattgcagttctgagaaccagtgcattctggattcattgtagaactttgattctctacttgactgtatgtcagaatcaccagagagcttgaaaaatcctgatacctggatcttttcccgcaaaactctggttcatttggcttgggattcagtgtgggcattaaggagtttcatcagctctccatgtagctttaaatgtgattttaagctggttaaaaaccacagctttaaaatgatatggcctagacagtgcactgttaggtaaatacttattccataggcatcagggttaagttgatatgcagagaagatctctaaagagaaaaaaaaaaaaaaaggtaggaaacaaatgaaagtggaataaatgaaggtgtaaatcaataagatgaatgggggaggggatgtcactctacgtatatggtataagttctgctcttttagctccacgtaagctaaaattgtggaataatgtacaagacaaaagttatgaagttagcatcgaatttaagccagaattaaaaattgtcaggcactctcagcttgttttctagattcggtattgatctctgcgaaattcagttttctctttgccaaaggatattgtgaggtttactggatatttttgacctagatgtataggcctacatacttggacacaggttgtctgttaacctaagactttgagtcaaattttaataataagaatagttataaatgtatagccctatgagttagcatttttttagttccagctgaaaaaagaaaaaagaattgtctagaacatttttctctcttctgggtatccccagtacttctatccctgagttgcaatccactaatattattatttatttgatgctcaatttgtcccagatttgtccagtgggaacccctttaaatgtccttaaaggtaaaaactgccagcatgttctactgagatatggactaacaatgtcagacatatgtgggtgcttgaatagtatttgcttcaaaaatatttattactagaaagctgctgtgtttggggtgagaggttagtagggaagggggttcataaagggaatgcaaaagccacgtcctctggaagtcaaaggatcattttaaatgattctactgcaaacatttttcaaaagataaacatgacccatttctccaatttgtgtcatgtaatagtaataataatgatatttaaatactcccactgatatgtcctttacaaagatatattatatgtcttatttaatcaaaaaaccttaaaagagtccctgtacctaattttattccaggactcaaactgtgtcagcatgtcattcagtgcaaatcagacatttagatgcataggctatgctgtcagtagttctgaactttcatagacatttccaattagctcggagagacaactggatattgtgtttaagcactgtgtttaggaaaacaggcactggatggaccaatgccaaatttcctgctctgctgcttaactaagtatgtgtaattacttgggcaattacttaagcaattacttgggcaattacttaagccaatccccaatttcttcgtcttgagcccagaaggtcaaggctgcagtgagccgtgaatgtgcctctgccctccagcctgagcgacagagtgagaattccccaggagtgcagaggttctcagaactgcaatactctgagatgaattttgaaaggtgaatcagggatagaaaaagttatatagggaaggcagtcaataagcttgttttaaaggatatggagcatttgaaaaagtggaatgtacataaggctggaaatatcaaatatctaaatatagaacaggaacagtgatgaaaagactttcaaaatgcttagcaaaatgagaattatatttctttctcaactcttttgttccaacagcaaaagcaacagtggggatcagcatcaacttgggtaagtaagtttttctggtcataaataggctgattcaactgaaaaaaatgtttctttaagaagggtgaatttgtgtctaaggattttatgagactaactgggaaaagtcagtcagagtttagtttgaggtgagaagtgcttactgttgacactctacctaattatagggaaatgtgtgcagttagtcctgagaccagatgcagggttgaaagaaagaggtgtgatgtagcagccattgattaggcaatttgggtttagcaagcccagtcaatgccctcagagggtcaacagtgtataagatttagtccttgaaggcatcttttaaagtttcattcagaagattttaataattttgaccataattttctgagaagaggcttttctgagatttgtcattcacagataaacagttgtctaatttgtgtgtgtgtgtgtgtgtacatgtgtgcatgcgtgcatttgtgcatgtgtgcctatctagcctcttttgaacacaatggtagattggcacctggtagataatattgttgaatgaattgtattattcatattatctcactgccaatttgaagaatctacattctgtttccaaagttttgtgcatataatactaaaccagaaacagacgtgttttagtaatacgtaccaattacaaattaaccattcctgcctggaataaacacaggttttgttaaatagctcaattttcaaaatttgtctcatgttatttccaatccttttttttttaacgccgatatattttgaatttacgaatgtgaaagctgaacttcaaaaaaataaagggagaggaaacaaagctcgtgaaaaattttaaaaatatcttttaatgcgttataacatcctggagagaaatcaaatcaatgtgtttcaatgttacaatatagatttctcctcccctcccggataaagcactaatttatttaatttggttcagagcactgaatattccaagctacagccttgtgggtaagagcattatcttaaagagtgttcggatttaacaaaggtcaatgtcttgtgcagtttacatagtatctactctcagtagcttttgcttcttgagctctaggtggctcctcagaagctgttaggcttaacaaacaaaaataaagtaaaatcagacacggtatggggccttgggactctaaaaccttcatccggagaaaatcagttaagccttcagagactagaagagagaatgtgtgtgattggtaggcaaagcaaagaaagattaacacaagttgtctggcagctggataaaaccttacacctgcgcaaaaataagcctccctcgtaagaaagcccaaagatgtccggggtccgggaggagaaaagtgtttctcatctgtcccatcaaagcaaattagtgaaacctgcctcaggtgaagtgcaaaggccagtctgtaggcagagtttcgacctctccccacgagattggctagacatcacctgcccaagctctctcccgacctgctagagccgagagggcggaggccggagaggctgcagccgggaagtagcaccgccaccgcacatccgggaacgccagcagccggctgagggctgcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccaggtgtgatgggtacagggtccagggtagggagggcggagggcgcgcgaggctcgggtccccgcgggcagagggcatcgccggcgcgccgggcaagggtggcggggagaggcgcggggatgctggtaagggcgggtgggagagtcggcggcggcctcccattagctacgtttgtgtcacctaagctgaaccctgaaactgctgcggctcgcgttcctgcgctctttggggcgagtcttgaacgaacagcgccccgcgagtcgggcgcgtaggtaacagggcagagtctggtttttcctaggaagaaggcagtggggtgtgtgggtggttgcagggaccagctagcgacttggcttgggcaaatatggcatgaattttgaaagccacatttccccaaggcctactcccttttcttgattcgagagtaaggctcgagtatcacctccttccctcctcttggcaggtgggttggctttgaggatttttttttttttttttttttttttgagacggagttttactcttgttgcccaggctggagtgcaatggcgtgatctcggctcaccgcaacctcctcctcccgggttcaagcgattctcctctgtcagcctccagagtagctgggattacaggcatgcgccaccacgccgggctaattttatatttttagtagagactgggcttctccacattggtcagtctggtctcgaactcccaacctgaggtgatccgcccgcttcggcctcccaaagtgctgggattacaggcgtgagccacctcaccttgccgaggatgtttttttagagctgagtaggggaaaaaacatcataaccaactagccaaccaaagatccacaacttacaggataacgtgtgtgtatcttcattttacaccgtggtctttgaaaacaaaatgtgtgtgtgcatgtgtgtgtgtgtatgtgtgagatttttgcttgttgttttattgtttaagacactttgacagagggattacgtgcaaaacattaacaaagccaacacgaaagttgccattctaccttcacctgtttataattacttttcatattgaaaggattccatccaacctattgcaagtttctgtgtcataaatgttaccagccagtaagggtaataaaagaccacctctcaagctggtaaatattggccaccagtaactaaaattgggacattattctgcaaaaagttttcaaactctcatgggaatttattttcatgggcttgtaagatgtggaatttttgtaacacaccatagagaaggaaggataatcaaaaggtaagactattaatttttataaatgccttttaaaacgtctagttgttaacaacttggacagaacatcgtgggttccttcgcagatttccttgtgccacatctcttttccataataccacttataaagaattgtccaggcctgtaatcccagcacttttgggcgctgaggtgggaggatggctggaatccaggagttcaagaccaccccgggcaacatagcaaggtcccttctttattaaaaaaaaaaaaaaaaaaattaaaagtgcggttgtggtgatgtacaccagtagtcccaggtgcttgggatgccaaggcagaaagattgcttcagtccaaagtttgaggctgcagtgagctatgatggtgatggtgccactaagctccagcctgggtgacagtgcaaaactgtctcaaaaaaaaagaaagaaaaagaaacagaattgtccaggacatttttcccccttctgggtatctccaattcttctatccctggttcacctcagagtattgcagttctgagaaccagtgcattctggattcattgtagaactttgattctctacttgactgtatgtcagaatcaccagagagcttgaaaaatcctgatacctggatcttttcccgcaaaactctggttcatttggcttgggattcagtgtgggcattaaggagtttcatcagctctccatgtagctttaaatgtgattttaagctggttaaaaaccacagctttaaaatgatatggcctagacagtgcactgttaggtaaatacttattccataggcgtcagggttaagttgatatgcagagaagatctctaaaggaaaaaaaaaaaaaaaggtaggaaacaaatgaaagtggaataaatgaaggtgtaaatcaataagatgaatgggggaggggatgtcactctatgtatatggtataagttctgctcttttagctccacgtaagctaaaattgtggaataatgtacaagacaaaagttatgaagttagcatcgaatttaagccagaattaaaaattgtcaggcactctcagcttgttttctagattcggtattgatctctgggaaattcatttttctctttgccaaaggatattgtgaggtttactggatatttttgacctagatgtataggcctacatacttagacacaggttgtctgttaacctaagactttgagtcaaattttaataataagaatagttataaatgtatagccctatgagttagcatttttttagttccagctgaaaaaagaaaaaagaattgtctagaacatttttctcctttctgggtatccctaattcttctatccctgattcacctttcaaaattcatctcagagtattgcagttctgagaacctctgcactcctggggaattctcactctgtcgctcaggctggagggcagaggcacattcacggctcactgcagccttgaccttctgggctcaagatgaagaaattggggcttggcttatgtaattgcccaagtaattgcttaattgcccaagtaattacacatacttagttaagcagcagagcaggaaatttggcattggtccatccagtgcctgttttcctaaacacagtgcttaaacacaatatccagttgtctctccgagctaattggaaatgtctatgaaagttcagaactactgacagcatagcctatgcatctaaatgtctgatttgcactgaatgacatgctgacacagtttgagtcctggaataaaattaggtacagggactgttttaaggttttttgattaaataagacatataatatatctttgtaaaggatatatcagtgggagtatttaaatatcattattattactattacatgacacaaattggagaaatgggtcatgtttatcttttgaaaaatgtttgcagtagaatcatttaaaatgatccttttaacttccagaggacgtggcttttgcattccctttatgaacccccttccctactaacctctcaccccaaacacagcagctttctagtaataaatatttttgaagcaaatactattcaagcacccacatatgtctgacattgttagtccatatctcagtagaacatgctggcagtttttacctttaaggacatttaaaggggttcccactggacaaatctgggacaaattgagcatcaaataaataatgatattagtggattgcaactcatttaataatatgggaattcatgagtacccactgatgtaaatttaaaaaggagtcaatgaaaagtttgatggggtacaaagtattaaagattcagagtaactcttcagaatgtgctcattaatatcaagggaaaaagagtaactttatggtggagaagcttggcagacagcactttgatcaaatgatcaaagaccaaaatctgtttaaatggaacagatgaaccataagcctacttttatttatttattcattcattcattcatttaatttttgagacagggtctcactctgtcactcaggctggagtaccgaggcacactcatggctcagggcagccttgaccttctgggctcaagagatcctcccacttcagcctcccacatggctgggactacaggcatatgccaccacacccggctaatttttgtattttttgtagagatggggtttcactaggttgcctaggctggccttgaactcctaggctcaagcgatcttcctgcctcagcctcccaaagtgttgggattataggcgagagctacggtgcccagcctaagcctacttttaatagtgatgtttctgatgcatgaccatttttaccctaaatttatcatcacaaaaaaattatatgttgaaaacatttgttaagaattagggcaactgactcttcctcatcttctgtcaccctcgttcccttccctcctacctctcatctttccctccataggtcctatagttatttggtggggaagagcaaggagacatcctcactaagtgggtggagcccaaggggaccagatcaggatatctgaggctgaccctggtaaggatggcatcaggcaggagggcagcctggtgtggagtattagggcctgagcacagtgaatggttgctcctgcagcgggcagcttgacacaggatcccagagttgagcaagtttaacaaggcttttgtgcaggagcagcagatgggtgatgtttgatcccaaacaagatgtggaggaaagcatgtaggagggtcagaccagcgatggaggttggagcctgagtgggtaaggagacatctctgtggggacaggtgtggcagtagcaatgacagtttagcagtatacagggtgatggatcaaataattaaatctaggaaagataataggatctaggtttttcactagagaagaatgaaataaagatagagaaaaagtagaatgaaccctgtggtgttggattgcagttggcagtatccatgggaatccatgacattaaatccctatctctttacttaagtctatataggtatatagctttaaacaagtatatgtgtaaatatatgtatgatgaatacgtatcatgcatatcatatacataagtgtatatgatatacattataagttgtatgtgtatatgaatatgtgcacatgtattcttagcagtgatttccagtagtgatgagtatacttagcacccagatcttgggttctaaataccattctttactaatagtaaccaaggcttcttggagaaatggctgatttcagggctagtgtgggaaagtagcagataagcctagaacatcttgtgccagaaagcaatggagtgctcaaaggataatgagtcatgtcaaaaagatacaggagccaatatgaaggggttcccactggacaaatctgggacaaaattgagcatcaaaataaataataatattagtggattgtaacccatttaataatatggggattcatgagtaccaactgaagcaaattaaaaaataaatcaatgaaaactttgatggggtacaaagtactaaagattcaaagtaactcttcagaatatgcttactaatatcaagggaaaaagagtaactttatagtggagaagcttggcagacagcactttgatcaaatgatcaaagaccaaaaaaatggtatgccatctgagacgatctggtgagaagagcacagcatcacttctatgatcttcctgccaaagatgcctacctcaaatataatcatattagagcagaactgtcttggaattttaaaaagtgtcaaggttatggaaaagtcagaagagactgtcacaggtccagagtgaagccacattagagagaagtgatagccaacggcaatgtgtgattctgagctggaaccttttgctaccaagtgcgttatagggacttttttttgaaacttagatggggtgtggggatgagatggtgcttcatatatattcatttcttgattttaatggttgtattgtgatggtatggggaatgtcctttgtaggaaatagacggtaatgttttagtggggcatgaagcatcaggtcagaaacttactcatatggttcagaggggaaaatgttctgttcttgaaatgtttctgctactttgagattgtttgaaaagaaacaaaaataattagtttacctgagaaagcttcagtttaccgaggtattaaactaaaacagtagttgagaaatctgttaatgttcttaggtatcattttccaaaggtgtatatgccctccaacagaaacaaatcacatgtgttgaggctatttgttctaaagtgtaatcttttcacattaactttgtacagctggtctcacatatggcacaatataaggtgaacgttagaaattaataacttatgacatatatgctgatgtaggagaacaaacctcacaacactttgctaaaaataaactctactcctaataaaaattgccactatttaaacatagaacatctcaaataatgttagaatagaaattatgaatgttacctttaaagagttgttattcttttctttgaaaatagcattttcctggcatttttgaagttattgaggttattgtactaatgtgtccctaatcccaaaccagaagcttttaatagccttgcaattatatacttctgagaacctgaaagggaatttagataccttgtttcattgatcttgaagcccaaagtgcttttgtaacttagccaaaagcaatgagatagctaatagctataactgttttcctggtttgcatttcagcgtccctccagcatgtggtttttcttcataaaaagtcctcaaaataggcccctggcaggagggtgttcttgggagagaagggtggcaaaaaatgttcacactttaaaaatgtctgcacctaaactatgcagaacaggaatttagggccacagggccattggaagattattaagaatgatcacattgaagaatcagtattgctgatgtatctgttcaaaatcaaggttttcaactttggtactgttggcattttccgctggataattctttgtcgtggcaagctgttatcctaaaatgtttagcagtatccctggcctctacatatgcggtgggtgaattgtacaccccaaaaagatatgtttaatccctgatcttgggtacctgtgaaagtgaccttatttgggagtagggtctttgcagatgtaatgaactaaaataaggtcatactaaattagagtaagccctaaacctaatgactggtctttataaaaaaaggagaaggagatttgaacagagacagagacatatacagagggaggatgatcatgtaaagacagaggcagatattggactaatgcagctaccaacagccaaggaatgccaaggttgccagcaactcccagatgctaggcagaggcaaggaaggattcttcactcaagagttcagaggaggaaggtcctgccaacaccttgatttcagactcctggcctccagaactgtgaaagaatacacttttgttgtttttgccaccaaatttgtagtcatttgttatgacacctaatttgtggtaatttgttatgaaaacttatataacctactaaataaatgtagtaatcttcccccaattgtgacaagcaaaatgctttcagacattgccaaatgtctcctgcggggcaaaactaccctcagttgagagccactgaacaaaatcccaactcttatcgaatagactaacaattgaaacatttaacaaatctacagtctttagaaagaatagaaatcttagttattaactttcggggttttattttttaataagtttttatttggcataagttactgttaaagtatcttagtgacccatgtagaggtgatttgaaacagaatttttacattgccctttgaaacgtatattattgccaaaattatatttttttaaagagatctatttatttccattcctataccatctggtttttaaaatagttttacaagactggtaaaagtgtgcattgtacttgtcagtaggccttaaaaaaaaaaccttgtctgtaaaggcttcttgtccaatagcttccatactgtgcagaaaatatcaagagttcaagagttctctgtgtggagtgttatctgtctctgacttagaaagtctgacttataaatgttcccatcaggattactataagttttttgttttttttttggagacagagtctcactctgtcatccaggctggagtgcagtgatgcgatctcagctcactgcaacctccgactgccgggttcaagcaattctcctgtctcagcctcccaagttgctgggaccacaggtgcatgccaccatgcctggctaattttttgtatttttagtagagacggggtttcaccatgctggccaggctggtctcaaactcctgacctcatgatctgcctgcctcagcctcccaaagtgctgagattagaagcgtgagccaccgcgcctggccctgataactagaattttttgacaagcttttttttttttttttttttacttgtttttcttcttttttggatgaatctctctggagtataatttccaggactcagagatgccttatttcctttttcctctttctgctgcatttatggacaggggatagggctactctgctcctaaaacccataattctccatgtgttgtgtataatcagtattttacttagtaattaggtattttaaagctaagttttaaccatatcatggcttaagtggcctttacaatttggcatgggatcacatggttatatataacattgcttccatgaagaaatatattcttatttccaaatctctattttatgaataatatgtaatattcattcctatcagtgtttctgtaattgggttgcacatttataatgctgtatatcagaatgttaaaattaagtactgcatgttgatagcaatcagtatagagatgagaaagataaagaataatatttattctaatagttgcttcttacatttttttcttaatgaagttcagacccttccaagattttaacatataataaagggattttgggggctttagagagaatgtttattcttaatcagagatgtagttgcatttatttcctgatttaaaaaagcaaatcttaagacccaatgcagttttctagtgttacttatttttcttcccaacttacttcaattaaatgaagtcctcaaaatgaaatatgtgaaaatgttaccttaatacctttaagtagaattatagcatgtttatttcacttgaaagtgttaatagaataaattatatgcccttctagcaacacattttaaaatataatatgtgaaaaacatttaagtagagaccattttgctatttcacagaaaattataacaggtgaaaattaagatgttactcacttctttgatgcagtagtcttatgcctcaactgccctgcaaagagagaaaaaagtcttttaatctcttgagcaactatttgatgttactctttcatgttgatatttttgtctctacctgtaaaagaatgctatatggaaattttccagcaatgattaagaaagggtgagtttgataacttgagaaatgcatgttatgatcttggcatcatcactcatatttatacaacttttctgatcctcattttttttccctatcagatgaggtttacagtggagacatattttcaaagcactgagctgggcatatggcgtttggaaaccctaagtaacagtcagtgacagaatttggattaagaccccaaattccttcctctccattttatacttctttttgtgactcagcctaatccttttagggaagtattcaaaccacatctgcctgagtctcctgccaatttcctttaaaccccaatgttagctgaatcagcctcctgccagctgtcctccaactgaaagcaataaggtttacattctcacttttttggttaaaaaaatcttgcctaaacaaagaacttcttttactgtcctaataccttctgtaggttgccctgcttttccacttaaggcatttctgtatattgcctctttaagggacttttcccaaggcaaaagtcacacagcagttacacgtgttcttttgcacttggcactttttccgtggaacctgaagcttgaccaagattagtgccttaaagggaatatgaagttaaggtactggtggtgtttggtttatggatgtctgattgtatttttaatatgtgagccagcaattgtaaatggcctcaacagctagtatattctggaaatacccagacttccctacctctggaaacttggtgtttccttcctttcctatccttcaactgtcatcagcttagattctgccaaagccaaacttagactcattttctctccttgttctaacacaggtccctgttgagcccatccatgacaagtcctagtgatcagtaagggagaatagccccagcattggagctcatcttcctggaattatcttcacccttcttccacctccaggctcaggcttcatactctagctcatgtgccaatttgtataaaatatactggctatagtcagttatatactgactataactgtaactatatatacagttatatattaatgcatagttatatactatgcattaatgggtgctgctcgaaattttaatgactctcaatctcaaattatgggcccaaacccctactattatgatccacatagccctttaaggaccaagtttgcccagcttcatattctccatcagtaccaagtgtgcatgagatactgtgtatattcacttacttaagtggaataggaataagaatgacagaaagcattttttctttagtttatgtcactcttattgttactgatactgtgaaccataataataaatgatgctggaaatctcaaaaaggttatgggcttgtttcagggataaagagtataataagaacccttaagattgtattctgctgtacagtggggtatccctggggaggaaagcaaagatatcaaagcttacgttttgcaggcttcacagaacagatgatatagtagaatagcggtttccttctcatccacccccgcctggcttcctgtccataagtgaatagcatctgccttgatcttcctgaaatattttgtctttaatataacctctaagtatgctagccccaagaatggaaacaaggaattttcattaggaaaataacatttatgggagcctttcttttaagcagtgtgtatatgtgtgtttgtgtgtgtgtgtgtgtgtgaagagagagagagagagagagagagagagagagaaagagagttggggagggtgagagggaagaggaagagagaaaaggggtgaaaagacagagaaggagggtgatgggaggagagggagaatgggagaatatgggtacaaatatgaatgaatgagtgaatgaattaatgaatgaatgaatactagatgtgactggaggaaaggttttgtatacttgatagcctagtgagaaactcaggacatattttcctatataatcattgtgagagggtagtctgatttaatatgttatttaaggactttttttctttttttaaaaattattataagttctgagatacatgtgcagaatgtgcaggtttgttacgtaggtatacatgtgccatggtggtttagaaagtgcattaaacttctaaagctgttttagaagtgattaaacctttggaacacagcctattggagagttaggttctgctaggtacgttattttactaggcgatattgtaaaagcaatgttctaaagctaaagtaacaaaagtgatcactaacttttacatataagaaaatgaaagaactggaaatctaatcttgtactagaaataactttctgagcagattatttttaaaaagtgtaataaaaatggctcaggtttcatttaaattgaatgggatttaatttaaataatgcagccaagtttacaataataagctttttttcccccttctctgacttctttgatatatttgagtagtttcctggaaggtaaggtctggtactctaaaataaaaggaacagtaggccatgttgttggccaggtgtggtggctcatgcctgtaatcccagtacttcgggaggccgaggcgggcggatcacgaggttaagagattgagaccatcctggccaacatggtgaaaccccatctctactaaaaacacaaaaattagctgggcgtggtggcgggagcctgtagtcccagctactcgggaggctgaggcaggagaattgcttgaaccggggaggctgaggttgcagagatctgagaccatgcccctgcactccagcctgggcaactgagtgagactcccatctcaaaataaaaataaaaataaaaataaaaataaataaaataaataaagtaacttcgaagagagtgagagaggtggaaatagaaaccttgtttctttaattaaagttttcaaaaggagagagaagtgacagaggcagaggaaactgaaagtcaggtgttagagggcatgcctcttggtaaccgtagctagaaaacaaatagcaacccaaactggcccgtcagccattttatcttctctgttccctggtgcccagtgctatctatttttttttttaattctctttattaaggtctgcctgtcgctcttctttcatcttctctctctgcctcttcatatctttccattttctggctctctcatctgattccttggtatcttcagtttatttatgttttgtaaagaaactataatagtagaataaaaatggaaggcgttatttaaaaaaagccatctgatgtaagtcagtagggatttttaggttaaaaaagaaaaaaaatcagaatttttttcacatttaatagcctaatatatctctaaatgtctttgaagtatataagactttgagcttcctgaaaacacagtttttcattaatagttcacaacagtgttttagctgtttcaaagtagtttttagatagtcatttactcttgataagagtgtgtaatcatgtgttctttctcttatagattcgccttttacaagtccacctctcagagaagaaataatggcaaataacttttccttggagagtcataacatatcactgactggtaaatgtatcatgtttcaaataatgcaattcgaaaaaaagggtttaagcaatttttcttaaacaaagctactgctttttgctttgcgaagtggtaatccctgttcctggcctggtgggaaaacataccagtagtgagctgggaatctaatgtggtgaggacgttttactgggggcgcacaaaggaggaaaatataccagacatgccaaggctaagaatggctccccagaaaatggatacctgagaaaagggagaatcaattttgatttgcagatactcttatgttttcattaattcttgctggtacatccattacatcactctaggtcaagaagagaatttgtgtatctgttggaaaacctttagccagagaaattaaagatgatatcaaatgagtcactgtgctaaggagaagcaagcaaggaactccaacatggcaaaaccctgtctctactacaaatacaaaaattagctggggatggttgtggacacctgtagtcccagctacttgggaggctgaggcaggagaatcacttgaacccaggagttggaggtttcagtgagccgaagttgagccactgcactccagcctgggggacagagtgagactctgtcaaataataataataataatataataataataataataatgtcttcatttaactttggatttgtttttgacaaagatttgtcattaatttagaaacattagatctcagagttgggcactgaatggttacatttccatgtaggttgttgctctagtgccttcccatcaaaaagtttggtcttagaaactacctttgctgaactacagaatttaaatttgaagatatatttataatttttagtgtcaatgtaaaataaaaatatcgagatgaatctctaaacaaaatgttttatttggtagaacagaattggagttcagggcttacacagagagtggaatggtcttcagtatgactgaaaaccaaagagaagtttagaggttttattagagagaaatgttatatattgttttggaagaaaactcattagcactagcaaagtttttgggagctaacaagttctgactggtgagtgatggtggtgggtaaattagtcttagagtcatggtggtttgtttcagaagctgctaggtaaaactggtcttaaagttataccaggtcatttcagcagctagcttgcagtattagccccgggcaggtgctttgtgtcctaagtgtttttttttttttttttcttttttactgggtctctggactctaatttagttgaaaatgacaagataactccaattcctgattatcaatttttaccttatgaaccatagactttcttcttactgctgttaagatttttaacctactatttgtaaatggagtgttttcatattttcataacattgatatgtatcaatattgattttatcattattcattgttgtctagaaacaatacttataacatttctatgttgttacttattattttctctttccctctggccattgtcgaagttaatctctctgttaggataaaatgtatcttgtagagagattcaaatacaatacgttaattgtaaattttggaccagaaagattttggtctggctcttgacatacatacttatccaaagattctcgagactggaaaacatatggattcttgtgcctgggagaatgaaaacatggcttttgattcataaaagcttacttatttaatatttttaaaatattgctaattattaacaaactcatgatgttgactatgtaccatgtttgtatttctaagtaacttaattcttataacagctcaatgaggtgggtactattactatttgtaatttgcaggtgaggaaagagaggcacaaagaggcgaagtgaactgaccaggatcacagttcctgagttggagcttatggttttcaatgcaggcagcttggtgcccagtctgtgctattagccattatgctttgcagcctttctttctgggcataatgcccagttacttgtttcttttaacagcattattaaatcaagtatatttatttttagaagaatgacattagttttgaaatgatgtagtaaacaatgaaaataaagctattttctaggtttattgctatttctaggcttatttagtaataaagctattgctttagaagttgcatttgctgcctgcaatcccagcactttgggaggccgaggcaggcagatcacctgaggccaggagttcgagaccagcctggccaacatagcaaaaccccgtctctgccaaaaatacaaaaattagccaagtgtggtggtgggcacctgtattcccttctacctgggaggctgaggcaggagaatcacttgaacctgggaggcggaggttgcagcgagccgagattgtgccactgcactccagcctgggtgacagagcaagagtccatctcccctgcccccccagaaataaagaaattgcacttgcttaatcataaatttgtgaaagtaattgacttgactgaaactaaaagtattttttctgctctcagaggttttaaaacagatcttttggtaatggactatttttatatcactgtacttaattttccaatgtccatagtatttggaattcattgtattgtttgtattaccacaatatattttttttgtttttttcctctctgcatattagtgtttagttgctcaatcagtgtgttatagtttaacagaagagattgaaataaaaataaacagctgacagtttccttgaccaacttgttaacgttggaatcacctctcctgtgttgacccaaaggcacattttatttacatgttgagatgtgagcagctctcccacaaggtccttgtgagccaaggagataatataggcagacattagaggtgcagatgtgcaaattaaggcacaatgtaagattcgggaagattagtcaagataaggaaaaacaaccacattgtctaaatctcggccagcaagaggtctaggttaggaccactcagattctaggggcaggtgattgagaagattgagaagaagaaaagaagtgaaaatactttattgcagaaaagattctagcatgactccaatgctgcaagtgttaggatattttttcagaggtactcatcaaacttgatatgtagactgttgatgcacagagaaaaaaactgaggcctaacattcatagagagtcagagaaagtaaagatggaagagggatctacccatagcaacacaagtggcagtggctgcgatcaacttttgtttttttaatatcagttttttttgtttttgtttatattaacagaagtattgatgtttggggctggatgattcttggttataggaggttgtttgcagaattgtaggttgtttaacaccattcctagccattacccactagatgtgagtgacacctgctaagttatgacagctggatatgtctccagatattgtcaaacattccctggggtacaaaattttccccatttgaaaattatccccactgttctatacattaaaaatgagagtcctgcatgtttcccatccccttatcttgggaatacacatgatttaataatcttgtgattaacatttagtaaagaatctcaccataaagttagatgatggtgctgaatcacaggcacaggacctcacactctgtaagtgggacctgtctcttccctccctcctactggtgttcaaatccttcctctctctaagaatggagtcaagatcccatcttcaataaagcacatatcagagaagcgcatatgttcctgcttctctgatatgtatttagtgtatttttgttaaattttaattctgcaagtaaaaatgagttgttttgaaaatattaaacattattttcagcattagagtaaattagaaaatctgaaaaccctcctgccacacctacgagtatctaaaatacagtaaacattcttttaaatatatagcaatgtacacaaaagtaaagaagtttctaccgatcaaaattggtgatcagggcatgaaacccgttaactgatattgtgttaggtttcctgtgtttgttgccaagatatttgagttttaagagctacaaaaatataaaaaacaaggccttgagttcatgcaaggaggagagttggaactgaaaacctgaagaaaactatccttcctaggctgtaaatatagggaaaggtttgatttagggaagaaaatcagccgacagcacaagatgacaagttggcttatttcttttaaagttttgttaggcatttaaaccaaaagattcccagtgtttcctgccagttaaaaataatgtgaataaaaataatttttttaaacctgcaaatccccaaagatttccgttattatttaaagacgtgggcctgtcctcaacacagtttaaattgcaaatttacattacctgcattatactgtacaggagcctccgagctgagaaataacacaaaaatgaccctggcaggtagtacttccacaggaaagcaatgaaaaaccctctgtggaagaatgcattgtccatcctggtgacataatccctgctgttacatgtctcaacatgtcacaaaacaaaaatataaaaaacaagcacacagtccctaacagagctaaggagcagtaggattagacattccagagcttcagattatagaaaatactaggtagagaaataaatatcaaaaacatgagaatgaatattatactgttttttaaaaagacaaagcaggttcaaaaaatatccaaatagaacttcaggaggtgaaataaaaaatgtgactgatgagtttcaagtctcattgaattacccaccatttctgtctctcttctcttctcctcttttacaatggtatacgctgttcaatgtgtttctttcccatgctgtgtatgtgtgtgtgtgcatgtgtgcatccataaaaactagtattgtttgttttctttagttttagtgctattagtccatatgtattctgaaaattgatttttgtcattcaacattagtttttggagatctagtcatattgcatatgaatctagctttttttttttttaatttgtatgcacagtataaatacaccagcttacttagacatttttttcctaatggaccctagttggctaatatatttttttgttataaaccatgtagcaagggataccctacatatatctctctgggcataattgtgaatgtttctctaggataaataccacaaagtagagttgctcagttagaaattatgcacatctttattttaacatatacttccagattggccttcaaaacatcttgacagttggcccctttccctgacccacgtactaggcttatattttattttttgaattaatttaaatgaggtaggcataaattttggatactgaatttttactttttatagaagttgcgaatattttttcccactttaaactttaaacttttatgtggtgttttttagttgtgaagaagtttcattatatttcctcctattatttgcatacttttccacctttcactttttaacccatttatgatatagttttatgttttgtgtgtgagaaggaactaattttatggttattattttgtactgttagccagcgtctcaactttcttaactgaatagttctccttttcctgatagctttgaaatagcactctaatcatatttcagttcccaaactctgttctgtttctctactgttacattgttttacaaagttattaaagtacttcccaaagtaagaagtacattttactttgcaacctgatgcaccaactgcatgttcacacacatatgaaacagaatattcatcgaataacacctacacctaataagcttgttatactctgataatttctcttttactccaatccattaaaaaacaaatctgttgataactattaaattgatttcctgattcactaatagatttttgcttgcagtctaaaaagttttgcctattttatttcattaatttcttggtattttatggcataattaacatgttagtattatttttaaaaacatatctttttatctgttctttttaaaaaaacagattttctttcttggactttctttcacatgcacttcttttttttaattatactttaagttttagggtacatgtgcacaacgtgcagatttgttacatatgtatacatgtgccatgttggtgtgctgcacccattaactcgtcatttaacatcaggtatatctcctaatgctatccctcccccctccccccaccccacaacgggccccggtgtgtgatgttccccttcctgtgtccatgtgttctcattgttcagttcccatctatgagtgagaacgtgtggtgtttggttttttgtccttgagatggtttgctgagaatgatggtttccagcttcatccacgtccctacaaaggacatgaactcatccttttttatggctgcatagtattccatggtgtatatgtgccacattttcttaatccagtctatcattgttggacatttgggttggttctaagtctttgctattgtgaatagtgccacaataaacatacgtgtgcatgtatctttatagaagcatgattgataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatggccattctaactggtatgagatggtatctcattgtggttttgatttgcatttctctgatggccagtgatgatgagcattttttcatgtgtcttttggctgcataaatgtcttcttttgagaagtgtctgttcatatccttcgcccactttttgatggttgcatttcttaaaattgggttctgtaaaaaatactcttggaatttgactgattcttcacccactctgtagatttattttggggaaaattaatgtttttatactattgccgtctgtgatttagatctcattttatttgcagtatctgttgtagttaaacttaattgtagatatttgtgtttgagttatatgtcccctgctagattagtaattttaaatcccctctatatcacatatagcatataaaagtactaaacaaatttgttttggccaatggatgagtcaactgtgtgagacaagaacttcttatgcatttcttgcatatcccgtaaagtactttccacctagaattcctcatataaatcatgaggcagaattttaatatgcttgaaccttcagtctaagggaaagtgccttatctgtctaaagaagtgattcatgttttaagtactgtattccgggagctacaaccacttcaacaaaaatttattgaaagcctcgtttacagtggtgaacatggcagacttccctttctgccctcctcccccgatgtcatacagtgtatgtttcagtgggaaaggcaatggataagtaagtaaacaaattaatatgaaaggtgaaaccggacagtgccaaatgctaggaagtatataaaggaagtgtgatagagagagtctgttgttagcagtgttgtaaggttagaggagccctttctgcaaaggaggcatgtgacctgagacaatcagtcacttggggtgtgtacaaaatgtatgtactgactccctgagtgtctgcatggttagcaccttagaagttgataccatgagacataaaccattgtaagactaaatatcaaggattggcatcagggtgtaaacacctgcagtttggagaaattcattaccaaggtagcaggccatgctttcagtttacattaggtatttatgagcccttatcttgatctggtgtgtgctgagacttgtgtttacctctcctttgatggaatccagttacttttattgtattttattttttaaattctggggtacatgtgccggatgtacaggtttgttacataggtaaacgtgtgccatggtggtttgctgcacctatcaatccatcacctagacagtaagcccagcatgcattagctcttttccctaatgctctgcacccctgccctccatcgacaagcccctatgtgtgttgttcccctccctgtgtccatgtgttcttattgttcagctcccacttataagtgagaacatgcggtatttggttttctgttcctgtgttagtttgctgaggataatgacttccagcttcgtccatgtccctgcaaaggacatgatcttgttcctttttgtggctgcatagtattccatcgtgtatatgcaccacattttctttatccagtctatcattgatgggcatttgggttaattctatgtctttgctgtcgtgaatagtgctgcaatgaacatacgtgtgcatgtgtcacttttaagtcctttgttccatgtgatgcaaccatgatggggaaaggagatgaagggatgaagaggccaatcttgaatgctttccacaccctctccagtcttcactaattgtagcaacactttttatcagttttatacagttatctgtgtgtgtgtgtgtgtgtgtgtatgtgtgtgtgtatgtagtgggggttctgtttaagttttcctgtgatttatttctgaaacaattctgctactaaaataattttgaaatccattagaataatccatttcaaaatttaaatggttcttgtactggggaatcaaatgatatgacattgtcatttgctgttcctttcttccattatattgaagtggatatgtgcaaaatggttcaaaataaatgaaagctttttatcaaggtagagaaggcagaaattagatataaagattggaggcaagttgttatggcttgagatgattttgatttgtaaatgtagaagagatggaaaaaatactaaagtgtgatttatagctacaagaacaaaagggcaggactggccatggaggggagcatacagggccagggactggctgatctgagtcctggactgctacctcagcctggatcttgtcccctgtgtaacctcaggtattgtctttcaaatgtgctgaactggtactatgattaccactttgcagaattcattctggggaccaagtattatcatatgttctagatatttgtgagctgccaagtgacatcagtgctatgtaattttaataaaatggaaggagtgcatagatgaagtatctagtgtaaatcttgataggtgtatatggattaggttaatgatctcaagcccagaaacagtctatagccagttaagcaggaaataatttgttgaataaaggattttggctagcagaattgatgagaaaactggaaatcaagttctggcaatgccaaggacctcaggctgacagacagcaaggattactggaagagtctgcttaagatatttctgcaggcactggactcttgatactagggcctagaataaaggcacgtgatatatttttagtaaaattgttgaacgagtggataaatgaaaagcacatggtaggtgttcggtaaataagtgttaaatgagtgagtgaaagaataatgaggcacaatcactgctagacacttgccattgctattgtgattaattttcagttctgcctaggtccctaactccctccctctaactttacagccatgagtagaaggttataattaaagtggccaaaccctagtgctcagctgggcagagagaagaaatatctgttcttaggtttccgcagtgagtgagtactttgcctatcaccaaaccttacacggatgggaagggtgttcggattctggttgtccaaaaatatgatcagtggtccccactatagtgttggattaacttcatgttaattatttggaaacagtggcaacaaatgtatttggttactaaaacagtgtaaccatttactatagttttcctgtaattgatgtaaacaatagttgcagtgttctctatgttgtagaaaaatatatttaattattggattattacccaatgttattgtctcaaattaaatactgcattgttgaaacaagagacatgcaattctggaattcaaacagaattgtttttgtttttctttgaaatgatgttaaatcagtttagaaagtagagaaataaccattacatgccttaatttctgttactaaatgaagtggaggaaaacagtgactgataggagctttgtttagtgaaattcaactagcatctcctcttaaataattttaacatattttccaaaatattgccaaatctttgatgaattattttggaaaacctggcttcatttgtgtagaagccattcatgttttctggtatttctctttcttttgaggatgtctgtgtaaaaaaaattctaaaagtttgaaaataggctcagctcatataacaccagccacatagttcataggtcttgagggagtctccagggattacttggagattttatatacatataaaaaagtatatcaaggtatatgtactacattttactcaagttgggtttatataatttcaggtttctctgtgcacattggtgatttcacattttaagtttatgggattcaggaagcacgtgtgttttaggctgtatcacattggtgtggcactaatcagatggcatgtaaataacttgttgataggatcacttaataaaccatcatgattcttcaatccatatgagacttatttgggagagaagtgaaattacaagaatcaagggattagtattatgttttataaattttggatataaactttgagaattttattcttattcataagttaactccatatgtttaagacgcacaacattaatgataaaaataagatccattgtatcatttttatataggggtgttggcctcatgttagtgtggccttctgtttctgtaaggattctggatgtttaatagacattttgggttgcatcatgaagctttattgacttttatggtgaaattattacagggcaggtgaatccgaacattggggtttagcccgagaaggttggctcaggaaagaattcaagagtgagctggtggtagaaaaatcagctttattgaggcagggttgttacagctctgtgacttctccttcagagcaggggtacccctgggcagtgtgtcaagagtagcagctcagggccagttctgcagccatgtttatactacttttaattatgtgcaaattaagggacaaggtattcagaaatttctagaaaacagaaggtaacttctgggtcattgccatggaaagggatggtaacttctgggtgtagccatggcaatggtaaactgtcatggtgctggtgggtgtgtcttacggagaggatctttcgttgcctcttccttgtttctgtcagtcttcaatctggtccagagtcacattccacctcctacctcattatgaataatgaaaagtcaggctgatagggctctgtattttctatcttggcttctgtcagagttgtcccatcgaatccgtcgtatatgtcacagttcacttaactgtgtttagtaagggtttctatctttaaagcatgtttggaaacactatcctatgcaataaattttaattggcttcttccatattttctttttcttaataaagaacaaagcagacttttatttctagtgaaatggtttacaagattgggtcctgaatagacccaagaaaatctaaatgtcatttctctgaagactgcaaattgttgaaaggcccatatactttaaaaatgttacctatgaaaataagaaattatttagacaggtataaattactatatggttttaagaacagtcttgaaaatacgtttcaaaaacaacaaattgttatcgttttagaaatgcagatgtcatagatgtttttgcagcactctaaagcagcaaaaatgcattgcagttgtgcagtattaaggaagttgaaacatcgttgactgagctcacattagtttgttggctaaccacaaaatatgtaaaaaggtagagctttttgcatgtttttgatgctgtgatttcttgacaggaaggaaagcaaactgcagaagcacagcaaactgcagaagcacctgcaaagtattataggaaacagtgagacaacgattagggcttggaggatggcctaccattaagaaaaactgtgttgcactttaagttatgtaaaactatgtttagttgaaaatgtgtatttttaaaatattttgattgcactgttcattttatcatcgcattcatattggtatatagctacactgtacatttctttaatcttctattaatattttcttttatttaaaatcttgtttcaacagtttgaaggtgatgaagttaattccattgtaatgagaatttaatatgtttgagagttggtatattctgttggttatcacagtctggactcaggcatacctaaatctgagattcagtgttgcctttgtcttgatgtgtaatcttagacaaaatagcctctctttgcctcatctctaaagttggaattgtagcagtgatacttacctcataaagctgttgtgaagattaaattatttaatcaacatataacccttagcaccatatatgatagtttttataatattccccagtgagataatggtgagaagaagtaagtgggcatttattaattgctatattatattactgttgacgtttcttatgatagaactttttacaatctcatggaatattattgtcccaccttacaaataaggaaactgatgtctaatacaaagatactttgatttgcacatgcaaggtatagaatcaaggcagttaaacaatttgagttttgcttaaattgctccaaccaaagttgtcctttggttggagcaagagaagctggccaagagaaattagataatttacctggtcttggtgaaagataatgaaggccaataataggagggttggataaaactgggcaaatttgtttgacattttagcggtagaatcaactaaatactactgcatgtgattcagtgttataggtcagcacaagggaatattaatggatctcttggatattttgagtttgaagttctcatgggatatccagatttagatgctccgtagacacctggagctgtaaaataaaaaaacgacttcagtggaggttctaattttgcaagtaaagagcattagagttaatagttgaatccaacaaagaagtgccaaattgagaagtaaagagaccagagagcaaaatcctgatgggcaccaacatttaaaaggtagttggaataatttggtgtggctagcaaaatgtttaaaatatactaggatagtgaaatagagcacagtaaagggaactgcaaggaataaggtagtctctggcaatatatgtattctagagacatcaaatattatttttctttttgagcattaaattcaattcagcaattttgcaattttacaagcagttatttcaagcatgtgctcacaaagcactttgcacgagctgtacttcactatctgcaaaccttgcatctggtccttgcttatggaagcatttcgtaaagtttcaaatgtaattaaaagtgatagaatttttttttttttttttttttttttttgcctgagacagggccctgctttatcaccttgcctggcgtgcagtagtgccaccttagctcactgcagcctcaactctcgggctcaagagatcttcccacctctacctaagactagatgggaccacaggcatgcactaccaagcctggctaattttttctttttttttgtggagatgaggtctcaccatgttggccaggctggtctggaatgcctgtgctcaagcaatcccacacacctcagtctcccaaattactgggatcacaggcatgaaccattgcacctgaccattttatttgagttgtattatttttctttctacattttggctctgcattctacatttcatcatactataccattattgagaatgagaagagcttgagaaatttgtttatatgatatactaccgtcttccaaacacaactccttctcttccccttaagagtaattaccactattctgatttttatgcagtcactttcttgcttttctgtattgctttattacccaggtatgcatccctaaatattacagttcagttttgcttttcttttaatagtattttttgagtatcttataatcttcaggtgccccaaacatagcacctgacgtccgatacaaagacatctctctcccttttaaaatttatctattgaaaaaaccaggccaggtgcggtggctcatcactttgggagtccaaggcaggcagatcgcctgaggtcaggagtttgagactagcctggccaacatggtgaaaccccatctctgctaaaaatacaaaaaaattagccaggcatggtggcaggcgcctgtaatcccagctacttgggaggctgaggcaggagaatcgcttgaatccgggaggcggaggttgcagtgagctgagacgacaccattgtactccagcctgggcaacgaggctccatctcaaaaaaaaaaaaaagaaagaaagaaaaagaaaaaaccagatcatttatttgtagaattttcccagaatctggattttgttgattactttcatgaaatgtaggttaatgtgttcttctataatccatgtttcctgtaaactgggaattggatccagagacttaaccagtttcaagaacctcctccagcacctttttttaacaagactatatcctaggtagtggggtattcttcctcaagagagacataattctgtttttgaaattattgcagcagttgatgcaaaatgcctagatccatgattcactaggggttgcagcatcattatggtatatttgtatgatttcttttttattcatttgctggaatttttctataaagagaacgtttattttctctactgtttggttagccagtgatacagttagtgtaggacaaacaaggtacatgcttaatattttttctttatttgccactgttcaaaattaaagttagtttttttgtgttttccctaagtgtgtgtgtgtgcgcgtgggcgcgtgtgtatgtatgtgtgtattgttggatagttagtggttgggaacttgagggttaaactgaagaaagaaaagacaagtagaggctcttactgctcttgctctagtgcaccctttttttttttacaccagtatcccagaaatcccagatttctgggatactggtgtaaaaaaaaaaaaagcttgtacttacctgctgggtcagaggtcctgaaatctcaggctttagaaatggggttggagtggaagggtggggagtcctaaccattccatattccttgccaaactgtcagggaggaactttttctctgcaattctctacaatttcaggctccgcgaattaaactgacaaaagatagattagcaaaacaaaaagcgtatttaataacatatggacaaaagttaccaaaacatgtagctcaaagggccagttaaaagtgggggcttatacaccatcttagtagggtaaggagaggaggagagaaaggcagcttatggaaaaacgaaatgagttttaggaaagataaatgagccctttaggtaacaggtggaagatatagttttgtgacagtgtctgtttaggtgtggtgtgaagatttctcatgttcagtgatgactccattctccctattgctcctagggaggggatttatgacaatggaggttttttggagttcctttgaaaggctctgcttttagtcagagtagctattttaggaactcaaatgccttctgctcaaaataatttgtatgctatccaggcatattctggaccccttcagtgtgtgtgtgtgtgtgtgtgtgtgtctgtgtgtgtgtgtgtggtgtgtgtgtgtgtattgttttcaagataaacacctcaacttccctaaagcttctctaagggttagctccttctcttcccacctgtagatgggaagagtaattgagaacctttcagactactttttaggtacaagtttaaaaaatttgctaagagggaaggtctaatgttaagtgttcttatgataatcaatcaatccaaaataaatatctattttgaaagtcaaaaagaaggataaacacctcatgaattcatactgatattgaaattcagtcaaaattcagaactactggatgcttatttaaattctctgtcttgtacctatgtctatatccagtccttacaggttctgaagaagactaggaatggttagaatataatatatcactcaaatccatgttacacacaaaacattctctagtagttattagatccataaaacttaataactactaacaacatgattactcaaaattattgaaacaggcattccattctcacccatgagtgtgtgtttgtatttacagttgtgctgtttttacactgtcagagcatacggcacatgttatagggtactctctaccctatattctgctcagtatagagcttaaggagataactatcacagctttaggttttttttaattgtgttaatgttgaatcaaaacttttctttaggtgtgcatataaaagggaataagaaagggaaccaactatgttgatagaggaataattcttcaaatgaatgttacattaagaaattgtcaatgaaacactgctgttaataatataaaaggttttatgtgttagattcctctgaatataactttcacattttgtcctcttttgtgctaatagaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggtgagtatacaaattttaacctaccttgctcaccaaaagtagcttaattctaaatatttttgctgactgagcattctttcctctgcagccacttgaatgttatgctaatattctaatttgcatatttacagaattatttctctttttaaatttttattaatggctaagtcttttcattttcattaaggttttgagaactaagcctatattaataacttgaattatctttaggttcaccatcattaatagcaaacaaatgggaagttattcttgtttctttcgagaggaaaaggaacaaaggggaacatttaatttcaaaggtcagtattaataacttgaggaatagttaataacttcagcattatgttcttagatttctcaatcctgtaattttaaaattatttttacaataataaacataatgtagctgaaagaaagtcatatgctttccagagccacaagaggcagccttgaaaatggtcttgtatcccccaagtccacttccttcctgcttctattcctcaatttaaagcacatgttttagttcaaaaggccagcctaccacattattagtgaattatatcagttgcctgaatttctttatttatctctctaaattcatagctcttataatagtcctccacgtttctaagttattgtggtcccagcctctgagagtgtgggttgatgttctatatccatagctccaggacatgggattttaggatccataaaacttaaaaataatatggagatgcacaaacggttgcctactttttatctcaccaagtaaggaggtttaaagatatatacaagccacagaatatcatccacatttcttttgcttggaaacaaacgaattaaaatattttactgttaccatcattaaaccaaaactcaagaaggtctcaatctcataataaagactagttatttgagttagataattatcattatgaaaaacccagtattttgtggtgattagtgaaccatattatcgtgctggtatttgggaaatgcaatctgtcgccatattaactacgtcggactctgctttgcattaattccccaggaaacatgaaaattgttgtaacttttcctaaaactcctaaagcccgactgtctgctgtgacagaatgtggatgctattctcaaggctccatcaatagcagaatggcttgcttcaccattgccatgatctaatggttcactcctgtgtccctcattgcatcccttctgcactcacagagtcattttatttttatgtctttgtaattgttccaatgtggtgaatataataaattcttgtatttatatatcttggtctctccaaaagcagaaactagtatcattctttgattattttagtcatgtatattctttcttaacttttttccctccatttgcctttaacttggtgaaggactagataacaccatatacatttcctttcagtttccttttccttatgcatttcatttttccctcccctgccccatctgcccttcccctcctctttccttaatctctcttttcctttccctttttctgtcctttcttccctcccaccttttgagttcatttccttccttcccttcctgcctccttccttccttttttcctccctttctctttttcttcccaatgagcaaaaaataatactaaacacacaaaatttcagtgaacatgttttattgagtttttaaaaaatatgtaaagaaggcctacagattctgaggaaatgctcacagaatcttgtgacttaaagtgctcccaagatattcaactttaaacacttttttctttttttttctaagacattgtgctctggaaatatatactagtcatacctgctttcaatattgaagataacacatttttctcattagttttgataattacttaaattattatgtggaagtgaccattcttgtgtctaatgtgaagattaacaagcattttacttttcaacataccaatacattgaattgcaagtattcacacggaaggcctcttgattctccaactgttttgagataactaagctgattttggctggtgtcagcagcgctgacccaaggcctaggatttaaatcaaggctttaaggaaagcaaagaatcactgaacatttacttttttttcttttctagttgtcttgaagcagtttaggttagctaatttgtttttaatgcccctttaacattaatgtaacttttaagtatgtattatatcttgaagatatttataaaattaataagttgggtccttttaaatcttccttggtaaaataaaaattccctataattcatctaaattgaatattgcttacagaaataatttttacttgagtagtatttaaagacatctgtacattatggatattatagttatttaataggtctgaaaggcttataaaatggtgtgtatttttataaatgtcctattatattatttctccatatggtttacttaatggtttttcctaagaagaataattatcttttcttagaagacttacaactgcatgtagatgaaaagactgttttattctctattttaaattgaaccaaagataaatttttctgccattgactacatgagccacctatagtgcatgagcctgagtcttcagaacaattcatcagcaaagtccctgctgctgtctttatgggtgctggttgatttactactacaaagttgtaaaaggccctcaagattactgattagttcaatgcacaaaaacctgctgactttatgtgtttcgctcttgatgccaggacagaggagacagcaaaagtgtacactggaagtttgtgactgctaataagttgctgattacttgccacccgagaaagagaaagatgagtgatggtctatagtgtttctcagtagtggatcaaatattctgagtggttgctgaaagcttccataatatttatcagtgttaaaatctcttagtagaaagtatgcagaaatttaattggtaaagaacaagaactttttggaagtcatgatgagattttgatagtaccaaatgtagtgaagcctgtcaaagctcaactatctgtcttcccctggaagtatctaaaaatataaagtatggaaaggtagcataatagaatcagctaggacttcagccctggatcccagtgttgaagtatagttagcattcttttactacatggagtaatcttttttcctaatttagtggtacctaaaagtctttgaaccaatatgacatttaggccaatttgttctagttcatgaatatacaaatatagtctccaattttacaactccagagagctgttactttcactgggtatatccaaaccccatcttcctagaaactagcctgaatcagcaatttcaccaccttcaaacctggtttattccaaccctagcactcgtatgcatcctactttatgcaaagtcttaaaaggtcgacagggcacattagaatactgtctcactgtccttatattagtaaatatttccaaatataagctgtggccctgaaccccagaatagttcaaacaaatgtcatgttccctgaacatagtgcattttataatttaaatccacactgctgttattagccatatatagcagaacaaaagcatggtttatggtattttagtcattagtctaggggataatcaagaaaactgaagagatggcaagaaaacagaattttggtttcagcttttccatgttgtcactcagtcattgtcagctacctgcaatttacagcctgatcttaatatttagttgggatggtttaataacatagtcatgtgttcctcatcaaatctcagaatactcaactttcttgaaaagcgcctcgcagcttccattatgcttcccaagcaggtagctcttcaaggaatactgaaaagcagtgtatattctgccaggtttttccccaagaattacctttcttccacattttattcttagcctgtgggtaaattttggtattttgaacctatttcaacacatattttcatgctaaagcatgactcaattgccagaaagaaacatgtagagattgagaaataggatatctgagagataaacaacctgggaaagcggaaactgtgtccttaattactgagtgtctaatgcaaagcctgcactccaaaacagtgtttgttttaaggtgagcctaacagggctgttgaggtcattgccctagtaatgcactagtgcatcttgtgcctcttcagatggaactcaggaagtgtggctgctcttcctctcaggttgtagggaaacttgtggcttcagcaaagaatccctattttagccaagctccaatctctgcttatctgcaggtctttagttgacatgatttcatccattctttccctactggcaaactaaacatataaatgaaaaaagtaaacagacaaacacacgcatgtgcgcacacacacacaaaaccaaaagaagcaaaaaacctgctaaaattgaaaaaagtaaaagaaaaaaattaacaaaataatcttagttgatgagtctacatcttcagtgtaagtgtaccttctataatacatctttaaaggtcaatcagaaggaactgattgcaccatgtaggctttttattgtactgtttatgctcttatcttttaatattctttaccaagttattacatccttaaaacttattttttttctaaattcagtgctcatttgtattctgtttctaatggaatctacttcaaacttccttgactaggaaatttatcataatggatattagtgtatatatatatatattttacaaaaccacatgaaagaatttttaaatcttattttctttcttacgctgttctctttctgttaattttcctttgttccttgttcccaccttctctaactctttgctggcttttcataaattagtatcaactaaagatttcctatcctggaaattttatctgctcactcaaatgctacctgaggttaaaactttgaagaaaataattactctaaggtaacttagtaggtgggaagaaagaacaggggtttgaaaacatgaagcctctttcttacccaaaacatttaacttatccaaaaaggaacaatacttttgttgttaggctcaataatagaagaccttccatttctatacattggagacaattatatcgaatctatctactattattattactactaactacaccctaactactataaattagtttcattgatatataactgaaagtacttaaaataatgtaatgaaaaaatgaaaggagacaatatctgcacatttaatacatttcctttacctaaactctttcagtaacatacatttctctattttattctcagtccctgaacttcatgggaaaaacaagccattgatctcttacgtaggggattctactgtcttgacatgtaaatgtcaaaattgttttcctttaaattggacctggtacagtagtaatgggagtgtaaaggtaagatagttccttgatttgaagaaaacaacaacaacagaaaacatttatttaaaaaataacaagattgtaacagactcagcattcctaagatgatttatacttttgttatcttgttgtttagcttatgttcataaagaaagagcagtgacaaacagagttgtcatttgatggtttttggcatgtttacgttatacatatgaagatactcttaacgtttcattagctggtagtttgttttttaggtttaacaatttaattacattctttgaaaagaaattacattttgtgtgtagttgcctagtttagaaataaccccattagaaaatattctttttaaaaatcattccatgaaagtaactagaaaaaatgctagacatctttttgggcttctgtctcctgaaacatctgtgatagaatgcaaaatagtggcactatttgagaaaataatgaaaactttgtaacttaatcttacatcttaggttctatcagaaagtgtcattggccttttcaagctacctgagagaagccaaatacttttaattccttttttactgagagaaatcgctattcaaagagctgatattaagaaaaacatgagtattttataaataatttctggtttcctttcttctccccaaatagcctctaatggcaggaaaatttaggacattgtcctttaagagacacccttcctttgccctggcactaagaagcattacaattaaagtcccgttaaaggcaagctataattgtagaaggaacatgtgagacagtgtagatgttacaatgaaatattaaattccttcttaggcaaaattggtgttattatagactattgaaggatgacagatgattcagaagggagtgtgacttattctgtgctaacaggtttagtttttcaatgaaatagttccaaccaaatcccatagatgcagactgaagccattcctactcctttatgtcttctgatggatgatgaggaaaggcagtcattgtgtatatgtaatttttttttaaaaagtgtaattttgtaaaaacaaatgtcaactatggtatttgaaatacacagctttatttattgatgtgtatgtggtacaacaatatgtgaaaaacattagccttcatctaattatatcagatgttgaaaatgtcgttttagacgtaccagtgcttttgtccattgctatactagtcattatcctcttaatttgactctaagcatgagtcttattaggatgtgagaaaagtttggggaataggatgcaggtcaaaacttgagcacaagtgccttttcaaaatgtagaccaaccatgtgcatcagaatcagctgggtacttattaaaaatatggtactttgattgattagctctgaccaatctgtaccaaacattccaggcagtgttgtgcacatggtgccaggttgctgtaattttttttgcacgaataatatactcacagataattattccttggataagctctgagaatatttgtatgcagattagcatttattgaatagcacggttgagtgatggagcaggaaaagcatcaaatggcttgggaataaaatttaatttaaatagattaaataaaacagccccaaatagcttaatatggcaccttgtgaggctgtggaaaacccagcaaatcttagaagccagcttatctgagtgagaaagaaattcagatatgaaaagacagaaggtgtgcagttcacttcggatcccaggctcacagagggtcccctccattctatctacatcagctccaaaagcctgagagtttcatcttcatttctagcctggggaaatcacattgtctgagtgagcgattttcctttatagaaatgatcagaaatagtagcttccggggtggtagttgtttgaatatgtgcctgtgcttgtgaaggaaaaagtactttaaagcactaggcaaggataggaatgtgagactcagatgattgggatttttctgtttttaattcttctataatatttattcatgatgacctatttgcttctttgtagttttaaacattcactgctaaatccttatagcaatgtatatattttttctttgtttgctccctgggagatcaaactctgataagacttaagtctgttatagataacctctcacaaactttaatatgcctttctctagtaagcaatattgttggcattatcttatagctttcactgaaaaactatgtcatgtatcttttatgtgctatgataggaatggattttaatgtctcctcatattaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcaggtgggatttcttttttttgtttttttttttttttagaaagtattatcagttaattataagtatcatttacttatgatatggattatgatttgatacattgcaatgactttaggatttttggggaaaatcttcattttcttatttggagcagtatttaggtttacaacaatggtgacagtgagctggaaacatatacccatggtcttcctgtttcaattcctgaaaaaacttagtattaaaaatgccttttttctttctcttcccccaccacccccctctttttttttttttttttttttttggtgctactggtacctaagtaccaattaggtgatatgtattctggcactggaatattagaaaaatctatgatagcttaatataaaaagtctaaaagaaacaatttttctttcacttagattatcatttaaaaaaatattttattaaccattccagagttctcattaaagagagaccatcctgtcatgtcctatttttgcggcctgtgcctgatgggttacaggttgataaagcagtaatcctctagaaaattgaccttacgtcctgtattctttcctgattttatactaaatttttaatgatttaaataatgacaaactaagcagtcatgtttttgaaaataccaggccactaaactatgtttgatcagaaatgcagataaggtctgtagtgcagataaaggaggtgtaggtgtttaaggtagcatgtctctccttcattccaaacaggagaaacagcatagtacttacttacttaggaaggaggtttaattgagcatatatgttccataaaagtgacaaaccaacttcacagtcaaattcttcttttgttacacagatgaggggaaagaatttgagcagattgaacagctgtaagtattattttttacagattaattttcacttgggtaaaatacagggaaacataaaattgaatgaaatgtttgcagttagggggagaaaaggcagaggagtattttctgtatatgtccacgtggtggtggaaagtggctttccaagtctgcctacctgcgtgagaattcttcttcatcacttactacctgcacttctctgtacttcagctttcttctctacaaaatggatttaataatagtactcaccatatgaggttgttggatggaatgaatattatatatgtgtaaatgcatagcataggttatggtgcacagaaggtgtgcagtaaccatcaggaagtatttaatattattatttttaaagcaatagttctcaagcctggcaatttttgatcacttaagagcctctttaaaaaaatacagttgctcagaccttgctgaatctcctggatcagaacctcttgggttggggctatggcatctgttatttcttgaaaacatctacaaatggttttgatcctctgtctgttgaaaatcactggcctagaattctattagttattattattcagagaacacaaattgtgccacaggttctcttacacagcctttgtttagagttaagcatgaggaggtctggaaataaaatcaccagggatgtaatttagtttggcaaagatgggagttccgaattcctcgaagccagagaactgagtatggaggccagtgacagaggtgtccaagactgggattaaagcctgaacaatagagccaagggctggagtccaggaaaacgaggctagattaaagttgctgcaagaaacctgagaagtggaaggcctgagcaactataactaacacaaaatggcacttagagtttatcagccaacaggagctctatggagtgagtgttacaggcatggatagcaggagtggagcagacagttgtcatttagatgtttgtagacattattcaaataatcatgttgactccattcacataggctgctaaaataaaccaatatgatatgagcttccaagttaagggcacaaaataactacatcagaaatcctataacaccagatagagaaaagcaatgttgtcttagaatcatagactcccatagttggaagggaattgtatctctcccaagagaatcccttctctttctggagaacatagatatcttatttatgttgatttgaacttttaatctttcctatttccacgtattggcgtttttcttgttcttagcatcatataacaaacgtgacagtcattgacatatttgaaaacagaaccttgctcggattcctctattctccgagctctgcctcccactgtctctaaccattcttctgagctcacatttggaagttgcattctgatttaaaacacactctgaaaggatggtaccagaacagtgtggaatggaccatcacttctgaacaatgtaaaatggattcaatatatagtgtaaaagatgaattatttttctgaaaattggatcaatgtacatcattttgctcatcttgtatagcaccataaggatcactgaaggtgtttagtttttcttcaggttatttcactatctttagattgtatacaaatatcaagggcacttgaaatcattcagaacaatgagcttcttgatgtccctcaaaccatttcttgcaatagttgctgaggtgttttcttagtggccattattctgcttttgaagagtacacacaaaagaaaaacaagcactcgtgggatttctttttttttagaaaatattaattatcagttaattgtaagtaacactgtcttataatatgcattatgatttgataattgacgcctgcccccaagaccttgaagggcaaggtattcattatgcatactggttatttagtttccgtcaatctttagaatctgaggcccacatttgtagtcctgctctgataaactttgggtggaaaaagaaccatttttaacctctatttcagtgtaataagcatacaaatgtatagcaccaatatcacacatgttggctgacctcctaattggctattaccttgcatgtttccaaaaccacacataagttatggtctttacgcccaagtcctcactcatgcttggggagaagcaattctccctgtgcataaaatcaacaagcctttgtcactatcatttgtggtaacagctcctcttcaagcaatgccataaaataaattcaacattgtaagtaaaacatttttaggaagaaagaattctgtccgtattgacattttacattttaacctgatagccatatcagtgatgtactgacttaattttatataatataagcatttagtaattttcttttttgttttctgtgcaggaaatcagatgatagcaatggtatagaaaataatgtccccaggcatagaaaaaatgtaagttacttctgaatgatattccaaataaaaggtcaaattcaatatacataggctatctatcaatcagttacttttttttagttccataaaagatctggtcatttatgatgtgctcaaatatgcttgttaacactattataggggaaaatatacagtatagttatacaaaaataaatcattttccaccagagggcacatagcaactaatctagaagtaaatcttttgcactggctacatattttattttatcaccacggactagtttcttttacaatttttcatgtagctttatttgttttcctctaaaattttctggattttctgttattttagtttcatttattcccatatatttgggggtataaacttatgcatataagctaactttctttgctgattagattcaaaatttttagttcatcaacattagagtaggagctctgttttggcagtagattggatccctcacttcccagtattttttgctttgctaaagtgatagtaagttactataaaataaccagaacatactaattatatttgattatgctttatttaactcaggagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttatttttttaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaaactatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacagctaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatttgcttcttttactttgaaaaacacatagaatagtataaaggtccagtcatattttctgtaatagtgaattagtgtcttgtgagcaaaatgagttctaattcctaaactattacacagattacgttgctttcaacttatttaaatttcccttgttcttcatgtttcatggacagtacaaatgcaaaccttatttttatcctttattctaataacataatgcattgattttaaatgtaaagaattttaggctgcatggtggctcacatctataatctcagaactttgggaggccaaggaggatggatcacatgaggataggaacttgagaacagcctgggcaacatagtaagaccctgtctctactaaaaataaaaaagaaattagccaggcatggtacttgcctgtagttccagctacttgggtggctgaggcgggaggattacttgagcccaggagtttgatgctgcactgagctatgattgccactgcacttcagcccgggagacagaggaagactctgtatctgttccccccaaaatttagtgattgtatttctttacatcatactgtagagagttgatgtttgtgttcactccactaacctcattccactttcccctgccagtatacttcagaatatctcagatccaattcaaaatttaatcttaaaaggtataattattttcacagtttcatagtttagttttgatcactgaaagcatttctttcattttgtctaatcgaacaaatttatgcaaagaattggggacttattcctcattagtattgttcatctataggtggaaataagttcaagtatgtgttgcagtattaattaaaggcaaagtgacctacttgtactatattctgaataaatacttattgaatgaatgaaaaatagaagagtgactcaattattttagaatcttaagttatacagatttatgtaatgtctattttgatttttattaattaaccatgaatttatcctactctagtattgagaaaaagaaaatggaactatagacccttctttcatatgatacttaggaatgtatctgcactgtatccagaaagtcagttacatgccctgtttaccaattgaattctgcttcactaaggataataataactgacattgagtgcatggcatatgatgggcactgtgcaaattgctttgacatgttttgttcatttaatccacacaatggtcctatgctataaaaacagttaatatctacttttttaatagatgaggaaactgcagcttagagagattaggtaagctgccttaagtcaccctgcctgtaagtgtttagagctgagattcacattcacggagtcctcctgaagaacctaggattaaccaccacgttgaacagctttggcctgcaagttacatgcttcttagaaaatgaggctattatctataatctgtattttttaatatcaattttattcctttcaactggtcagttatatcataaattccatggaatttttatggaatccatgctttgccactcttgtatccctatagtggtgctggggaatcaagacacatttatttgccttagcactctttctttctttctttttttttttttttttttgtaattttacttataaattgggagggtggccataaaatttatcatccaaccactgaaagtgaaagaaggtgctatttatgatttccccaggacaacaggcagaaaatagtctctggtcgtacatttagcctgcagagagaatttaagtacattatggatagtctgccatagacacagcagtagcatctgcaacaagtaaatgataaacaaaaatcaactttcagggaaatagccatttttagtagtaaacatagggaaatagccattttaagtaaatgtcaggagagtctcactataaactgcctataatgagacagtttagtaagcttaaagttttattaatttccaaaagcatctaataggttgagatttattggcattcaaaagtatgattcacagattgtaagagaagctggcaaagaaagtcatgtttttgctggcctatggaatgcactcgagaattctttgggcttgcatatcttctgattcatgtgtcataataataatgtctgtgtgattctcagtgaatcatgaatgtgtgattgtgcttttatgataaaattttcttatgaagtcagtgaaaataattcatgaataatgttgtcaaaattacttttaatcacaagattaacctgcaacaactatgtatattatttttatgtgttggcttattatgttcaaaaactttgtttataaaaactgattttgctatttaatttttaatttactttagaaaataatgtagcacaatgttagatttattacatatgtaacaatactatttaatgctgcaaaatcatagcacatgtttgtaactatcacattttattaactgtctttgtacttttaaagaaagaaatatgatcataatctttagttttatttaaatcaaggatcatggatttattttgacatactttctaataattataattttttcctttgtaagcatatgtgcctaaattctcattgagggctttctgtactgtgtaaatagcacagaaaatgtctatataggaatgtttaaaaaatattttctgttgcatgtaactgaaaagatacatctaatatgcaattaaattgaataaaatagtacttagtgaattaaaaagttaagtattgaaaaacattgtcatgctttttatttttaatagtggtttaaaagagaatataaaggcactaaacagaaaacactagttttttttttctttgtgtatactcacaaataatttaaatcatgttgaacaatatgtccttctcaagcccagtgaaaaagtgcacctagagctgggactctagtttaacacatcgaaccaaaagtctttcagaaaggaattttcaaagtgtcccaaaatatatttgaacaatttaaaaggcagtagcgaacttcataaaaatagatattttaagttaaaatgatgcagagaacaaattttcttgttgttctgggtaaatttttttcattatattttaagttctgaggtacatgtgcagaatgtgcaggtttgttacataggtatacacgtgccatggtggtttgctgcacccatcaacctatcatatacgttgggtatttctgctaatgctatctgtcccctagctcccactccgcaacaggccccggtgtgtgatattcccctccctgtgtccatatgttctcattgttcaattcccacttatgagtgagaacgtgccggtgtttggttttctgttcttgtgatagtttgctgagaatgatggtttccagtgtcatccatgtccctgcaaaggatataaactcatccatttttatggctgtatagtattctatggtgtatatgtgccacattttctttatccagtctatcattgatgggcatttaggttgcttccaagtctttgttattctgaacagtgccacaataaacatacgtgtgcatgtgtctttacagtagaatgatttataatcctttgggtatatacccagtaatgggattgctgggtcaaatggtatttctagttctagatccctgaggaatcgccacactgtcttccacaagtaatttacactcccccaacagtgtaaaagcattcctgtttctccacatcctctccagaatctgttgtttcctgactttttaatgatcaccattctaactgacgtgaggtggtatctcattgtggttttgatttgcatttctctgatgaccagtgatgatgagcatttttttaatgtgtctgttggctgcataaatgtcttcttttgagaagtgtctgttaatatccttggcccactttttgatggggttgttttttttcttgtaaatttgttgaaattctttgtggatcctggatattagccctttgccagatagatagattgcaaaaattttctcccattctgtaggttgcctgttcactctgataatagtttcttttgctgtgaagaagctctttagtttaattagatcccatttgtcaattttggcttttgttgccattgcttttggtgttttagtcatgaaatctttgcccatgcctatatcctgaatggtattgcctaggttttcttctagggcttttatggttttaggtctaacatatgagtccttaatccattttgaattaatttttatgtaagacgtaaggaaggaatccagtttcagctttctacatatggctagacagttttcccagcaccatttattaaatagggaatcctttccccagtgcttgtttttgtcaggtttgtcaaagatcagatgattgtagataacgcggcattatttctgaggcctctgttctgttccattggtctatctctctgttttggtaccagtcccatgctgttttggttactgtagccttgtagtatagtttgaagtcaagtagcatgatgcctccagctttgttctttttgcttaggattggcttggctctgtgggctcctttttgattccacatgaaatttaaagtagttttttccaattctgtgagaaagtcaatggtagcttgatggggacagcattgatgtctcaattaccttgggcagtatggccattctcatgatattgattcttcctatccatgaaaatggaatgtttttccatttgtttgtgtccactcttatttccttgagcagtggtttgtagttctccttgaagaggtccttcacatcccttataagttggattcctaggtatttcattccctttgtagcaattgtgaatgggagttcactcatgatttggctctctgttggtctgtaattagtgtataggaatgcttgtgatttttgcacattgattttgtatcctcagcctttgctgaagttgcttatcagcttaaggagattttgggctgagacaatagggctttctaaatatacaatcatgtaatctgcaaacagagacaatttgacttcctcttttcctaattgaatacccttttttctttctcttgcctgattgccgtggccagatcttccaatactatgttgaataggagtggtgagagagggcattcttttcttgtgccagttttcaaagggaatgcttccagtttttgcccattcagtatgatcttggctgtgggtttgcataaatagctcttattatttgtagatatgttccatcagtacctagtttattgagagtttttagcatgaaggggtgttgaattttgttgaagaccttttctgcatctattgagataatcatgtggtttttatcattgattctgtttatgtgatggattgtgtttattaatttgcatatgttgaaccagccttgcatcccagggatgaagccgacttgatcgtggtgctttttgatgtgctgctggattcggtttgtcagtattttattgaggattttcgcatagatgttcatcggggatattggcctgaaattttcttttttgttgtgtctctgccaggttttggtatcaggatgatgctggcctcataaaatgagttagggaggattctttctttttctattgtttggaatagtttcagaaggaatgctaccagttcctctttgtacctctggtagaatttggctgtgaatctgtctggtcctgggctttttttggttggtaagctattaattattgtgtcaatttcagaacctgttattggtctattcagagattcaacttcttcctggtttagtcttgggagggtgtatgtgtcgaggaatttatcaatttcttctagattttctagtttatttgcatagaggtgtgtatagtattctctgatggtagcttgtatttctttgggattggtggtggtatcccctttatcattttctattgcatctatttgattcttctctcttttcttctttattggtcttgctagcagtctatcaattttgttgatcttttcaaaaaaccagctcctggattcattgctttttttttgaagggtttttcttgtctctccttcagttctgctctgatcttagttatttctcgtcttctgctagcttttgaatttgtttgctcttggttctctagttcttttgattgtgatgtcagggtgtcaattttagatctttcctgctttctgtcatgggcatttagtgctataaatttccctctccacaccgctttaaatgtgtcccagagattctggtacgttgtgtctttgttgtcattggtttcaaagaacatacttatttctgccttcattttgttatttatccagtagtcattcaggagtaggttgtacagtttccatgtaattgtggggtttttagtgagtttcttaatcctgagttctagtttgattgcactgtggtctgagagactgtttgttatgatttctgttattttgcatttgctgaggagtgtttgacttccaattttgtggtcaattttagaataattgcgatgtagtgttgagaagaatgtatattctgttgatttgggtggagagttctgtagatatctattaggtcagcttggtccagagcttggttgaagtcctggatatccttgttaattttctgtctcattgatctgtctaatattgacagtggggtgttaaagtctcccactattaatgtgtgggagtctaagtctctttgtaggtctctgagaacttgctttatgaatctgagtacccctgtattgggtgcatatgtatttaggatagttagcttttcttgttgcattgatccctttaccattatgtaatgcccttctttgtctcttttgatctttgttgattggtttaaagtctgttttattgagactaggattgcaacctctgctttccatttgcttggtaaatattcctccatcccttgattttgagcctatgtgtgtctctgcatgtgagatggctctcctggatacagcacaccaatgggtcttgactctatccagtttgtcagtctgtgtcttttaattgggtcatttagcccatttacactgttagtattgttatgtgtgaatttgatcctgccattatgatgctagctggttattttgcctgttagttgatgcagttttttcatagcatcggtggtctttacaattcggtatgtttttccagtggctggatcagttgttcctctccatgtttagtgcttccttcaggagctcatgtaaggcaggcctggtggtgacaaaatgtctctgcatttgcttgtctataaaggattttatttctccttcacttatgaagcttaggttagctggatatgaaattctgggttgaaattcttttatttaagaatgttgaatattggcccccactctcttctggcttgtagggtttctgctgagagatccgctgttagtgtgatgggcttccctttgtgggtaacccaacctttctctctgctggcctcaatattttttccttcatttcaaccttggtaaatctgacaattatgggtcttggggttgctcttctcgaggattatctttgttgtgttctctgtatttcctgaattttaatgttgacctgtcttgctaggttggggaagttctcctggatgatatcctgaagagtattttctaacttggttccattctccccatcactttcaggtacaacaatcaaaggtagatttggttttttcacgtagtcccatctttcttggagactttgttcttttcttttcagtgtgtttaatcttgtcatctcactgtatttcattgaattgatcttcaatttctgttatcctttcttccacttgatcaattcggctattgatacttgtgtatgctccatgaagttctcatactgtgtttttcatctccttcaggtcatttatgttcttctctaaactgctaattttagttaacaattcatctaaccttttttcaaggttcttagcttccttgcattgggttagaacatgctcctttagctcggagtttgttattactcaccttctgaagcctacttctattaattcgtcaaactcattcttcatccagttttgctctttgctggtgaggagttgttatcctttgaaggagaagaggcattcaggtttttggaatattcagcctttttgtccttcccggatttatctacctttggtctttgaagtcggatggtgtctctgagtggacgtcctttt

SEQ ID NO: 153 - DNA, 1210 bp, Homo sapiens
tgcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatggtgcaggtccatatagtcgtaatact

SEQ ID NO: 154 - protein, 331 aa, Homo sapiens [sequence omitted]

SEQ ID NO: 155 - DNA, 2248 bp, Homo sapiens
aattccccaggagtgcagaggttctcagaactgcaatactctgagatgaattttgaaagcaaaagcaacagtggggatcagcatcaacttggattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttatttttttaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatt

SEQ ID NO: 156 - protein, 277 aa, Homo sapiens
MANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 157 - DNA, 59767 bp, Mus musculus
  misc_feature (1)...(59767): n = A,T,C or G
aatgaaataatatttgtaatgagtaaatgttttgcctgactgatcttgtgtcttatttaataaatatctagagtgaaccttataaaacacctcattgtagccggaggggtggttccatggttaaaaattctcctgaagagaactggagtttggtacccagcactcaagacaggaagctcacaaccaccctaaactctagctgcaaggagtctgatgtcctcttcaggtctccgaggacacccacacttatgtggcatgcattacaaacatatacacacaaatgaaaaatagaacaagtctaaataaataaaataccttatgacagggacagacaaatgtgtgttcatttaaatttacccttttttctgttttccctttcttccatcctggagacagcacattccaccctcctccctgccaaaggcctctatagaatcttccaatcagaatcaatcttgcaaggagtcaaaggggacaaaaagaataggaatcttgtggactttagaaattgtgtaatattctaatgtgtgtgctcacaggtacatcctccaccctacaagtggccatagagtcataaagtactcatgaaaacagagctcagacaaaaaacttatcatggcttacttattattgtaaacttatcatggcttacttattattgtaaacttatcatatcttacttattattgtaaacttatcatatcttacttattattgtaaaattattatatcttacttattattgtaacctcttttaggtttgaaaagaggtcttaggcggaaggcaacgtttgatgcaaagaaatgactcttaaatgttgggattcaggacttgatggcctctggggagaaaggctttgggatgtctttgttatgctacaggagtagcttcagtttggggtgggggtgggtgggcttataactgagcagccttttcttatctgtggaaattgtaagtgaaattctgatattttttcttcaagggaaagactgtaaaggactgggagatggcttagtgcataaagctaatgctgtgttgggttgaggatcagggttcaaatccctagacctcccataaaagctagtgggcttacagagaggcagagacgggatccttgtggtaatctggctggcaggactaggccaattgccaacctttgggtttagtgagaggccttgccttgataatcaaatcgaagacaaccgatgtcagtctctgacctccacacccacatgctcatgagtatacaccaacatacttgtgagcatacttatacataggcatgcagaccacacacacacacacacacacattaaagggggtaggtggaccctttgaaatgacagtgaagacctattgtaaatattcaaacacaaatacttctggagaggtgcttggctcttgcttagcctgtaatagtttgactggctctcagagcaaagggcatgtagcttgactgttccaagcagcggaaaccctgccaaggcaacgtttacttcatttgatcattgccccttagtcacactgttctccttaatgcttggctgatccttgcaacttccagtgtcttaccttgaacttgtaccatctatttttcctggcacttgaaaagttgtggtcattgaccaggaatgtagaaagtggacatccttgtcttgctcccaattttattgaaaatactttgaggttttctccttttagcaggatgctggttgtggtcttgttgcctattgtcttttttatgttgctttatgacctccctcccctttccctagattctttaggactttttcatgaaggggtgctggattttgtcaaaggcatttctgcatgaagcacgagagacattcaaagaggatcccgtggtttctgtctttgagtctttttatgtggtgggttatatttactgatttacatatatcaagccatctctgtgcctcttggaggaagtcagtttcatcataatagataatctttttgtgtgttcttgaattcattctgtaggtattttattgagaatttttgtttctatgttcatcggaaagattggccaataatcccccccccttttgttgactcttttttggttgaccctttgtctgtttttggtatcagagtaataatggcttcataaaaagagtttgaagtgttcctttctttcctattttatgaaatagtttgaggaggagtggtgttagttcttcaaacatattttaaaaactttctatgtgtacgaatgttttgtatgtatatggatatgtatctatgcagcatgtgcatacagtatcttcagaagtcagaagaggtcattggatcccttggaattggagttagagatgattgtaagccatcaaccacatgggtgctgggattcaaacctgggtcctttgaaagagtgatcagtgttcttaaccgttgaaccatctctctagcccccgcttcttctttcaaggtcttcagattataaaacacatataacatgggcttggcagatggctctgtggctaaaagcacttgcagctcaaatgtgaagacctgtgttcataacccctgggcatggtggcctgtggctgtaagcagaggacaggacagggtgggaagatggtgtaggaagcttgctgagccatctggtccagtggaaatggcgaggggcaatgagaggcctctgtttcaaaaatgaaggaagagaatagtagacaaagacatcacgtgctgacctctggcctccatatgaacacaggtatgtactaatgaacatgtatgcaaacatatcacaccacacacacacaccacacacacacacacacacacacacacacaccactgccaccagaacagcttgctagtgttttgtgatgcacaagagcattagatcttaaaattttgtcatctcgtaaaagaaatcataatctcaagcatattgattgtgtggcagtctctgccttctttctttccagccccaggcaactactgttcattttactttcaaagagcttggctacattgaaaacaaacaacaaacaacaaaacaaaacaaaaaaactttttgggcagtggtgatgcatgcctttaatcccagcacttgggaggcagaggcaggtggatttctgagctccaggccagcctggtctacagagtgagttccagaacagccaaggctactcagagaaatactgtctctggaaaaaaaccccacccccccaaaccaaaaaaaaacaatcaaaaaaaccttcctaggaatggaatccttcagtgtttcttttggatttccttatttcacttgattcagagttatcaaggtttaaatacattgtagtaagtgccaggatctccttgtttgaaagctgagtaaatgtgtgcatacagagtatctttgctacatcgcaaggatgtggctttgtaacctccctccctccctcccttccttctttccttccttccttcctaacttacttactttctttctttctttctttctttctttctttctttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctctctctctctctctctctttcttcttctcctccttttccttttctccagaacacaactttattgcaatttgtttcttcctggtaaatctaaaacaagcagtgtgccacttggtcatagatactgaactcattgtaaaaaaaaaaaaaaagaaagaaagaaaatctaattgacaaagaagcaattggtgacacagtataacaggagaaacaccctcacccccatccctgccaaccaggttttttttttttttaatgagaaatagagaaagttcataaaataaccaataatttcacaatgtaagttgtttcataagactttaaatattgtcccactacaacaggagtgaaaatagagtaaatgtattgcttattggccttctgagttaataggactgctgtttttctcgtctgagacatggtctttttctagccaggctgtcctggaacttcctatatagactaggctagcttgaattctacaactctcttgccttagttgagcacctgtcctagtttgttttctctttttatgataagacactgagcaaaaccagtttgggaaggaaagggtttatttcatctgaaagcttagggtgcaccatgaaaggcagtcagaacaggggtttaggggcaggaactgaagcacagaccatggaagaacactgtttactggcttgcttctcatggcttgctcaacctgctttctgatacagccttagactaccacctcaggaatggcatcacccacaggagtcaggttcctcccacatccatctgtaatcaagaatgctccccacagacttgcctacaggccaatctgatggaggcattttctcagttaaccctccttttcccagatccatctagcttgcaaattgacaaaaagcaagcaaataaacacaaaacaaaagcactaaggtataggctttttttcttttagaaggagcaactgttgcttgctacattttattgtgtgtggggtgtgggtttgtgtgacctggtcctctcctctcaccacatgggacctggaggttgaatttaggtaatcaggtttggcagcaactacattcatttactaggccatctttctcggttagtttttgtttgtttgtttgttgttttgtttttgtttttcgagacagggtttctctgtatagccctggctgtactggaactcactctgtagaccaggctggccttgaactcagaaatcctcctgcctcagcctcccgagtgctaggattaaaggcgtgcgccaccaccaccaggctagtttttttttttttttttaaggaaatagatttttggtgatttattttcttttaaaaagtgaatgtgtgccgggcatggtaggaccttttcctatatctcttttggctgtacttgatcttcagaggtaactggcagcaatatttttaaaaaagatatattaatttattttatgtatataagtacactgccgctgtttttcagacacatcagaagagggcatcatcagatttcatttcagatggttgtgagccaccatgtgattgctgggatttgaactcaggtcctctgaaataaagcagtcagtactctttatttatttattattgtacataagtacactctagctgacttcaggcgcagcagaagagggtgtcagatctcattactggtggtcgtgagccaccatgtggttgcggggatttgaactcaggaccttcagaagagcagtcagtgctcttacctgctgagccatctccccagccccagtcagtgctcttaatcgctgagccatctctccagcccagcagcaatattcttaaacataaataatgatcacatttgttgattctttctcttgactacagtgtagaagtggcatgtgtttagtaaaatctacatttccattttagatccacagtcccttccccagtactgacttgcagctaggtagacacgggagtccccccgggaagctacaggtgcaccccacggcccaggactgcaatccttcatccacaggctacttgtgctttcagctgtcttcaggccatagtgggttcgttcgccccaacgggttgtgtaagtgaaggggcatcggaaggacgctaatgaaaggattatctagtgtttgttttaccaagaggataatccagttgcctatttgcaatgaggaagaaacaaaactgggtgtggactctttggtggccagagccggccatgaccttgggctgtgcagctcgatgttcactctgccaagttctgtaagagggactcaggcacatcgtgtggtagaactgcagccaactcaactttattctcacaaccccaaaactgcctgttagggggcagtactccaaaatgaccctcagtataatcagggccagcaagccggctcagtggatgaaagtgcttgctatgaagcctgaagacctgagttcagtctttggaatctagatgacagaaagagagcactcactcgtgagagaactagcatgtgatggctgaggaatgtccagtttatgttagccatccatccatcttggcacctgaagccatttatctctgactcaagttccctgcagctctgattccttgatgctttcccagaagtgtacatcctgtgaccatcttcttgttatggtgtgactgactcctgattttggcttctgtaacctgcccttgcagatactcaaggtcttcatggagttcttgcctttaaaaacacatccctcctcccttctcctggcacatctcggatttggcttagagactgtggccctgtgggcagttttaataaatttggcaaatcataatctaagtggagtctagagacctttttctggtggtctcaaacttggtagcaagtatgtctgcatgcacattcataaaacatgcatatatacacacaagcacctgcacacgcatgcatgcacacacacacatcaacaaataaaattaatacaacttaaacaaaaatttaaaatacataatcattctacccccaaatacagacttttcctttacctgttcttttttatttagacatgtcgatattgacaaaagcccctactgggtgccctaccgtttcgaggatagacatagttcatgtaagcagtgttcatgtagctgtgtctgctcctgatctcctgggggaagagtgatccaaatatgagactagggagagggaaatagagaaggaatacagtccagttggaaggagacaaacaagagaggagaggcaggagaagagagagctaagaaaaagggtgtggggagatacagaaaggtcaggttgatgctacagatgaagatggacagacagcatcctggacacagtacagataaagccagaaaggaaaaagtaacaggagacagagagacagaagggaaggacagagaaactaaaaataaaaccattttgaataatggagctggagaaatagatttgaatctgagaaatgcgtgcgcacacacataaggcacagagctcagtgcccaggtcccatggctagatgaggagcaggaagtagttagatattgaattccagtgctgaggagtctggagaggatggtctctggggcctattgtccagccagcctaacccagtcctccagcttcagggcagccggggcctgtctcaaagagtgaagctggggcctcttgcggaggaactgagttcagttcctagcatctacatggaggttacaactgcctgttccagggaatccagtgccctttctggcttccatgggctcctgcacacacatgctgcacatacactcacaaaggcccacgctgacacataaataaaaataaacaaaataagtggagaatacctaaggaatggcacttgaggctgacctctgacctccatgcatgcatatactgagagaaagagagagagagagagcactttgaataaagatcaattcatcttactgtatgcttcagtgtgttttgtgaggcagtgaagtggaaataaggggagagaggcccctttccttcccaggaagagttcagctgccagggaagtgaaatggcagagaattttcaggagaatcatgtgatcgatcgcctaaccgctgctttccacatgttgattgaagtgttcacaccccatgcagcccccgaccttataactaggggggtgagctccagccatgaaaaggtctgggcatgcttgggacagaagtctggtggcccccacagccagttgaaggctgtgagattggggttcagaccacatcgggaatattggagagagaaggtgttacagaaaggtagagaaaaatctgtttagggcaggcaacgaggcctgctgctgtgtagtggaaaagcatcatcctgcggcctggcccagggcaagccttgtatggaagtaccctgaggaaggaagcaggcactgggacacaaagttagaaagcctgaattttcatatatacatatattatgtgtgtgtgtgtgtgctcacagagctcagaagaggcattggatactctggaactggagttacagggaaaatgagactctgtcctctgtaatagctgtcagtctctctctgtttttttttttttttttttttttggtttttcgagacagggctgtcagtctcttaactgacaagccatctctcctgccctagaaacctgagttttctcggtttcctgctcagacttctccctcagggcatgttcacaatcttcaaacaagagctacaaacaattgaaggccagaggtggtggccatgtctttaattccagcacttgggaagtgtagggagtggatctttgtgagttcaaagtcagcttggtttacatagcgaggtccaggataaccagagctacacagggagaccctatctaaatgattgactgatcagcagtgtggagccatccttagctctgcagatgcagcaagatttcaagagccacagacaaccttcttgcaactctcggcctgtgacgattaatcacccacagaaggaaaaggccctggggagggggtagtgccagggactctggcctctgttgcatctgctgccacagaggtcaggggcaggctgtggctctggcacacaagtcagcacccctgacttgagacagtggaggctgcccaaatggctctgcctagcttccatttctttcctggaaagtagatctaacgacaaacccccgattacgatacaaaaacatgtcgtctgcccagggtttataaatgctcagagaagcaagcagagtgaggagtaactcagacgagttttgacagatgtattcacatcttctgcctattatcaagtatttgtttatttttgagagaaggttttactgtgtagcctggctggcctagaactccctatgtagacaaagttggtatacctctctagttgggactaaatgtgcacactaccaccacacctggtctgagtgtttatcgctattaacaggcctgtggataaatgcatcaccgagtggaaagcatttctagtctctccagtagatattccagctggggtgggtaagggggaagtggtgttgtaattttaagcaggcttgggagtaaggaagaggtccttgtaatgtgggtgtggctgtctgtcgcctctctcagaagtgtcgcgaacacagatgacctgggatgggttcttcacccatttgtggttgggattaattcccagtaatcctaattcagatccaatctccttactcgggtcagataagtaagtgtgtgagccccaggaataattggggaaacatctggatgtgatagtaacactggcaatgtatttctgacctcagcagtaaggtgcatgaccgttttagcgaattatatcgatttctaatacgcaactggagtcccgcagaccgcaaatcccgcgactgtgtggctcctggaagtctggtggggccatgaagccttggcctggagcttggagaacccggtgtttggtgtaatgacttcaggcgcgctgggcggggccaggggcgggttccgaatggactccacccctttcagggtctggcgcgagcgggcgggctgagagctgcttaaagagccctgcggaggcgcgctgggcgtactgtcgcgcgcgcagaggcggcacacgtgtctgctggtgtgggtcctgagtttcaccctacccttcaggatcgagagattggggtggccccaacccccttttgatgtgcgctcaccctggcctgtgagaacgtgatccacgcagttccccgcgttcagggagccaacttggccaagcaactgtcccgggagcggcgcgcgggggtaccgggcactgcgcatgcggagctccaaattcaaacagctgtgtccagggctgcaggacgagtgaacccggagctgctggaattaggggactctttctccaggaggtggccattccagagtcatggtggaccggggtcctttactcacctcggccatcatattctacctggccatcggggcagcgatcttcgaagtgctggaggagccacactggaaggaggccaagaaaaactactatacacagaaactgcatctactcaaggagtttccgtgcctgagtcaggagggactggacaagatcctacaggtgagccgtcggtcgccagaatcctccacatgcatctgaagctgttgggactatagcggtattgaaggggatactccctcctacagtttaagacgaccccccaccccccagtcccaaccagaagtccctgggtggcgggagaaaatgcctcatcaggtgtcaggtcgcaaagatctgtgtctttcgtctagggacagggagattcccccacgcgcgcagacttggtcagtacctagtaagttccgagagaacttggggttgactccaggatgaactgggccccgcggtggcttagtgtgggtgtgcgggtgcctccctctttggagggaggctgtggggcggataaaggagtttatctttccttggagacgctcccggagtccgggagcagagccgggtgccacccctcgcgtcaccacctcccgctccagggccgttgccgcgcccgctcgacctttctaaacttgaatacagcagagggcccccagacctggtgtgagcaaaaacacacccgccagttgctgcactttgagtggggcagggagctcggacatatcctaagtgcctcggaggaaggtctgtggctggaatgttcgggacggtcccaggcttccatgaagtcttagcaagctgagccatccctcaaggactcggaattaagctttgtcaaaacagcaggttgcacaaacgaacacccaaattcaggtagtgcccttttagggagcgaggatagtgtgggtgaggggatgtttccctgatgttagcttgtggagtcacttatctgagaatgcacacacccagtagaccattgacctcaccatggtaaacttggctgaccatctcaactggaaccttgagccaacttagggtcagaggttcttctctgtttcttgagggctcagccccaagcatccatccatcctgttcctggccttctaacaataatggtaggattaaactggagcaggggtagactgttcaaatcattatagatctgatcgacatcagcccccacttctttccacttgtctcatgcctctcactttccagcctcatttacctgttttgtcaaatgggaacaaacctgtcttcatccttgtcctgccctgaactattgtaccattgacaactgagaaaacctaaacacatcctattggtactacctcctaatttcagatggacattcacagaaacattttaggtgcccgagagatcatgggctcatcagagagttgccctcagcaggtttacaccactaggtgtgttgttgcttttgagtagacctgtcccctatgtttaggggctgggcgtggaaggttacgtgatagtgatgctagtggtgagtttcaaaagacagctgttcttccagggggttctggaaagatccacatacccgtctgctgcatctgggtgtgctgaggaggaagaaggtggtcagtttgtgatagccctgacaggatctctggaggagagttttgtgtgtgtgtgtgtgtgtgtgtgtgtgtgtgtgtgtgtgtgtgtagtttgctctgggggctttgtttaggggagggggaggagaggatgataagtctccagctgccctcgaagtctcccctccctgctgctcctcctcctccgtggcaggggaaggaaggaaagaattcaaggctaaatgtgggaaaataaacttcaaaacccaaggagaaggggtgggggcagtgtttaggggctatgcagcctggtacatctggtgcggtggctttacaggtcaagtggtttctgtagggtgtttgaaaaaacaaaatgccctttattttaaggtcttgtctgtcagcagtacctccacccccaaagtggacaggtaacttttagaaaaaagaatttgagcaacatcaggccagtgtgatttggagaagattctagatgcttgcttgaatgaacaaggacagtctgtcacacacaccctccccagtgaaaaaaagaacaaccttgtcaactgggcaagttccctcttttcaaaggaaaaaacccaagaaatgaaaatggaccaatgaaagcatttgccagcctcagcttaatctgcaaaaatctgcctctctcggctttctgatctgtgacttggggcgctgcctcaggcctcaggaaattggtttaaggaaaaaatgaaaactccaaaatcttccttctcattcggctgcctgggtattttccacctgaggttctgggttttaaccctggtcatcacaaagccccttagttgaaaattcctggggtgggagcaggaggtagctaagcttgggggggggggggatgggcttactgctgcaaaccgtggctgtagagtcaaaagcacagaaaaaaaggacgtagcccttccctcccctacttaggctgtggttgagctgtgccacacaggctgcctttcaagtgccctgtatccaacccaggaccccctggctgttcttgccttcaaaaccgtctgaactcccactgaagtaacaaactgcaccttattgttagagctgtttgtttttaaggcagggtctcaggtagctctggctggcccggaactcactgtgtatctgagggtgaccttgaactcctgatccttcaaccttcagctcttatgtatggtacccccactgtgaatgcagtgttgggcatggaacccagggcaaacactctacccactgagacacatctgcagctcttacattagttgccattaatgaatctgtttatttggttatttatttatttatgaaagcagggtctccctatgtagctctgtctgtcctggaattggttccgtgcatagaatgtactcacagagatccgtctacttctgcctcccaagcttgggggttaaataaagatgcatatgctccactgattttagggattgagacagggtcctggtacgaggtgaaagctgcctttgaactcttaagcaccctgcctcagccccctggatgcgagattataggcatgtgccttgctgtttggcattaccagatttttgggtggctggctattctagctgtttatgtattttcctcttttttttttaaacccagcaagtgaaattggcatgtatagtgagtgcatctactgtgctgagcactgtggttaacattattcttctgtgcagaggcataagctgttagtgcttcctggctggggcatttcctcatcaaaccagttaacttaccttagccttaatatcctcatctgcaaaatgagcagtttggtagggctcccggtaagagggtatgaatagaagaagcagggagctcttgccgctagcattttctgagttttatggagtgctctctgcggacggcgtcctgccaagtactttacctgcttatttcaggtgctttatggtgacctcatgctttaagataaggcaactgacacccagggaagttaaagtggccacaagggcaacagctccagtcttgggggttcccctacagcaatatccacctttgccagcccaccgcaggagacttgctgtctctaagtgacctgagttaattggttcagcttgactttggactgctgggaaattctattttttgtttcccttggaacaggcacacagtcttctccagtgtggctgcctgattgactcggcactgtctccgtcactgaagctgtgtgtacacccttcagttctgcacagctgtttttagaagtccctctttcttctccctcccggaaagctgaggactgagttaaattgacaggctgacaattcatctaagtcttttaggtagaaggttaaacaaacagtgttatgccttcatacagaggcgtctcaggaggtcaggtcagagtggagaatagagaatagtggggggagagagtcttaactttgtggggtgtcctctcttagcctaggaagggtcaacaagcttcttgatgggatcatatgtcccactgtcttctgagactgggatagggcaacaggccttcttttctgccctggtatcccaaagtgagccctggcgttccctgaaccccctcccagcttctcaccacattctaggggattttgggtatacctcctttcttttttttaaatttatttattgttatatgtaagacactgtagcagtattcagacacaccagaagagggcatcagatctcattatggatggttatgagccaccatgtggttgctgggatttgaactcaggaccttaggaagaacagtcagtgctcttaaccactgagccatctctccagctccctggtataactcctttcatggttaaacccttaaatacatcccagttttgaaattctgacatctgttctaacaccaaccctccgccaaatttatgaaaaaacaaaactgtggactgtttaatgacttcagaacaaaatgttcaaagcgaagaatattgaaaggtttagagaaaaacttctctgagcccagttcaggggaacagagggttaatacgagcactcactttgtttcaagccaaggtggacactgtgaggctcactggtctcacccacctttggtaaaagagtcattaggtcttttgagccttgatctaaccctgcttgaattctcacagtctagaactgcagagcttcgaagtgggcaaatttgtttttttaaaaggaagacaacccgccctttatccatccttccttccttccttccttccttccttccttccttccttccttccttccttccttccttccttccttccttcctctttgagaaagggtttctctgtgtagctctggctgtcctggaactcactctgcagaccaggctggcctgaactgggagatcagcctgcctctgtctccagctgagccattaaaggacaaccatttctaatggtttggcttttcttaagttacacctaagttgccgggcaatggtggcacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttacacaaagaaaccctttctcgaaaaaccaaaccaaaccaaaccaaaaaacaaacaaaaagctacacttaagttgaagactgaaaaaaaaaaaaaccaagcaaacaagaaaagccccacaccaacaaaaacaccaacactacctcaaaaggtctgccttagtaaacttgtgctggttagagctttaccagttaaagtgaactgttactaagctctcttgggaggtttagtggagcattagcatggttagatgacacagtcatggcgaaccatctggggagaaattcgcatgcactgagagcttgaaagtttgcaggaggtggtgattgtcacctctaagtattttcctggggtttcgcctatttatagactggtgtttaaaagaaactcagttccttggttttgcacatcatgcttggctggccctgacctggggccaaacaaaggccttcatcttgaacttaggggtttgctgtcaagttggtctcagcctctgtattcggtgagtttgtgtttagtggtagggggtgtacaggagggaagggaaatgaaaactttggggagcagagagctaggcttctgagaaagaacccctaggagtgtctttatattggggtgatgtaagacgatggccagaactggggtgcagcagggacgctccagacagaagtgaggtgggtaaccatcaggaagcacggggagagatctgtgtcttccattgtttgctgagaccctcggacttgtctgtgaccattccaccctgcccctgctcagtcctgcacagggtctgaagtgatttgggttttcatgcatttggagtgtctgcagccacaagagcagctcgaggacagggcctgaatcacaccacaaaagtcttgtttcatgtacaacaggtacaaacaccctgagagtggtttctatggactgtagtgtacctgcgttgtggttcatcgtgaggtcaagtatagacttttccacttgggatgtcccgttagtgcttagtcagaagggtttgacttggagtgctttagattttcagagaaaaggatggccaccctattcaggactgtatggagtgccgcgtgcacagacatagtgaacttctaaactgtaaagaatccaaaagacttgtaggggtggtggtggtgcacgcctttaatcccagcactcaggaagcggaagtaggaggaggtatctctgagtttgaggccagcctggtctacagagtgacttccaggatttgtgtagccagggctacccaaagaaactctgtctcaaaaaacaaacaaacaaacaaaccaaaacaaaaccttgtacattagtgtgtggggggtggggggaaagcacacacacactgtggccacgtggttgaggtcagaggacacaagttgactctgttcttctgccatgtggtgagtccccgggatgaaacccaggctgtcagtcttggcagcaagtgtctttacccacccagccatttcggtggcccaagaagaccctcctagagcatttaatgttagggctagcttagtgcacaaggtcttagcacatgctagacacgtgtaccacaccgagtgaggtgctttctcagcctgaatttattttttatttgtttttagtttttttaaggcggggtttctttatattttttctttttggcttttttcgagacagggtttctctgtatagccctggctgtcctggaactcactttgtagaccaggctggccttgaactcagaaatccgcttgtctctgcctcccgagtgctgggattaaaggcgtgcccggctaaggcagggtttcttaatgtagccctggctgtcctggaacttgtaggactctgtagatgaagctggccgcggatatttttttagttataaaaaacaaatatggagtctggagagctgcttcagcaattaagagcaagtcttgttcttgtagaggagccaagttcagcccccagcgctgacgtggcgctgataccttacttcctagctttcaaggacacctgcattcatgtgatgtgcactcacctccacccagacagacagacagacagacacacacacagacacatacatacacatgtaattaaaaaataaagaaaagtaaatgttaaaaaaagtcaaatgtactatcttcagcaggtttgagcatcatccagtgctaacgaggttctcactgttgtgactcagatctgagttgctaacccttgctttttgtagaaccgaaacttcccactaatcagcacctctccccaccttctcacccagtcactagaaaccaccgttatgctcgtgtttatgaagttgctgccctcaaatctgttgggtagatgaaatcatgcagcgtttgtcttttgatgtgtagcatggcaccgccgttggaaaactgtatggaggtcctttaaacagttaaaaatagtcctgccatataatgcgctcctggagcatctgggcctatatcagcccagtttatttgcattctagttttgctgtgatgagaatggaacctcaggtctggcatatgctaagcaaatgcactctcgccaagccacatcccaactgtcaactgaatattcggttttactgtctttttttttttgtatgtatacgggcattttaactgcatgtatgtctgtgcatcatgtgtgtgtagtgaataaggaaggcagcagagggccttgcatcccttggctggagttgcagatggttgtggggtgctacgtggctgctgggacttaaaccctagtccttctggaagagcagccagtgcactcgaccgttgagccagctctccagcccctcgatggaatattttcaacatgaaagtgggtggggaaggatggcgtgggtcttccccttccaaagcccccagagaggtataatttagcaccatggtgcttgaggtgcagccacaggccagagaggtgagggtcagatgacagagccttgtgagtgtagccaaggaatttgaactccatcaaatgtttgccattttcaagaggggaagtggataacattacagaaagttccctccttcttcacagccatttacaacttgcaaacagtggaatattctgactgaaattaaatttccgtaggccgagccactcactctgtgagtgttctgataaggacgcctccttcctttcagcttctggtgaaatgggagtgtggcttttcccagaagctcatagtctttagccccttcttcacctcagacctcattaaggtgcctcttttcctgtgtaggtcagggtctgggatggtctacccagacactccattccaggctacctttcccagccgtccttcatgtcctcttgtggaaaaggacaggataccaaagttcttcttgaagccttttgtgagacttaactccaatccttaagtaaccaaaaaccccaatgggcgggtggtgtggggggcttctcttgctggccagcttttctgtgcaggaagcctcaaaaaaaaaaaaaaaaaccaaaaaacaactggagggtcttgagcccttgagctcagtcttgctggggagaggaaattgctctgggggtggcagagtgaggggaaatgcagactgacgtgccgagtgatgggtgacagatggtggaggccagaggggaggacacggttgcagggccttggaagtttcacttgccatttccagaagtctgcgcaagaaccctttctctggggaaatcagactctgaagaaacaaaacaaacaaacaaacaaccccagcctctatcctcagggaaccctggtctgcagggggaacaacaaggagccaccagcaggttggtgttagtgagcgtacctggaatatccagtagtgcatcatggacacatgggtttctcttctccaatgtaaggaagaaagggtggcgagtgggtgtgggtagcaggcctgtgagcatactgtgggctcctgcttgctatgctaggcaagggactggcccattttctgtatctctagaactatgggctgggacttactgctgttctggatgtacacggtaaagtaaagggctgaggcccactgtcaactaagccttggtcttgcccatggttagttagtagagctggtgactggagcacacaggcatgggccagggggagactgttactaagaatgtccttggccaggtgccatcatcacctcacagaaaagcaagcagcagcaaaatagaagagaccaccgtgatggtcttcactgtcgagttgccatggcaacacacctctgggtgtatctaagagtgtttccagaaaggttcagctgatctgggaagacacctctgaatataggcaacagcatcacattggggtcctgactgaagaaaaaggcaaaagcaagctgaactccagcattcacctctgcttcctgacaaaggacacaatagaaacagctgcctcacgcttctgttgtcatgactcccctgctgtgtaccctcaaagtgagctcaaatcgaccccctaaaaaattatttctatctgatatatatatatatatatattgcctgcaggcatgcatgtgcgccatatgcttgtctggtttccggtccacagaagtcaagaagtcagaagagggcttcagatctagaactgtacttatggatggttgtgagccaccatgccgtttcttggaattgaacctggggcctctgcaaaagcaacaagtgctcttaactatcgagccatctctccagccctgcagaccctccctttctcaagtttttgttagttattttgtaacagcagtgagaaaggggaaatggtaccaggaattgggggagggggagtcctttctgtgataaacctggcctgtaggtctttggagctggtatgcatgaggaatgtataagagtttggagctacaagctagagaagcccgaggatgcttgctgtaagcagaagcttagtgggccttctagattgagtttggaagactagaatgcccgtgccttctgtgccctgatgtgatggactatatgctcttgacctttgaaaggcagaataagcccatcttcctaaagttgtcaggagtttgattacagcaacaagaaaagtaacaatacaaccacagaggtcacagcatgtctgaggccttgtgattgggagagtgatgaaggctggcacccagttctcatgcttggaaccactttgctgtccattcggctgtgttgatggttgaagaagcaagagggagggaggctgagaaatggaaatatgccacatagacttggtgtctcagaaccttttggtgcacaggggtaatgtaagcattcagggtgttgatgggtgtgaccgagagcaagttgtctcctccatgggatgcaaaagtggtgctccactgtatcagggcttacaccatacaacagagaacctaagtatcagttgctctctgtaccccctttctctgggcatcttgttccgtacatccccacagtcctcgtcatgcatttttaatctagaaactggtgtcaaagaggaacccagaaagccctccttcatgctgcccaccattgtctactccttcccagtcaactcagttcactccttgatggtcataatcaacgcttgaaaatgtgacttctcccttccagtctcaagctcctcctggagaagcctgggtccagatagcctcaggactgtcttccttaggtggtggctgtgcagggttggtgaccacattggaccttccctagagacaggacagtatcagcactcttggggctctcttggtggccagggctctttggttaggtttgcaatatgcattcttttttctcttacccatctaaatatttaagcttcctgctgaaatatttaggcaggactgtgtacttctggctgttgtcacccactcccccatgccctgctgtgatctaactgcagctgtttagccaagtccttcctacaaaggggcatgtgtgtcccaagtctgtgagaacctatgcaggatagttgaaggaaggactagcttggctctattgtgtagcctggagcctggtcctgtaggccacctggaatcttaccagcctcatctcggggactgcacaccttgggctcctctaattgtctgaattgacctatacttgaggatggggaaagggagcccctatttgagccattgtgaagacaaaacctgatcataactgtagtcctagtcttaccctatacattagttcgtgctgtgtgactttggccagatttaattacctcatgtccatccatctatgaagagggattggagtgcctttaagttataagggcccaacatggcacatctccctgtccccagacttgtgtgataagacccagttctcaagatgttcagtgcggaggtaagcgcttgcttcatgttccctcgtgcccaggttctcagtggcatgtaccttctcgtgaaagtctgatgaggaagagaccaggcctttacaaaatcaaagtgaggtgactttaaccaggtaaaggctttggtctctcacagactttgaaagaaatgatcagtgtttacaatagtgagatggcccagtggggctaggtgcttcctctcaagcctgataaaacctgggagagaactgacccctgaaggttgtcctcccacctctacatttgtgccgtgactccaacacgccatacacaattaaaaaaaacctttaaatcaataaaaagagtttattcctgtgctagatagtgttatgttaactcgacataagctagagtcatttgggaaaagagaacatcaactgaaaaaaatgcctccaccagatgacaaggggacaagccattggtgcgttgtcttgattgacagttgatgtgggagggcccagctcactgtgggtgatgtcactcctggagtggtcctgtgtgctagaaagctaggtgagcaagccagtaaatggcatcctccatggcttctgcattagctcctgcctccaggttcctgccctgacttccttcagtgatggacagtgacatagaagtataagtcaaatagcccacccttctcaaattgcttttggttgtggtattttatcacagcactataaaccctaggacaattgctaaccccacccaaccttgccccttcaaacttgctcacccccagctccaccctgctgtgctttgtgtcaatgtttccccaagctcttcctgggatgctggatgcccaggttgtggtcgccaagtcctggtcttcaggtctctgctgggcgctggggttggagggagaagctgtggtttctactttcaaggaaatatccaggtctcacagcagataaaaagcacgtgctgatcgtgaagacccacaagcatgagcacacaccatatgtgtgtctccatctctgaggatgttgtgcctactcctggtccttcctgcaccttcaggaatgcctttgggctgtgttctggggaaatgaggaaggtaaatgtaatgtggatgggctggggtaggccacctgtatgtgtgtatgcccctgcccttgtttaatctacagagccttgccaggaggagctgtgaggacaggactgtttgcaggagaggaggtgcctctctagctgatagggcctgtggtgtgacagatctagaccacagccacattggatctttccacctcttgacctacacacagggagggagcagaagtgtttgcagggtgtttcctatctcacctaggtgacgccacccagtcttctaaaaagcttgcagatgcaggctttgtgctcaccctaccctccctccaccttgccttttccaagagtctgcagaaccattcatttgacacctttattctgtctcttccatggacccagtacaggaaggggccctctccatcctcctcctccatagacaaatgcatgccatcccctttgttggattggaaaccagggccagctaagggcctgccactaagctggtggcagaactgtcttgcagggatgtctaacctgttggcattacgtgacataatatgcaaatatgtggagccagatgcatagctctcctgggatgcatgtgacctgtgggctgcaggttggatgtttctggttgagaggcaaatttggtcagtggagcagaactgcttgcaggtgtggctgtgggcctttcttcacagagataattcttagcccatttctaaacctgcacatgtatgtttgatatccttgtgtgtctgtgcatgttggtgtatgtgagtgtgcatgtgccaccgtgaagcctgggggttaatcctttcctttcacctttctagagacaagtcttgttcactccttcgtgcagcaggccaactggactgtgagcttctgggaatcctcctgtctctgtctcccatctcactactgcctcaggtgaccctgtgaggtgtgacttggtttctggggtcagaactctgcagcactcccgtgcctttgtaacattgctttttaagtcacagaggtattgattatattttggggtgcagagcctcctatgtttcgcttctcctaacctgcccaacatggccctccctgagatctgggggcggggcttccctgctgatgagcgttggtggaagaaaggtaaatgttagtggggaagctcccagtggcgcagaaagaagggtgtttttctgggccaggctagatcctggggcacaagcgctccgactgagacccactcccacctccaaacccactccccaaggattttgtccagcattgggctcagctccccgagaatctgcacccagagagctgctggttggctggtacctcctgcccatcgtggaggttgcaggaggtgatttacaccgaggacccctctctttcccggcaacaaaacttaaaaactgtaaggctggaagagcttcgttatttaagcagcctcctggagccaaggcccagccctttagagaaagttacacaactttgtctaagacatctgtgcttacaaggggtggggaagtgcaatgaagagcaattacagctggggggcaagcaattaaggcagggaaggctttgggggaaagtggcctcagagggcagtcagtcagtcaaaggtgttaccacacctgtcagtggctctccaggtcaccacccaaggcctctggcaataaatcctccctcccagcggcctggtggggtgggaatggggaggtgatctgttgatctttagatcttaggattctttctgctgatcctagtaggccttgcagacagggggcttgaggtcagccttccatgggaggtgttctgcagccccgcatgcctgtagcatgcactttgacaaagacctctgaggtttatgttgtcccaattcctttttgagatagggtctcactatggtagccctgggtggtcttgaactcgctatgaagatctgactggcctggaactcattgagccttcggcctctagagtgttggaattaaaggcatgtgctaccaccatgcctggtgactttgagatccactgttacagatgacttggcaagggtggcaaagagaggcaggcacacagcagcgatgaatggtatgaggtaaggattcttgcacacagttgaataacataatctggattacccagctaagtatctgcttgtacccaggcaagtctggagccagagggctgcaaagctgctcttttcagagacttgctaagtctacaaagcactctttggtttcatttttgtgtgtgtgtgtgttttgaaatagagtctcagcccaagctgactttgaacttgccatataactaaggatgactttgaacctctaccccgcagagtgctggaattgcaagcatgtacaccaccaagaccattttcatttggtgctggtcatggaacccagagcttcatgcatgctaggcaagcactctagctgagctacccagccttctgctccaccctcccggttgctcctagcttcaggagttgccctgagcaatgctctttggaattctgatacttcaggtaccttgtcctgcttaaatagacagtgtgtgtgtgtgtgtgtgtgtgtgtgtgtgtgtgtgtgtgtgtgtttaccactttaggcatgaaaactttcaaatcaggaaaaccttggttatacaagaactgtcaacattacctatacctccagcttgttccctgcccccatttacaacacctccaaggggcccttagccttcatgcacctgatcagcctcctgtcctttggcaagactgtgggcctggggacagtcagaaaggaccccatgagaaagaattaaggagctggagggagagtgtaatcattgtttatttgtgaagtgttgcctgtcacctctctcacttagacccacacttgggacaggcacctctacttggcctccccagggttagtgactcctgccccccacataggacacataggttagtgctccagagagaatctttagtctttttctccagtggctcacatgccattccaggcacagccctgccagggacaattaggtgacttatagtatgctgagggctgggtgggagaagagagctttatgggtgtttattttggccagggtggctttgggtctactatagggtttgtgctgctcccgtgccccatcccccaagcaggatggaagtaggcacctgtccacagaccctggagtagaatgaaggacaggcccattcctccctatcattgctgttcaaacaaaactcatgtcccctgggctgtggaatgcatcctgccaatgttggctttggaaggatgccctttccctcccatcatccctgccccctccagagctgccaaggggataagtgctgagcaggctaagtggggcaggctggtgtgggagtgtcttgtcagcacccccaaggtaggtagcaggaagagggaggttgtcctgattaatagcttttccacacacacccagtcccctctcctagactctcaactcagctctatatccattggaatggcccagtgagtgggactcactagcctgtttggggagcctcatttgctgtgtgactgggccaggccattgcacctctctgagccaaagacttgttcaccaaggccatttaaacagggagtgccagttgtacgatcagtactggtctaaagggctgtaggaatgaaaagactactagatgccatgtttcttcctttgaagtcagtggggcttagcaggtgctgggggtcgttaaccatacagtgttggaagcaggtaggagcattgcaaactgtagctaccataggtcctcccagtaaggaaatgaacgcaggttgggatgttatccctggcatggtggtatctcctgatgctgggtctgggggttaccttcctttgagccccatctctcagtacactgctctggagttttgtcatggccgttttctttctcatcctctccacagggctcttgatttgtgccctgttgcatctgaaacccaggaccctgtatgtagggtaatcattaatgaacaaccattaacgttcccctccgcctctgtctgccagcagccctcaaggctagatgtagtgctgtcccaggtctgtccgtggcaaatgtcagtgtgcccaccttcaatccagaagatgtctaggcaggctctccccatccagcaagcaccctgcagccgacggtactccgccccaccctcatctgttcagcactctcttggctaggacattttgtctaccaggcaggtccataggttgctggtgaaggtgtgtcaacggctgcctaggattttgcctgtattgccctcccacccccagcagaggaggtgcaactttagtgtcatggaggacactttggggtccaaacctagaaggttcttgttgcactggagatgagcagaggtgtgttgtgacattcttgtgaagctccaagtcatcgggtccccctgcttggtctgttgggtgtcattatgtatctttgtatttgtttgtgttgaaggcacctgtgtttatcgatcatcaaattggtatgctttagcctgtggcgtggcataccctgtccagacagtatggaagccctgaagcctgaattacccggggcacggtggtttccactgagtgaatttttaaaagcaggtttgaggttcaagccacacttcaggtttacaaaaacaagccagggaatggctgtaagtttagcactgagtcacggaaactcaatttaaaaacagaagctaggcagggccaagctgtggggactgggttattgatggctttttctctttctgcctgcacattttctgtaatgcagttgtattgtgtttataacaaagaacttgatttttttttatggcacggaatgcacattcacccgttacacactggccgttttaaagtatgggggaacacaaggctggttttaacagaacatcctctaaagccccttcagtagtcagtgaacggtgggagagaggtcttcagttaaataaagtgtaacctctgggaagtgagtgctcagagtgacaagaactttctaaagccgagtcgcctctgaggactaatgccattcattagcagtagagactcagggcctggagcactcagggttggaagtttgagaccaggctggggaggtggctccattgtcttaattgagttcagatttccacacccatgagaaaagccagccacagcagtgtgcagtgtgtgtctacagtttcaaggctgaggaagcaggctgcagagttcctggggcttgtcggccggccctgctagcccacagtgagcgctaggtttattgagagaccctatctgaaaaataaagggaaagtgattgagcaagacacatgtgtgtgcacgagtacacacacacacacatgcacgcacgcacgcacacaaaaacaagcacacgaagtttaagactgatcacctgacctagcaggctaaagaaggcacacagctccattgtacatcgagctggctcttacctgggttgcttggtgtcttgctcaggtgagaggactctcctggaggtctgtaaacaagtggggtcctgacctctctatgcctccagccctgccgaattccttgggggcccaagaaatctcaccgtgtgtttgagattaccaggaaacaggatctcaggcgagagatgaagaaggctgttgtagcctgaggctttggtcagcctgacagtccagggaaggcacatacatcctagggggagatgcaggtagggtatgtttgatatagattctacaagtgggatatgctgagatgtgcgtttacttcttaatatgatatctctcattgaagctgtttaaacgaataaatgaaagttcagatcgcattgctcagtccttggctggatttcaagtactcagtagccacatgagactgaaccgatgagcctatctcgtagtgcaaagttctgctcgctggtctgttttctgttgctggtaatgcaataccacagatgactttgtactttgtgaagaggtttattctggctcagttctggcccatggtcaaggggctgtgtctgatgatgggcttcttgttggcagcatcctgaggtggtgcatcatagcccatgcagaaaaacaagtatctatgatggtgtggaggggccccaccctgatgactttatccaatccttatcccctcccttaggcacagctcagaaagccatagttggattaaatttccaccctcttagcatctcaccatggggattaaatctcagcttgtgaacctttgtgggggagggcacttacatcatatctaagccacaggcgtacagcacaagggtgctggtaataccgcatatttgagtgtgcctagccaccttgtattcctgatctagggagggctgatagcatatccaagacatcttagaagatcctaaaatggggagaggggaggtgagatgggcttgtgctttaagtgggtggaatctatggctaagtgattgcctcagtcctagcttattcctgtctggtttgctttgttttatttttgagacatattcttgccatgtagcccaggctagctttggactggtgatcctcctgcttcgttcggcctctgagtgttaggatagcaggcgtgtgtcaccgcgcctcgatgcctctctgtctttgtgcctttgtttccctgcttccagccttttgctttcccttgaaggggccagtatggcttgttctcttgttctgtgacctctctctctctctctctctctcttttttttttttttttttttttttgagacagggtttctctggcctctgcctctgcctctgcctctgcctcccaagtgctgggattaaaggcgtgtgccaccaccgcctgacttgttctgggacctcttgtggtatctttttgcctaacttccatctgccagcctaggctctacctttgcctggtagcagatcctcctgggcaggcagtggcttgtcctgcctgtgttgtgcccctttctgggcacatggctgtggctcagcaaagtcgcaaatgaatcaattgactgtgttccaagctgcatgggacagggaacagccgtggctctggtcccacctttgggttacatgtgttaagtgatcaccctgcatatgggtggggtgctggtccctggctaggcaggcatctgtagcagccagacacagttgcccctttgtccctccatagagaggaatggctcagagtcccctggggagaatggacgtgtaaagaaaggcctcctgttctcccatctctccctgtttttccctggattgaccagaagccccatgttagaatggggagggccaagggccctgaagagggcaggatgagtcatgaagcctgatgctgggttgtagttctattattgttgatattttatgtgtatgatgttttgcctgcatgtatgtctgtgtacctggtcccccagaaaacctaagaggggattggattccccgaaactggagttgacaggtgattgtgagctgccatatgggtgctgggaatcaaacccaggtcttttggaagagcggcaagtgctgctaacttcctgagccatctctccagcctctagggtagtttttaagtgactcctgtcctagctccagctgtcccagctccagcccggggactctactttagcagatgtgaggatagatggcccctctggcaattccaagaaagtccttcctgctgctctgttggaaaacagctcacaggaggacatctgcttctctgtttgacccacaggtgacttgggaatacgatgacatttgttctttcttcttttggtcatccatgacaacacccagccccactttccccacagcccctaacatgtatagaccgcaagtttgtggttgaggaacatcttcctggcttcatcattgctgtggaccctttggaaatgctgagaggactctattctgtgagctggcgggaggtgttagtatttgtattttctctctctctctctctctctctctctctctctctctctctggcttttcatgacagggtttttttctatgtaaccctggctgttctggaactcactctttagaccaggctgtcctcaaacttagagatctgcctcctgagagctgggactaaaggcgttaaagttgtgtattttataaatgaagaagtggaagccatgattgggggacgaggcaatagctggcatggacagacctgtctgtttgaatgttcaccactcagtaggaagcatgaggtgttgctgggttctgggaagggggataaggacttaaacaatatgaggattagtttgtttgttgctttttatgtagccttgtatttccttgaacttgggggaactcctgcctcgttctcctgagttctggagtgacgtgtgtggcccgtgctggtatggaggaataaatgttcttgcttaacaacacagcgtgcacttagaaggctgaggcaagaagaccacagaacttggggccagtcaattgtgggccagtctgcactacctagtgagaccttgtttaagaaaaacaaaataacaaaacaaaagtatctacagctcttgggagaaggaaagaggacagggtacaagctgggcagggtcctgcttacttctggcccctagcgttagcagtaggcccctgtctttggtaacattcttgtgctagtcagcggaggtttccatttcctgttgcccagcttgtccctggtccctggttagtgagggtgggagatttcttcggctcctaccacaacccttacctcagcctggcccatatgtcctggaggggccctggctgtgtttttccatcacctcagtacagaatggcactttgcttaacctggtcacatcctacactgtatttggcctgtgatgatcagtggacagaagaccattcatgcagggtagacaagcagagtcagctattctggggaggctctctgttttcccacatgcctgagtggtggggccactttcccccacactgggctctgtatgtcatccctgtcatcagaacccctgtggtgagatttgagagggagagcctatttggggtcatcatcccttgtgtcttatccaatggtttgggggttgtagggtatcatggtctcaagctgtgacccaagtcttctagtgggttgactctgggtctcagaagccattgaggcagagaaagcattcctcactgtccctcctcctgacccacagagtgctgtccgtgctaagatgcctgtgcccggttcctggcagtttcttgtacaatttattccagagaggatggaggccagctgttgtctgtctccagccagtgactaaagtagaggaaatgggcttggaccacagccgggggtgaggtgggggctggggggtggggtcaggttagagtcaggcaataaggaaagggtttcgtgacaggtggttggctcccagaaggagccagcagggagctttgtgcagttggggcaagatcatgcttggagcatagatgaatgacagcctctctagcacccctgtaggcttttatttttttaattagtgaaaaggtttacagtttaaccactggtcatcttaaattataatcagtggtctgcttcaaaaccccttatcatcagaaacccagcctttaaggatgagtgcttagttattcattatccaggctgacagctacaggtagaagcagggatatgcccgtggggtgggaaagcttgctacattgtgacattgtgagagacacagtgggacagagttcaaccacacttctccaggggtcagggataagggccaggagccggcatcctcctggggaggcaggagcttggacacccttctaggcaagagtcctcagaacaggaccggctgccaccagaactgggatgctacagggatctggaagcactacctctcctcttccaggagaacctgaggtaatggtgtgcaccaagagacctgtggaccttcagccagccacctgggatatccctcactcagccccaccctcccctccccacccagtctcttacctttggaatctagttccaaagtcgacaaggaattgactcaatgggccagaacctctgtgtagggggaaagccattgggatctggaaccaggtaccaccccctgcactagtggtgcgccctacccacctcagccatgagggcactcacatcatgccccagcaggcaggtatcccagaaaccccatcattcgttggttaatatgggatgctatccagcaggttctgctttgggtttcatagtgtgagtgacatctgccatctcagcactgacccattcaggcaatattcagagtgagctagataaacagatgcccaacagcgtgatgaagtgtgatgaaggactgactggaaggaggaccggagaaggtgatagtgaagatgaaacccgattgaaggaagatcatgagtcctgtgcaggggcctacaggaacacacaagtggaaatccaccaagctggagccactgtccccatctctgctcttcagggtggtgatggtcagaggcagtgtctcacacagctgtcactgccctcagaacataggcctctctcagacgtttcgatttgtgtgtagaagaaccgtggctacatcagtctttcttccccagtacccactttcagaacatgctgggtgctcggcaccgtaattcctatgctagcccaagtggaatcatggtcctcctagttcacctgtcctgatgttaaggcatgtcccaggtgtcctgcttgtgacgcgagggcttgggatgtctgctccaaagtcaggatctttgcccttgagttgctcccaagggagggtcccaaacttggcacttgggggctttgaagtgaacttctagacacacatgttcagggcagacctgggctacagacaccgggaagcaagggtcccaaacttggcacttgggggctttgaagtgaacttctagacacacatgttcagggcagacctgggctacagacaccgggaagcaagcgtgcacgcatgcacgcggcagggcagctgagctgcaggtgagccagctctttcctaggttgtctgccgtggatggggagttgaccagtcagcagttcccacggtgacctcctttgtagcctgctcaaggtgctgtttttagaaaccttgagcaatggcttcctgtggtcactccttccatctctcctcaaggtcggactgaattgaatagagtggggagcctaagtgtacacgaaccctaaagttgtagtcaagattagataagggtgtgtgtctcctggagtcttttttaagctttacaaaaaactttcctttgacaattccgtacagtgttttcagtcatatccaccgtagctcccccccttctccatagttccccccaacatgtggcctgcctgctatcacgtccccctaattagcgttatctgtgtgcacatgggcaacctacagggagccacaatccctaagaaaagtaatccctcattccctagcaggcgtgagctgcccagctcctcagctagggcggatgggtcctcatgagccatgctggagttactgacagaccttgtacaggtaaccatcgtggccgcgagtccctgagtgtaacagcgtgcgccaacctcgagacagcacttcttggcattcatctgcctctgaccctcttttatagtattctctgcatagtccttgctctgctgtaggtgacaggtgacattccccaacacagtaccagggttgacactggagaatcaggtttttctgtgcaaagggactctactctccctttggcttcttatggctctgccaccagcttgcttgtgtggtttcaaccatgtcacggaccccctcagcagattcctcacgtataaatagtaagagaggtgtccagggctctctgggtattctggctccccttgaagggtcttgtgctgtagagagagaggactggtgtctgctgtatggaggagcgggagatgctgactgacatatgagctcctacagtttgatacgggagagtgagggcacaggactgaaaggcctgcctgtttgtctggaagagatacattcaacacaggggctcttcccagagccctaaaccacccttggaaggaaacctctctcgcttgtaaagcacatcccaagcctggtaggcctgtggggcctaactgaagccattaccctcttggcattggtcagagcagagagatgccaggcattttgggttgtgaattctggtgatggaaagggatgaagtcacaaacccaaggtccagtatatactagcacagagcaggaacttgggtcacttgggggagggcagtggtggttaattggggctcagaggtgctgcagggagataaaagatgccccttttcttgtcttgttggccacaggtaagttctaagagcttcactccagagggcccagctggtgtgcatgtttgggagggaagggccctttcctgttccccaaggccagttcttgggcaagcagctgtgttctgtgactgcatccatacacagggacttccagccctccaggtgccccagcatccttgctgacattccatcctgaggctgacctcctccagcctttcactatactcctggctcagccagcccctgccaaactccgctctacattcatgggaggagtgctggctgccaggaacagggcaggtgaccatctcccaggctgagaacaatagggacagaggcacctgccttgttttctttgtcccttccaagtgaggacagggttcccaggcctgtgaaagtcggaaacccagaaggaactgctaaaaccctgccgctcccttttggcacagatgtgctcccgggagttcgagagagcgtgagacctaggctgtgtctctgagcgccacagagcctgctgagagacagcccagtgagggcagcggggggaatcccaaagctgggtgagaggacattcacacacaaagtgctgactgggagggtgtgggggaggagggggcagaccttcatcccttggattcagggtagctgttggaaaattgcttgggaggatggggaagacgatttagtcagtaaatgtggagaacctaggttcacatccagtactcaagtggaaatccaggtacagagagacatgcgtgcgcctctaatctcagcccaggggaggcacagacaggtggattctcggagctctctagcctcccagcgtaactgaatctgtgagatccgggttcagccagagaccttgtctaaaaaagttaaggtggagaggaactaaggaacactccagaggacggtcggtcggtctctggtctccacatgcacacacgtgtgcatattcatgtttacacaaacacaccacttgcacatgaaaattggctatgtagttgttgttagcacctcctgggaaagcctttgaacctcacttttccagttcaggccctgactttctctgggggctaagacgaagctaaaggcttccccttccctatgttaaggtactgtccaggtcaagaagccacagaacagtcattttcctttgtggtttcactttctacaatctctgattacctatggtcagttgtggtccagaagtattcaacagaaaattccagaagtaattcatgaactcgaactaactaacttgtgagtcacatgatgaaaattcatgctcttggccgcttcctgcctgggacatgaatcatcccttctcatccagtgtatccacactgtgtctgctacctacccatagctcagtcactgtgttatgttgccatggtaccggtatcattggtccaagaaatacacagctccctgttttctagcatctactatgctgtcttggaaaacacctgcacggattgttaatgctaacatggataagtaggataggtctatagtgtcccaatgcatgcagagagtaaatgtgtcatttcccaccctctctctctctcacctgtgctccggctggttgcttctgcagtgggtgaaggaacagcaggctgggtgggcactggacatacactccttcaaagacaaaatatgagtctagacaggaaaggggccttccctccagtgtgagctgggttgaggaagacagaaggcaaactgttcctggctatggggctcctgatgtgggagctgggctaaggctcaataaatttcgatgctgatagcaatatattttgaacatgctaaagagaaggggtaggcgaggaaaggtgctggtctgagcagtagaaaactggtattttaggaggttgtggtcagatcttgttttgtagagaagacgtgggcagaaaggcgaagggttcctagagagtctccgttcttggtatgctctaacagccaagcacactgaggaaggaacaacgtggtgtggccctcccctgggccatccatcatctgtcctctctggataaggcaaggctgctatgagctgggcctccagcgggcccagggagggagttggtactaatgggctcttgcctatacctcgctctgaactatggctgccctctgagcctcaccccagtcaccctgagttggggagaaggcagtgaagaaataccaggaattccttatccctgccctattccccctgctcgagctccacagctcccactccatgccagcctgcactaaaggcagctgctaatgttttttgttttgttctgtttttcattttgctttgagagaaattgctttcttgttggcttgctttggtgtgtgtttttgaaatagggtcttggtgtccaggttggccttgagcttgtgactctcctcatacttctcctggactgttaagattgtaggtgtgtgtcaccatggggattgtttgtttgtttttggagacagggtttcactgtgtagccctggctgttctgggattcatctgtacagcaggctggcctcaaacccacagaaatcctcctgtctgcctcctgagcttagggttaaaggtgtgttccattaccacctgacaccttttggagaatttttaaaatctgtggacacgtgtctgcagggcttggtattttaagcttaaagatggttccttggacagtgcagcctggtcttgagagtccctgcctcacagtgactctgtattgtcaaaatcttagtttcatctaatataagcaagccttacatctcttcccaaccccaagttaacattgagaaaataatgcaagaggtagagttgacttggcctggtctgcaatgggagctgcacgcgcgcgcgcgcgcgtgtgtgtgcgtgtgtgtgtgtgcgtgtgtgtgtgtgtgtgtgtgtgtgtgtgtgtgctcatgtacttgtatgtgtatgacagccagagattagtctcagaagaagcccgcctcactgtttgagactggtcttagtggtgccctcaggctcactcactgatggactaggctggctcaccagtaagctcctagatccttctgcctccacttccccattgagatcacaggcttgcgggactttttacataaatgatgaagatggaatgagtccaggttctgtcccatgcttgcaccccaagcccttcactgaccaagttatctctagccattccaagatattcttatgtgtccataaatcccagtggggattatcagattggatggatgccagctgctcagctgggcacactaacattccctcatctcccaccctgattcctaagttgctttggtgtatgaaggttggtttggggtctccctcctttgacctatgcctgtctgtagctttaaaattttggcagacgttgtactcagtatgtttacctggcatgtatctagctgttaacttttgtacagagaacccctccatttaacgtggggtcttcatccacccttggcttcccacctgggaggggattgtgttagagacatggacatggacagcaagtgactgtgaggccagtgtcaggcagacttttgttgactgtgaagcttgaaacagtaggggggtggggagtgagggattaagttcagagaagttgccatctgtcccctcctgtcctccacctcacctggggagtgcagcgctaacccctattcacctagacagcctcctctgttgcttagttgaatggcagacacactattagggatggcccagaactggaggcagggggagattaggttcccttctgaaggtaaggatactttatatgtgcctgagtttcttcctgccacgacacctaactatggagacgtagtgctttctccatgtggtctgaggaagccaagcgataagaggcttagggagagaaaggcttctcactgcctcccttctaggcatgggctgtgaacttgtagtcctgtccagggtttgccactccctcctgtcctttttgtttgtttgtttgatttttgtttgttttggggggttttttcaagacagggtttctctgtgtagccctggctgtcctggaactcactctgtagaccaggctggcctcgaactcagaaatcctcctgcctctgccttccaagtgctgggattaaaggcgtgcgccaccactatctggctgggcaagtgagtctttagtgggatctcatgtctacagtgtctgtgctcctgatttagaccaagatagatgagctagcatgctgatggcaggcacacttggccagccctcacgggggcctggatgctcctcttgtgttcagaagatgcaggccaagagcagccaagtactttacccaagccttgttgctagcctttgggagaccttgcccagctcaatctcaggtaggtccaactggttctgtgtgtagacagcctgtatctgagatggctcagcttgtcatcgccgcagtggactgtctgtgactaggggtgagtgcatttggagaggagaggttggcaaagagtcagtgaagcggccatcagtcagcgtggacttctatactccctttcctgctctcgctatatagccattgcctttgtgagggtttccggaggtgaccggtgtccttcctgcaggaaggacaacctggttaccccatgggtattcccctagcgcagccattgcatgctctgttgcctttcctctggctctttctgcccccctaaccctcatcccctctctagcctggctccttcccttccctgggctgggtgcacagtcccgtggccttcccaagtgcagtgctcagctctatccagaacacccactgcttcccccgattctgctggacagaagcctctgctttgttgcagataaaactgtttaaaacccaactgcagccaggtatggtggagcaagtcttccatcccagcactgagatgcaggggcaggcggatctctgtataaacttgaggcccacttggtctatataggaagttccagaccagccacaaccatacaatgagtccctatcttaaaagaataaagcaactttagaataatgctcaaagatgttggggtgtgtgggcatttgaagacaaatgagccgaggctggagtaccccattcttcattcaaattcacttaacaggaacaggcactcagtcgtgcggtgactactctctgtgaggcagagacctaagctccaggaatacaaagcctcttcttggcatttatactacagggaactcttttttttttccccctggtgacatttaacatttcctttgtgattgtctgaggcagtgtgttataaatctgacttcattctactaaccagcgtacccagtgttccatcttctccctctgtactgtagtggtcctgcctgaattcacatcccagctctgccacttaccttggactggaccctgctttcttatcgttaaaataggctaagggtccctgctttgcaagacctagccattccgtgagagaagtgttttaagtacatgatcagtacctgtccccacacgtgcccaactatcacttcagcagctacacagttaagaggtggtgtctggaaaagccacagtaaggaggctgataatggcttcagtatttgaggtcttaagcaccgtggacaggtgaagtgactttccagaacagagggactgtgtgagcacaaaggattaaagaagggatccagaggcagccagtgagagcacgagggttctggctcttggaacaccataggactgcagttttccaggtcaggagtagaggatggaagaagggctgtgttcgggaagccataggagtcgtgggagagatcaaatagctgcatggatgcttcttagctggaacccctgcagtaggctcatgtcttggccagttccccccaccctatgcaaagaaaagtccacctgactgcggtggcgtggtcggtcggtgtctacaggttagagtgggcgtgtggatgttggccactagaagacctgctgggaatggctggactggtttttgggcactgttttctcagctggtgggaaaggttggaagtgtgcataggtctccttcctgtgccctctgtggggaaagggggcgggatcaccatggttaggacccaggtggccctgggttctagtcccagccttgtagcttttagtaccatgacctctggctacttccttgctatctcagcctcagactctcatttgcaacgtggaaaaaatgatagtgtcttcccagtagaatcctgtcctcattaaatgagctaaaaggcacgtaaaatgctgagcacaccccttggctcataggaagacctcaataaatcacgctggctttatgatgaaggtgacaagtagggaactcgattccgtccccaaacaggagcctggcctggattgtgcaggctcggctccctctctccatcaccctcccagcttaggaggaaagtgaaaatattgtctcttgtgagtttaggagccaagttaaagaatactgcaagtgaacaggggccacctcctcccgtgaaagctgtttctctaaccccgagaacaggacgccttgtctaacagggtttgcctgcctcccccccacagccctcccttgacccaggcatggccctcatcctgggtcagctcgtttgttctgggagactgattcaggcctcttcctcaccctgtgggatccaaccatggccaactgtgcctctccaccatggctccacacagtgggaaaaagagtcgctggccctgaagttcgcattcagacctcagctctgtgccaagtgatacctggcagaatcaggaagagccaggcaggtgatggatgtgtccaagtccaagcaagggagtgtctggccacagcggcagtcttgtgccccatcttgtgatcaccccccccccccccatccttgttccaggtttggcgaaaagccgtgcagccatatttcggaatggtgggcaggggaagaaacagtaaggggctctggggagctgtgcacaccactacctttttcacccttcttttaagacactgtgcctttccacgattgtagtgtttcacggggtgaggggctcttaggagagtgaacgccttccacagttatctgtccttgatgggtgactcaagagaacgcaacgcaagtcacggggaaagcaggtgagcggccgctcctgataagccaggaagagggcgaggctgtgtgcctcggaggacaccaccaccagtggggtgagggcaggaagcccggcattgctatcctctatgctgtcctgatttttcagttcttctgtcaggggaatgtttagtactttctgactgatttctgaattaccggtggcctttgagtcagcctgtttccaggggagcattgaggcattatgggtagggctgtcttgtgaatgctatggcatttattgcctttggtcagccatccacttcatgccagtattgtccccctgttaaccacgtgtgcaaacctgtgagaagacagattcaattgttcacaaccgtactccctgtctgacatatagtactccctgtgaacaccatctcctaaccctccagaaactacaactagtcctgagtagggtctcctgtcctctgcgcccccatataaactcctcctggacgatgctcacccctgtactaaccgagtctcagtagagaatctgcagcggcagatggttatcctcaaacacttcgatgatggctctctttggtcttgagctcattgactaccatgacgtgtatagtccgacacagagttggaacagtgtgttccttgtggcctgaccttgaaacacaatggactaggtgtctccaactctggacaggtaacacaccctgggatttactttttaccccgtttattgatctgtggtcagcggagaccaagaaagaactctcccccattcttgcatactctgtttcgttttaggttgtccggtttaagatttctatctgataacaggtggggacttaaatggtattgccttttctcccatctgtttaatgtcaacactcggggctctagactttcctcattctcctgctgcagacagatttttaaaggctaaatagctgctaaggtgtggcttggtacccgagccatttcccagtaagtaggttcagtctctcagaattgaagggagaacctgttgtatgctcctgctggtctgcagcatctaagatgctcttacacatagactatgtaagatagtctgctttccatggtctcccaagcttggaatggcagtgggaggtagggcagcaagcggcctgtggtctgatggggtgtcgagcgggcatgtcatcatggaaaattcttcgccaaagtatgcagatccatttacacagcctctgctgcttctgcaaactgtgcattcctttggaaccatccatgcgttctctccttccctccaaacctcagtcatgcttcgggtggcttagaatgatggcttctctacctctccgttgtttccactctctggtccctgctgtccttggcttggattttataggaaacttggctgggttcctggtctctaggctgatgggtcatcccagggctgaccttgaatgacagaacttgaaccccagatttagagcccctaatgggtctcttgggtacagtctctggcagctcttggtgtatgtagctctgatactgctcctttggtcagatgagttgagaggtaggcagagtcggtgtttgtaagtgaggcaggtagtggtatgtagaaccaggtttggtatttctgggaaattcctagagtagataatgcctgccctggggcttccaaccagttggaaactgtagggaccggtacgtttggatcaccttgaagtacaattgccacctgttgatctgtctctgtcccaacaattgctcagcccaggtcagagaaaagaaggaactcagagaaaagggagcctgtcacgatgagggacaggatcgggaaaggttggtttagctagtttacgtatcctgatacgtatccttggcctctaggatactgagctgatctcagtggtcatcctcaagtgcagtggttaaaggctccttcccaggtcacagagggctaaggtatagggggacattggaggtacctgtattgagtctgccctcttagagataggaatagtctcgtagctcttggagttcaggccctgaactccacttcttggaaaccacatggaaactctttgggagagctcccttcccagaagcctggggtgcaagctttctcagctctgggtggtttgaggatatgtttctgtcaaattttcgaaccaggtgcctacttcgtatatctccctagctgtgtggacctgagtagatcattcaacctccctgatcctctctgtaaaatgtttcagctatataataaagaactgctacccaccttggtatcctggtggttaaatgaggacacttgagatgtgtggctgctgctggtggtattagtttggggcaggggctcaggtagcccggcctggccttgaagcataatcctgattcccttccccctgctttctttcttccttgttgggttttggtttggtttggtttttgagacagggtttctctgtgtagccctggctgtcttggaacttgcactgtagaccaatggggcctggaactcatagatttacctgtccctcctccttagtgctgggattaaaggcatgtgccaccattggcgggctcctctgtttcctcgagtgttggcattacaagtgtgtgccaccatgccaggtttatgtcatgtttggaatggagcttagagtatgtatgtttgctaggcaaggtggactccaccttggagctacatctcttgtcactgataaatcctcttgtctctgaccttctctttggttttcttttttaggtggtgtctgatgctgcggatcagggtgtggccatcaccgggaaccagactttcaacaactggaactggcccaatgcaatgatttttgctgccacagtcatcaccaccatcggtaagtccccgaacaccttcagtacaccaagatccacatcctcactcctcagaaccgtacaggaatccagctttggtgactgtaagtttcaccctggccttttggttaggaaggacttagtaagtcccgagtgattggccatacctatgcaaccacttccataggtcctgatttagactgtatttttttttcattatttctgcatgcctatgtgtgtggtgtgcacacatgtgagtgtgtgtttgcatttgtgtaggcacacatatattcgaggatatatgtgtttggtggtccaaggttaacatctagtatcttctttgattgttctctaccttatatattgagatgtggtctctagctaacccaaaaattcacctagtctagctagtttgttctagagatcctatgtctgtgccaccgtttgttgggatgataggccacccacctcacccacccagcctttacatggctcccaaggttctttattccatttggactcttcaagcagaaacaccagagtggcttgacggggagaaccacactggtgagatagactgcttactgcacaaagccccattgttctatggttctgtggcttaactatcttcaccctttcagggttggctgggttcagctaacagttcttacgtgggctctctagcatatggtagtcaaatagtggctgcccactggtctggagtccagcctggcttctcccacctactgtttgactcttggtgttgactgctggctggggttgaatgctcagagcctctgcagctgggcactcgaaggaggagtcttccaattcagtgcgtgaagacaggaagcagcagtgggcttttcccggctccccctgcctatatcactctggccaaccacgccactgatactcagattcacagactacacttgacacgagcgtcttgacacttgacacttgacacgagcgtctgggcagagggattcagagtggccatctttggagtctgtcctccacactgggtgagggcaggcatctttgttttatttgcatagcagtacccagtgatcagtggagtacccgtgggcctcatgcctgcccacaaggaactcacataatggaggggacaaagcccctactgtagaaataattgtataattgatcagggtcagggtcagggcatgatcaggggatcatacattgatgttactaaaaccagatcagtttatcttagagtgtgtttctctcaagctagcatgtgtgtgtgtgtgtgtgtgtgtgtgtgtgtgtgtgtgtgnnnnnnnnnnnnnnnnnnnnctgggcgcctcttctgtgtcttctacggcctcttcggggtgccgctgtgcctgacatggatgcagtgccctgggcaagttcttcgggggacgtgcaaagaggttgggccagtttcttaccaggagaggagtgagcctggtatgttcctaaccttagacacagagttaaggggtgggagggaccatggcaggggaggagaggtgttgggacaggtgaccctgggctctgtgtctcagctgggataggaatcccttcccacagctgacttgctttctcaccaaccctgctagaggaaggctcagatcacgtgtacagccatcttcatcgtgtggggtgtcctggtccatctggtgatcccgccctttgtgttcatggtgacagaagaatggaactacattgagggcctctactattccttcatcaccatctccaccattggctttggggactttgtggccggtgagtccctgcctccttcctctgacctctgccatgtctagttctaattcaaggcagacctttgttgggcacctgatagatgttagtcttttctctctctctcttgcttctcttatcccatcctcaactcacttggattcaccttgaagcttacagcaacacacacacacacacacacacacacacactgagccaggatggctgccagacaagagaggccttctccccactgccctgccccctcagccctgctttcctcctcctcctctgcttaatccccacaggcaatgaagaggttctttgtccgatttgtgtaaaggcctgtgcctgtcccagccacccatgctctgtgtctggtgcctgtggcctgcacagcctcctggttcctaatcttgaaaccattctggaccagtgtcagcctgtgccctattgacctgcacctcagctcccagaggtcacggcgccagctgctttgcccagggggcaggtggacgtcatgcctctgccccctttttatgtggaatgcagtgagagggcagctgagtgggtagaaggaacaggacgcttgctttagtgaacactcctgacccttgcttcacaggcctgcctgctgtctggatataaatttagaggcacaaccctgtcgttgtttagtctcaggggcccagagcctgctgaggggaaggaagcctgtggtattaagaagtccagtggtaactttaggcatactttggtgttccagagagataccagatccatcctcctatcttaagtgtctgtaacaatagccaccagcacatgggacactgtgtactgaatccctctcagtcctcaggtgccgagcttagaaaccagccatgtgaacatgtgacatcattgctgccattcattgtgatcaggagccaatgcagtattgccttcagagcaaggcacttcctaagtcagaggctctgctcctggctccagggaaggttgcaatgagggctgggggtttcctcttccaggcccttcccttgactaacttcccaccgtggaaggcaggatgcagataaagctccaaaggttatttttaaaaattacttttttaattattattttatttatttgtatggtgggggtttgcacatgtggaggtcaggggacacttttcaggagtttgttctcttcttttaccatgtgtgtcctggggggtcaaactcaggtcttcaagcttggcagcaagcatctttagctcactgagccatgttgcctgaccatgaaggaaatcttacctaattctagaagggagaagcagctctggagctgtggggtgaaggtgggaaagactttctagagtgtgttgtcacagaggggcatacagagtgttggagccaccaaggaccaccagagagagggttacactgaagagggccgagctaggaaggcaggaaggcaggctccgtcttggaggagggtaaagacagttcagagtggttcttgccaggtcagtgcttcctgggtcatctcgacccaaccatcattcacagtaaatctgttaggccctcccaggggcagaggctgccagcacccccaatgtcgactttccattccatttttaactgtgctgtgtgatgtgctcactagctgggaggaatagagaaaggagcagaaagattcacactcaggagctggttattcaacagttgcctcaaagagcccccctggggggagggagggagagagagagagagagagttagttagttttgcctggatgtatatctgtgtgccacatgtgtgcctagtgacagaaagagggtatcagactcttggagttactagagttacagatggttctaagtagccgtgttggcactgggaatcgaacctgggtccatctgagagaacaatcagtgctcttaaccatagtgctcttaaccgttaagacaacagcaaccctcatgtgaattttgtgtaacaaccctgactgtcctagactcactttgtagactaggctggtctcaaaactcacagctgtctacctgcctctgcctcccaaatgttgggattaaaggtatccaccatcacgcctgactcccaggccctctttttttggacactggactctgtctgcatggtgttatatcagccagcacagctctggcccttgctgaccctctgggcttcctgtctttacaggtgtgaaccccagtgccaactaccacgccctataccgatactttgtggagctttggatctacctggggctggcttggctgtccctctttgtcaactggaaggtgagcatgtttgtggaagtacacaaagccattaaaaagaggcggcggcggcgcaaggaatcctttgagagctctccacactcccggaaggccctacagatggctggaagtacagcatccaaggacgtcaacatcttcagcttcctatccaaaaaggaggagacctacaatgacctcatcaaacagattgggaagaaggcaatgaaaacaagtgggggaggggagagggtcccaggacctggacacgggctgggacctcaaggggatagactacccaccatccctgcatccctggcacctttggtggtctattccaagaatcgggtgcccagcttggaagaggtatctcagactctaaaaaacaagggacatgtgtcaaggccacttggtgaggaggctggggcacaggcccccaaggatagttaccaaacctctgaagtgtttattaaccaactggaccgtatcagtgaggagggagagccgtgggaagccctggactaccacccgctcatcttccaaaatgccaacattacctttgaaaatgaagaaaccggcctctcagacgaggagacctctaagtcttctgtggaggacaacctgacctcaaaggagcagcctgaacagggacccatggctgaggcacccttgagcagcacgggtgaattcccttcatccgatgagtccaccttcaccagcaccgagtcagagctctccgtgccttacgagcagctgatgaacgaatacaacaaggcagataaccccaggggcacgtgaggtgggcctggctccccacttgctttccagtggcttcctctcacgaggattgtcctgtgatggccagaccccagggagaaggctctggaaatgagatggggagccagggacctgcctttccttctgtcctctccacttggttgcttccatgggatgtggtgttggcccaggacaggcctccgttctgtggcccagtagggaggctgctgtcctgggcctgcccggcaggtgtattgctgattcaggcacgtaggccgcaacactcaccctggaggtcctgggtttgctgcttgtgtcttcccccatcactcggttgactgttgtacggttctctgaggccaggagcttcagctgagttcaccagtgttaatgggcaacgcccttgtgccttgcactaagctagacatttggaaggaggagctcataagacccaggtttggcatgtggttctcgggtgttctgggaaagcacagatatgatggggtttggggcctctcagtaccccagcagtagcaggacctgcttgcccaagtaggcatcactgcccagcaagccccttactgcaaacctcagggcaggggatgtaggggagagctatgtgtgtcctctgtgtggagtcatgcccacctcagattccctctgaacaacaacagcaggccaaagggtccctgtgccccgaaagtgcagaagaaagatggagcctccggatgtggtcagggagctcagagatgaggtgcaggcccctcagccccagcctaggcacccatactcccagcccaccgtctcatttcagagagattctctcactgcctctccctcctctcttagtgggggccaaattgttcttggctcatagaactgtgaattgagcccccccctccagccactatatggtattagcatgtgtaactgccaatcaatgggcatgcgtgtgcacatttgggctggggagaaaagaaaatgtgaatcttactggtccagttcctagcgaggtctgggaactagctgctgtatatgtccttgatgctcagcccactctggcctaaatgctttttgttattaatattttttaatgaactgttatttttatacccagagccagtaaagaacagggtccctgccattagaatggaggtctgtcaggcactctgttgtccttccaactcagcttgtcctttgtcaagccaaggtctagctacggaggggcaggcgcaggtctcgggtgaggggcagctgataacctgcctcagccccttcccctgctgtgtgcatttgcggaggggcatatagggccagagcccccacacgttaggacagtgagaggtgtgtatccatacctccaccattatcaaagcggttgtagaggccacagcagcctcggtggggggaagagccaggctcctgtgagaggacctcagctgaatgtcctggcggcacaccaaccacgctgtgtgcatgtgccgatggtgaaggcagatgtaatttattttaacatttttttacaataaaacacatgaacaagcccacttggtgtgtggtatgtttgcggtgggagcacggtggggccgtggggtgggcaaggacaggctgatgtctgtaggtcagaaggatcagtatagagctgaagtggagatttaggagaaaaacataagcaagaacatctaggagcggggcaaaggagatggtcttctgacttactctggcgccgtgacaatattctgccccaaagcaacctgaggaaaagttatttggcttacatatttccatcatcaagggcagccagggcgagaacctggaggcaggaactataaaagccatcttttgctggcttgatttatgactcattacagcctcatgcttagcctgagtttttcatacagcccaggaccacccgcctagggatggtgctacccacactgggctgaactcttcttcctgaattgtaatcaaaaccgtctcccaaggctgtgcctcattcctcagtgatggctgccccccccccccgcccgcatcccccccccttccagtcagagaggggcatcaactggacaattaaggccaggtcaggtcagggaggatgtatggccaagtctgcccctcactagcttccagacacctttctacagactttacacccagtaaaacacaaagtaacacctttgtaccttacagcagtcctgccctagaagcaaagggagcaggaggcagacaggtgtctgaggcaccaagttgtgcagacagtaaaaatggagacgttggctttgaatccaggcagcacagttcctggctagtccacagccaatgtgccgggatgagaagatggctagtggggtttgattgttctgacatcactagacgggcctcacagctccagctgggtgaatcagaactttcccaacgtaaggagtttggaagcagagacatgagcaccctgtttaaaacctgtgacctggaaagatgactcatgggtaacatttgccaagtggccctgactgcagtttggtccccagcgtacacttaaaaagccacatgaggtgcccagagccccagcagtcccacagtgagattggagttggaaacgggaatcagatggatgctttatccatagcacaagggcaagagtactgagaccctacctccaaaacaaggtggaaagagaactactctgggaaagtcctggcctacctgtacatacatgtgcctggattggtcattcacacctgtgatccaacccgctgtgccatcttcccagccgctgtgccatttctataaagaatcctgagatttggatggcccagagtggtcctggaaacaacaccgcacagataatgtacagttgaattgaaaatccttcccgtctgcctattcatttcttccctccctctcctccctcatgccctccccctcggcccacacgagtgcactcagatgcataggtccaaggctttctggtttgactttgtccttaagataacagcatcgtaacgccaacattctttatttagcatcaggtggcttcacaaactgccgattgctgtttaaaacagcatagcccttcagccccagcagcgccaattactgtgtgctggagatgggacttggggattacctttcagggacagagctgaaggggacactgacagattatggacacacaccgaggaaggctgagctcttgtcttcctatgctgagcttaatctggagcgttctgaagcaggaggctggaccgaagctggatagaaggtagagcagagccctggccaggctcccccacttcctgagaggtcttggacagagaaagggggtgcttcaggagtgagggatgggttgtggaggtggaagcagtgagctggccccaggctcagaagtcgctgggcactctggcaggcacagccctccctccattgaagccactgaattagccctagcctggggcagtgctccagatgggcgagatcaatagactcaatggaagtccatggtgctggtcctcccagcagcctctaggttctgctgcctccagaagccagccttccagccctggcctgagatagctccctactctccctcagtatcattgcactctctgccgccactgttaactggtcacctgctgtgcgctaggttaggtgtaggcacttctggtgcagctaggtgtgggactgacaaatggccctgcatccagggagcaaaaatggtgtctgtcctagtgtaggtgggtgatgggtattgataccccccaagatttcttttctaattttaaattatgtgtatgtgggtatgcacatatgtgtgcaggtacttgagaaggccagaagagagtatcacgtctcttggagctggagttacaggtgactttgagctgcctgatgtgtgtgctgggaacgccacaagagcagtatatgcccttaactgctgagccttctctagctcctgggacttcaaaacaaaaacgaaacaaaacaagaaatattattttattaattctttgggaatcccatgcatgcatttaacaattttgattatatttcccccctcttcctacccctaattcttcccagatctattccacacccccacctcctctcccaacttcatagcctcattttttaaaaacaacccattaagtccaatttgtacaaatggggggaggggagcattggagcaagacagacctaccggggccacacctttaaagaaaacggactctgcctcctttttagtgaccacttgtcaacagctccttagtttgggctgggggctggtgagcccatccccacccgtgctggaaggttggctggattgatcttgtgctgtggttgagttcatgagtgtgctggccctgtagtgttcatccaaaagatgtcgcttgccccgttctccctgacctccagctcgtacagtctttctgccccctcttccgtgatgttccctgagccttgggggaggggttatgctatagctgtctcctttgtggctgagcactacagagcactttttctctgcactgtggggctgtgattttttgcattaaccagcatgcactgtgttaaaaagccttaagctctcttttatctatgccttttaatcctaacgtgttattaacttcatcttacaaatgaagaagcagaagagagcaattttccccaagttcaaacagctatgaggtggcagaaaacacctgctcagacttgtgttcctgtccctcacactgccctctggcagttatgaatctgatagggaagacaccccaaagtctgttggaggtggcggaggctctgaccttcaaagagtctgtaatctgagggggagggagaccagatatggagaaaccaacacgtatactctatcccagctgcctctctaccaccacctcctcctcctcctcctcctcctcctcctccttcttcttcttcttcttttttttttttttttttttttttttttggtttttcaagacagggtttctctgtatagccctggctgtcctggaactcactttgtagaccaggctggccttgaactcagaaatccacctgcctctgcctcccaagtgctgggattaaaggcgtgtgccacctctctaccttcttgtgagaccccagaagaatcaccattgttcaggaggactaaacaaacaaacaaacaaacataagcctgcttgggtgtcacctcatcctagaatgggcttggcaggggcagggttgcttgggaagtttctgaagccaaggctaccatgtgggaagacagtgggcaagttaggcagattgctctgggagaggtctccagcaaagacaacctctctttggggcgcggggtgggggtgggggcacctgaagtttggtctcagctctgcccatctgctctccatgtttgaataacaagttcctgcttcaaacagacaaacaaacaaacaaacaaactaactaacccacttatttggtgagggggtggggaccactctgtccttgccaaagtcagaagacaacctaggggacacagacatcctttgtcatgtgtgttttggggatcaaacacagggaatcaggattgagagcaagtgcctttacctgctgagctgtcttgctggccccaggtgctagtctatgagtctccacagtgttcctgctatctaggatccactccatcacgtgcctttactttcccaggggccacctgctatcacctttccatagccaccagccagccctctccgagtctaggctgggtacctttccctgtgtggcaccgtccccctcaggaaaccacctctgttcaaactgctgtgacctgttcaagttccctgtctcccactcttatgccctcttcccggcagagaagcactcgctggtggtactgaagactgggttagtcatgtgtgtattcccaccagggcttaaatacatgtggatggtctctgctttctgatatttgaaaactgcagggtgaatgccccccccccccacgccccggatcccatacttctcattggcagttctgtccctctgttcctgaagcagaggccagaccaggatcaaatcttgttccacgagggcgagttccaacaaagccaggtggatgaacttgagggaccttgtggcagactgaggtggcctgatgagtcacctcatcttatgccaagtcatctgagtctagagggcagggccaggacacagcatacctgatttctcccacctgagagcattgttactgcaaacctcttttatacatctccgcatctttacctctctgtgtttccagatgattcgaaacagagttcccatggcccccaaattcttcctttccggccatcttttcaggctggagtatctcttccgtcgttagccccacacaactgtactggtctcttggtttacaaagccctttcacaccctttgctatgtggagattgctcaacaaattgaagcaaacaggtgtagtgttttatagcccaactgaagggctttttacaagttaggaaatctggtactttggtttggggcctagaagagcaaggcctcgggcaaggtcagaagtagcagacatggaggtggggggtgatgatggagaaaagagaaggggcagcagagatttacttctaaaacattattttaagtttctagtgctctctctctctctcccccctccctctctttccctctctctccttcttcctccctctctctcccctctctctgtatatgtgtgtgtgagagagggggcagagtgagcgatcgagggagcgagcaaatgtgtatgtgtgtaccacatgtgtgtggatggctgaagccagaagacattgtcagagcccctggagctggagttgcaggcgattgtgaactacccaacgtggtgctagaaacagaattcaggactccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagggagagagagagagagagagagagagagagagagagagagagagagagagcacaccaagggaaaatgagagcaagccaagaaagctgaacttaatttttttttttttttgaaataaggttggtcttgaaccaccattgagccaagggtcaccctgacctacctattctcctgcctctaccttttgcccatatgcttgctaccttgcagtttaaaggatgcctgcattgaacccagggctttatgcattttagccaaggactcaaccaattgagctatatcctcagaccctgaatttgatttttttttaaaagatttatttatttattatatgtaagtacactgtagctgtcttcagacactccagaagagggtgtcagatctcattacggatgtttgtgagccaccatgtgattgctgggatttgaactcaggacctttggaagagcagtcagtgctcttacccactgagccatctctccagcccctgaatttgattttttgttttgttttgttttgtttttttgagacagggtttctctgtatagccctggctgacctggaactaactctgtagaccaggatggcctggaactcagaaatccacctgcctctgcctcccaagtgctgggactgaatttgattttttaacagtctgccattgggataaccactacacactcacaaaacaggcttgaattccttcccaggatggtgctctcaaaggcccaataacctttactagactctactgttataggatatttgaatctgtttatagttagggtgtggttcagcctttagtatgcatctttaatcccaaacaatgaaggtaaaattagtttgtaaaaggaaacacccatatttgaaagtgatgtctaatcgagtggcagacaaagtgatgaatcagagaaagatttgacagactaggatatgcccaactctcaagagaagagagaggaaagggaaactacttcaggagagacaggcagcacactaagaagagaatatagtacaagaacacagtagtatatgtggagacatttcagtagagttcagaaggagagcagagcagcacagagagggagaaagaggcagttttaccaggagaattttacagagacaggttgaagagagaacaaggtagacataggtagagacagaatgagcaaaagaatgggaaggaaccagaaagttagaaagattgctagagttagtttgaggtcaagcagaacaattcagaggtcaagagaaaagccagactggataagtcgggggggggggggggaggagtttgagtaaggtcaactgagttgaaccagccagtcagaggagaaaaaaaaaaaaagaagggttagcttattcagcagtaagtctcagagactgaaaacattctaggcctagattagattatacagagactagaagcttccaagactaggcctaggttagcagactgaggcagtaagcctccaaagcaacaattacaacaggtgaataaaatatacctttacactccctcttaacgattctatcaccttcaacataattacactagggaccaagccaccagctcaggagtctttggtagataacctgtatgatggtctgagacatttgctgtgcttatcccaagcaaatggctgtctgctgggctatggagaaggttctgaggtacagagacagcccagcacctaccacaactacactaaaatgtgaagcagtgaggcatggggctggagagattgttcagtgtttcagagcacttgcttttacagagaacccaggctttgttcccagcatccacatggtggctcagaattacctgtaattctagttccaggggatctgatttcctctcctggccttcaagggctccttcaaacacatgctacatataaactcatgtagcacacataaatacacacacattctaaaacttgtaaagtgaaccaccttttgggtatacttgagccaaaaagcaccggctaccccaactcgaaaactctgtccttagatgcaacaaagctgagaccagatattattcttgtccaatgtcttttcctcggatgttgaagatccatctgtttccagttctccagacctctgtgctctctgttaaatgtgttaggaggtctggagtctgtgattatctaggcaggtgatgttaatagccatttctgcttatgtaaagatgcctcactgtcttacggattgtcttagtcagtgttctattgctgtgaggagacaccacaaccagggtaacacttataaaggaaagcatttaattggggcttgcttacagtttcagaggtttagtccactatcatcatggcagggagcttggtagcacttaggcagaca

SEQ ID NO: 158 - DNA, 1499 bp, Mus musculus
atggtggaccggggtcctttactcacctcggccatcatattctacctggccatcggggcagcgatcttcgaagtgctggaggagccacactggaaggaggccaagaaaaactactatacacagaaactgcatctactcaaggagtttccgtgcctgagtcaggagggactggacaagatcctacaggtggtgtctgatgctgcggatcagggtgtggccatcaccgggaaccagactttcaacaactggaactggcccaatgcaatgatttttgctgccacagtcatcaccaccatcgcctttacatggctcccaagctgggcgcctcttctgtgtcttctacggcctcttcggggtgccgctgtgcctgacatggatgcagtgccctgggcaagttcttcgggggacgtgcaaagaggttgggccagtttcttaccaggagaggagtgagcctgaggaaggctcagatcacgtgtacagccatcttcatcgtgtggggtgtcctggtccatctggtgatcccgccctttgtgttcatggtgacagaagaatggaactacattgagggcctctactattccttcatcaccatctccaccattggctttggggactttgtggccggtgtgaaccccagtgccaactaccacgccctataccgatactttgtggagctttggatctacctggggctggcttggctgtccctctttgtcaactggaaggtgagcatgtttgtggaagtacacaaagccattaaaaagaggcggcggcggcgcaaggaatcctttgagagctctccacactcccggaaggccctacagatggctggaagtacagcatccaaggacgtcaacatcttcagcttcctatccaaaaaggaggagacctacaatgacctcatcaaacagattgggaagaaggcaatgaaaacaagtgggggaggggagagggtcccaggacctggacacgggctgggacctcaaggggatagactacccaccatccctgcatccctggcacctttggtggtctattccaagaatcgggtgcccagcttggaagaggtatctcagactctaaaaaacaagggacatgtgtcaaggccacttggtgaggaggctggggcacaggcccccaaggatagttaccaaacctctgaagtgtttattaaccaactggaccgtatcagtgaggagggagagccgtgggaagccctggactaccacccgctcatcttccaaaatgccaacattacctttgaaaatgaagaaaccggcctctcagacgaggagacctctaagtcttctgtggaggacaacctgacctcaaaggagcagcctgaacagggacccatggctgaggcacccttgagcagcacgggtgaattcccttcatccgatgagtccaccttcaccagcaccgagtcagagctctccgtgccttacgagcagctgatgaacgaatacaacaaggcagataaccccaggggcacgtga

SEQ ID NO: 159 - protein, 373 aa, Mus musculus
HGCSALGKFFGGRAKRLGQFLTRRGVSLRKAQITCTAIFIVWGVLVHLVIPPFVFMVTEEWNYIEGYSFITISTIGFGDFVAGVNPSANYHALYRYFVELWIYLGLAWLSLFVNWKVSMFVEVHKAIKKRRRRRKESFESSPHSRKALQMAGSTASKDVNIFSFLSKKEETYNDLIKQIGKKAMKTSGGGERVPGPGHGLGPQGDRLPTIPASLAPLVVYSKNRVPSLEEVSQTLKNKGHVSRPLGEEAGAQAPKDSYQTSEVFINQLDRISEEGEPWEALDYHPLIFQNANITFENEETGLSDEETSKSSVEDNLTSKEQPEQGPMAEAPLSSTGEFPSSDESTFTSTESELSVPYEQLMNEYNKADNPRGT

SEQ ID NO: 160 - DNA, 60915 bp, Homo sapiens
cttaatgcagccagggggcaagggaggtcaggggaggcaggctgggggaggggctccatgtgggagcaaagtgttcaggcaatggggtaggaaaggcagattagtattggtgccaactccagaatgcagcaggttctgcagacagcagcataaagtagcagggctctgaagacaggggcagggccctagatcacaaagctgctaactcccctaacatctcctgaatcgtccctgcttcccactgctactgctcctaccttccttctggtccccgtcatctcgcccctgaactattgctaccacctcctgaaggacgagctgcctttgtgaattcttggaagtgctacaacaatcagattacttgcctacttaaaacctgggcagaatgcataagcttatttttgttgcgtgcacccctctggtagcctggtgaagcctgtggacttcttcctatgatgatgttttattttatttttgagatggagcctcactgtcacccaggctggaaggcagtgacacgatctcggttcactgcaacctccacttcccgggttcaagcggtttttgtgactcagcctcccaagtagctgggattacaggcatgcgccaccacaccgagtaatttttgtatttttagtagagaagggctttctccatgttgaccaggctggtctccaactcctgacctcaagtgatctgccctcctcagcctcctaaactgctgggattacaggcatggccaccatgcctagcccctagggtgatgttttaaatgtataaaataaaatatactgagctgggtgcggtggctcacgcctgtaatcccagtgctttgggaggctgaggtgggcagatcagttgaggccaaaagttcgagaccagcctggccaagatgacaaaaccccatctctactaaaattacaaaaaaaaattagccaggcatggtagtggttgcctgtagtcccagctactcgggaggctgaggcacgagaattgcttgtacctgggagggggaggttacagtgagctgatataatactcctgcactccagcctgggcgacaaagtgagatgctgcctcaaaaaaaaaaatatatatatatatacacacacacacgtatatatgtactcacatatgtatataatgtactatacatatgtatacacatatgtatataatgtattataaaggcaatcaagtatgttaaaaaacaatgatcaatatatttcttaaaaataaaatttgtgaccgggtgtggtggctcatgcctataatcccaacactttgggaggccaaggtgggccaatcacttgaggtcaggagtctgagaccagcctggccaatgtggtgaaaccccatctctactaaaaatacaaaaattagctgggcaagtggcgggcacctgtcatcccagctactcgggaggctgaggcaggaggaattgcttgaacccgggaggtggaggttgcggtgagtcgagatcgcaccattgcactccagcctgggcaacaagagcgaaactgcatctcaaaataaataaaataaaatttgcaaatagtaatatatgagcttttttttttgagacagaatatctctctgtcccccaggctggagtgcagtagcactatcttggctcactgcaacctctgtctcccgggttcaactgattctagtgcctcagcctccaaagacatatgcactttttaataaacacctcatatgataagttacagcggtgggtctcctaactgacataattttgagacaaaattttgaactatctgccaccatgttcatgggataggaaaagaactgtgatatctgttggtgagagagtctcgggtactgctaatagtactttggtttgttgtctacatttgttttaaaaggcagtgctggccaggcacagtggctcacgcctgcaatcccagcactttgggaggccaaagtgggcagatcacttgaggtcaggagttggagaccagcctggccaacatggcgaaaccctgtctctattaaaaatacaaaaattaaccgggcatgatggctcacaactgtaatcccagctactcaggaggttgaggcaagagaatcacttgaacccgggaggcagaggttgcagtgagctgagatcgcaccactgcactccagcctgggcaacagagcaagactctatcacattaaaaaaaaaaaaaaagtatgaatatgaggcattgtaaatggttgcccaaagacattggcagggtcagcatggcattgtcatccctacatgccaagtgcaattgtccccactgaccatttcttcttatcctcaaagatcctgtctttattaagggtgaccagcaaaggaactgagctggaagagaccagcagggagaggttgcaatctccaaaagagctaccccaagcaacccaggaagctgctcaccacaggacagaaagacaagggaggtattcccaaagggctgctgggcatgcccagccaccccacaatgggtgggagagggtgggccagcaggtggaggattctcagcacagaaggaaaccagaagacttcagggaagctggaggaggccatgggagaggggagtggtgacctcatatatatgaggggagggaagcatgctcaggtagtgaggagagccgtggactctgggcacgggtcaccctgggtaccttgagcaagttacttcacctctctgaaactcagtttcctcatctgtaaaatgggctgatcatcccccatggtgtcattgcaaccattaaatgagataatgaaaatgatgaaatgctttatttatctgcactatcttatgtagtgtgtattaaatatctagcacatagtgaacacggcaaaagcaccttattattattgcaaaattttttaagttgcttcaatttgcttaccctttccacttggcttttcctcttttatctccctcatcaatcagcgctgtgctataaccccaaacctccctgcccaaggtgcctgtagagtcttccagcccagaacaacctaggggaggatgaggtggaggtgtggagtgtgtgtgtgtggtgtgtgtgttgggtttcctgtgagccatcagaacttgtatagaagtctgggtgggtatgtgcatgatgcattttctctgaggaaacagtcatagattctcaaagtagtgaccaaaacaaataaaggctaggatccacagaagtaaaatgttagatcttaatgcaatagtcctttctcggtctgaaaagaggtcttagcgagagggcaatgtttaacaccgagaaatggctctcacatgatggaatttcaggaatcaatgattgttggggagaaaggtttaggggtaggtaccataaatcgcaccctgccgtgtcactctaaaaatgacccagtttaaggaatagctttggatgacctctaaattggttcagaatgagggcctcttttgttactaaattatttttcctggccatagaaattttagacgttggcaaatcgcaataaatttctgatattaccatttcgctttttaagaaaaagtctttgaaatgacaacagagacttatctgaaatcttcaaacgtaaataattcagaattagtgcttgagctctgctcttaagctacaaggacacgtttctcgataatgggctttcagagcaaaggatatgtagctttgctattaagagtgactgaaaccctgccagggcaacatttacctaacttaattatcgccacttagccacatctctctcctcaatgcccggctaattcttgcaacctcaaatatcgtacattgaatttacacattctacatttcactattcttttaattgtggtaaaaagtatataataaaatttacccccttagctattttgagcgtacagtacagtaatattatcagtatgcacactgttgtgcagtaactctttagaacattttcaatttgcaaaactgaaattttatgcccattgaacaactcccctttcccctcccgctcccaccatggccaccaccattcattctactttctgtttctaacagtttgacttcttcagataccgcagataagtggaatcatgtagtatttatctttttgtgaccagcttatttcatttagtataatgtcctcaaggttcatctatgttgcagcatgcaacgggatcactttttttttcttaagactgagtaggccggttgtggtggctcatgcctgtaatcccagaattttgggaggccaaggcaggcgaatcacttgaggtcaggagttggagaccaggctggccaacatggtgaaacccatctctactaaaaatacaaaaattagctgggcgtggtgtcgtgtgcctgtaataccggctactcaggagtctgaggcagaagaatcacttgaacccgggaggtggaggttgcattgagctgagatcatgccacctcatgagactccatctcaaaaaaaaaaaaaagactgaataatacttcgttgtatgcatataccattttcactattttttaaaaacatccttgttgctctgctctgtgatttattttgttcagtgatgtttctcctagtataaaacgtgaagcttgccttatcatgtacattaaatttaccactcagaaacctttctaattgagtaaatggagaatttgtagacatgaaaatttaagatatatttctttcagaggttctgaaaacaagtcggtggacacagtggctcacgtctgtaatcccagcactttaggagacttaggtgggtggatcacctgaggtcaggaattaagaccagcctggtcaacatggtgaaagcctgtctccactgaaaatacaaaaattagccaggcgtggtggcgcatgcctgtagtcccagctacttaggaggctgtggcacgagaatcacttgaaccgaggaggcagaggttgcagtcagctgaatctcactagtgcactccagcccgggcgacagagggagactgtgtctcaaacaaaacaaaacaacaacagaaagaaaacaaaaaacaaaaagaaaaaaaaagaaaatttaacagatatttccccaagtttccaaatgatccattggaaatagggcaagtttataaaataattgataatctttcataatgtaagtgattttataaggcatttcatatcatctgtcttttaagcaatatgacaagaacaaaaataaaaatagaacctgttgaccttttcagttgacagctacagagctttttatttatggaaataaggttttcaagtaatgatgatattgaatcactttatgctcttaatggctttttatataactcctttgatcagatccgatttgcagaaggtgactattttcctctgaaattcttttttttttttttttttttgagacgaagtctcactctttcgcccaggccagactgcagtggcactatctcggctcactgcaagctccgcctcccgggttcctgccattctcctgcctcagcctcccgagtagctgggactacaggcgcccgccaccacgcccggctaattttttgtatttttagtagagacggggtttcaccatgttagccaggatggtctcgatctcctgacctcgtgatccgcccgcctcggcctcccaaggtgctgggattacaggcgtgagccaccgcgcccggcctaaaattcttaaacagaatataaaacaatgtaaacaaaaatgttacaaaacagaaataaaaacagcatttgtgttggattaccaagtgttcattttaccaagaggataatccctttacctaattgaaataaggaagaaacaaaggtgggtgtgaaccttttatggagagatcctggaagcatgaccttggccaaaacaactgatggctcagccaatctctggagatgagacctgcagaagtttcattatttgttgctgtcaaggtgaagctcaactccatcctgtggatgaagagtcaaactctgtagagtatttgaagagatttattctgagccaaatatgagtgaccatggcccatgacacagccccaggagatcttgagaacatgtgtccagcgttatcagagtacagcttgtttttatacattttaggttataggtgaattcgaagattttctgattggtagctggttgagtttatctaaagacctgaaatccgtaggaggaagtgtctgggttaagataaggggttgtaaagaccaaggttcttattatgcaggtgaagccttcaggtagcaggcttcagagagaatagattataaatgttcgttatccaacttacaaaggtgccagacgaccccgggagcgcagggagcgctcctgcaggagcatttcaaaataggccaaatgaatatattttggggtaaaatacttcgatttctctcagggcctgctgtcatgattcttattgctacaaagagtctgtactgtcagtcttaaggtctctgttttttgggtttttgttttttttttttattgagatggagtctctatcatccaggctggagtgcaatggtgccatctcggctcactgcaacctctgcctcccgggttcaagcaattctaatgcctcagcctgctgagtagctgcgattacagacataagccactacgcccagctaatttttgtagttttagtagagacagggtttcaccatgttggccaggttgtgccttaaggtctctgttttaatattaatgctggtcagctgtgcctgaattccaaagggaggaagttataaggaggcatgtcggctgggcgctttggatcacacctgtaatcccagtgctatgggaggccaaggtgggcagatcagttgatgtcaggagtttgaggccagcctggccagcatggtgaaaccccatctctattaaatatacaaaaaattagccgggcgtggtggctcatgcctgtagtcccagctacttgggaggccgagacatgagaattgcttgaacccaggaggcagaggttgcagtgggttgagattgtgccactgcactccagcctgggtgacagagtgcgacgccctctcaaaaaaaaaaaaaggagccatgtccaaccacccattccatcatggcctgaactagtgttttgtgtttacttgagaatgcccttggtcaagaggaagggtccatttgcttgcttgggaggggcctagaattttattgttggtttacattcctcagagctgattgccttccaaaaggttgcactctgaaattattatcaaccctgatcaataatcataatactaagaactacacgtatgctattggaatggatttatttatcagccctgtaggaaaatatatatctcacatcacctcattcccatttacccacttttcccttttccaatcttaaggctcgtgttgtctaaatattcgatagtttcagcacagtttacattttataaaagcccccactggctgctgtgcagagagcaggtgtgtgcccctgatctacagaaggtcaagttgatccaactatctggctggggcaggggagttggagaggggagtggggagatggggaggggaggggaagttgggggaggggaagcacattcaactgggatggagacaaaggagagaggcaggaggagggagaatgaagagctggggaaggagctttggaaaaatacaggaaagcaaaggatgcggcgacagaaggagaggatgaggagtcagtcagcaccacatggagagcaagaaggaagaaggggacaggaaatgcagaaacagagtggaaggacaaagaaactacaacatacagaggcctcgaataaaaatcaattcatctcaaagtgttcagcattttcatgaggctgtgagaccgaaataggaagaggccctttattttcttaggaagagaacacagaccggaggtgggagaggaatggtagggaattttccaaacaaagagagggcctgtggcctctcaaactgcccccaccccatgctcactgaagcgttcacactgcagccctgaactcttcacaaacagggtgaactccatccagagaggggggatccggaacccatgcttggtttccatcccagctggagggctggagaatgagactgcagagctagggttcaggccacagcctgggggacagggtaggcaggaggtcagcaaggcttagagaagatggatatgttgggttgggtgagaggcctggtgctgggagtgggttgtctacagagaagcacccccagggccttgtccaggatgatccttggccaggggggtcctgaggggactggcactgcacacctcagggatgcagtatcaggaaatctggggctccccagcttcctgctctggtcttcttctctggacacgctcatgttgccataaggagagacagaaacatcagcaaaatcagatcaatgcttccaactgtatccctaacccctccattccagccagatttggagatagtacagatacccccctccccaagtaaagtgtctcttgacaccttggggttcaggccacagcctgggtacagggtgggtaggaggtgagaaatgactccccttcttctcgatggaaagaaaaggccttggccaggggacagtgctcagggactctggccactccagtacctgcccctacagaggccagagaagggcagggccagcccctggtacagagcactgaaaggaggttccccctccaacttctgactggtgctggttgaaagactgaacaaactaacccactgagcttttttcctcactgcaaagtgggtcgaatgacagggcctgcttatgatgcatggaagggattcagtacttcctggggtttacaagagctcagagaatggcagcaaggcgagttagaaacatcctgggcacctgtttttaacaaattcattcactccttcattgcacacatggttattgagtgtctgctatgtatgtaacaagcactgtggatacatcattacacaagacagattctccatctccccagcagacatttccgtgtgtgtgtgtgtgtgtgtgtgtgtgtgtgtgtgtgtctgtgtgtgtgtggcggggagagggcacaatacagagtaaacaataaataaagttatataatatagcagagggaatttagtactaggaaggacataaagccaacgagggagataaggtggcgggggtggaattttaaatcagctggagcatatgtatgaaagtgggccgggcgcggtggctcacgcctgtaatcccagcactttgggaggctgaggcgggcggatcacctgaggtcaggaattgagaccagcctggccaacacggtgaaaccccgtctctactaaaaatacaaaaattagctgggcgtgatggcgtgcgcctgtagtcccagcttcttgagaggctgaggcagaagaactgcttgaactcgggaggcgggggttgcagtgagccgagatagtgccactgcactccagcctggcgacagagtgagactccgtctgaaagaaaagaggaaaggagaggaaaggagaagagaaaagaaaagagaaaagaaaaaaagaaaagaggccaagtgtttcccgtagagatactgtgtattgggggggcgcacaggggtgccacgaattgagctgcccactccttccagatgcagggttctcacccgggtaggtgagaacggggtgagggggaggaatcacgcgtgggtggctggattagttcctgatgtcctctgattccctacagcttcttcagccccgttctaacccccttcctcaggcttacaagaaagtgtgtggaagagagacacggagagactgagcattagacttttttggaagaaacatcagtaaatgaaaatggaattacaataaaaataacaaaagcaataaactcctgacctcagtcacaatcattttagttaacacgccagtcctaataacaaacacgagtccctgagaccgcaacccctcgggcaccgcagggcgtgcaggtctgggcgggcggcgcagcctcccctggcggctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtcagtcgccgcctgtacccccatatacatctgaagctggcttgagctttagggggcgctgaaaggaagaccccttcacagctttgggtgaccctcagtccctgtggaaggtccagggggtgatgagagagcgtgtctcatcatgggtcaggcttcgaggatctgtcgctcacccgagggacacaggggtcccccaggcgcggagactctttggaacttagtttggccggagacaaattggagttgattcccgggtgaactaggctccacggtgtttcagtgtgggtgtgacggtacctccctccttgggaagaggctgtgggacggataaaggcgtttatctttccctggagacgctcccggagtctgggagccaagcctggtgccatcccctcgtgtctccacctccccgctccagggccagtgccacgcctgccaggcttttcttaaggaacgtgaacccggcagagtggcgggagggtccctcagcccgagcctgggcaaaatcttccgcccccagcagagttccggagaggagctggaggctctgtggggcccgaacccacgggatgagggctggtgcctggaatgctggggacgcgctcaggcttccgggaaggcttatctcgcggagacatccttcaagggcttggagtaaaactttgtgaaagtagcaggttgcacaaacgaataatacccgcgtagtccctttatgatgggggaggagagtgtgtgcggaattggggtgggtgggggacttccctccgtgctgacattgggaaccgcttattttctggtgcacagcccgatgggtggcattgacctcactttggataaacgggctgcctatcctggctgagaccttggggcccatttggggaccgaggccctctaccccagtttctcgagggctcagcttcaaccatcaactcttcttggcctgctcccccagtggaatgaccaggacctgggtgaaagttctagattgcagcaggtagggagtaggggtagattgtccagggtgttaccttgctctcagggtgaaagatgccagaaaggaggtctgatgagaagcaacgtttagtctacagcagcacctcaatactttatgcctatctagtcgtcgctcattttccagcctccgtttccccatgtgagaaacgggaatgagcccatcctcattccttatttctgccacggactgttaggttggaagcatttggaaaacatcaaaatcttgtccccagattgatggacatcacacagataagcatatacgtatttgctggcagccgtgtgtggggagacttgtcctccaaggggtcctgtagaaggggaggtttagtctagcaggcttagtgttggattttagtggagagtctcttgccctgtagcagtttcccgggtagaggcagatgggaggtgatggtggggaggataagcttcagtagatggttggttggtttacctcctaacagcaagagtcctggcatgaagagtctacatggcttccttctgatgggcgtctaccctggggggtgtgttgtggggagggggttgctttatgatttcccttgaggaaacaattcctctagagaacaagtttttgtttagtttgttccagggctttgtttagagggggaagagggcaggcaaggatgataaagccttgagctgccctcgaagtgtttccctctaagctgttgctccaacactgcaggggaaggaaggaaagaattcaaggctaaatgtgggaaaataaacttcaaaacacaaggcaaagggaaaggctggcggggcatacggcggggggggcggggtccaggggttaggcagccgggtgcagctggtggtcatagctttggaggctagacggcttcttaaggtatttgaacaaacaaaatgcctcttatttagcagtcctgttaaatctgtcaacatttacccccctaccaaaaaaaagtaatgggcaggtaatttttagaaaaaggacttgggcatcaagccagtctgctttggaggctattatagataagttcttgaacaaggacagccctgtcctcatccccggccaaagaaactcccaaaccaaccccaactgggcgagtcccttcccgtcataggaaaaaccccaagaaatgaaaatggacaagtagaagcatttgctggcatcagttttaatctgcagaaatctgccttgctctgctttcttgtgacttggggtactgcctcaggcctcaggatattggtttaaggaaaaatgaaaactcaaaaatcttctttcccatctggctgcttgggcattttccacctgacgctctgtgttttagctggttctcaatcaccttggaatcatgaaggagcccctagctaggaattcctggggtacaaccaggggtgggacaaagattgttggaagagatggggtgcagtctgagttggggtttctcttaccctgaaagttgtgtgtgctctttcaaatgtgtgagaaagggagttaagtcaactttctttagaaataccccccgaattgtcagatacttccttccctccgctgtggttgaagtgaggtgcaggctgactttcaagtgctcagtgacccgccagcctgggaccacgtgatcgtcctctttcctgtcttcagaaccatcttgaacccttgctctcaagcaagatctttggtgactcattctcccaacctcttcctaaattgcagactcacacaagggaagttaacatttacagcacacctactctgtgttgggcattgtgggtgctattatcctcattttatgagagagggcacaggctggttttgccatctggctcggccatttacccatcaagccatgtaacttaactttgccttcctttcctcatctgcaaaatgagtgtttggtgaggctccaatagagtagaaacattaggcaagatgtctataaaaagtgaacaggtctcctgaccttagcatttattgaggaaggcagctttacctacctgccttatttcaggtactctttacagtatgtattcaagtaagcaagctgaagcccagagaagatacaatggccacagggacaccacaggaggcacagcctatggggcgggacggggaggggcaatgaccaggcagtctgccccaggagcttgcacctccctcttgggcctgtgaagattgttgctctgtaactgagcttaggaaattggttcagctggaccctgatctgctggaaaattctattttctatttcccctagcacaggtaatggcatacaggcgtctcctgtgttgttgcctggctgacccagcacctctgttactgaagtaatacatcagtccacccctctgcgcttctcattttggaagtccccaacccctgtcccaccaaaaacagtgggggtgtgattgaaggggaggaaggacagcccttctcaaccttctgcctctggtgggcagtgatcagaaacaggaaggatttgagagcccaccgtgcaccagaccactttgaataagcactttatatacattcttattttaatttaatcttgcaggccacctcataaatgaggaaaattaggggaaaagccagtgtaacttgtctgggatcacatagagcggagtcagttttcacatctaagtttcatgtttcaaagtacatggaaattagcaagcatttattaagtatccaccatgtgccagacactgggcaagactctcaggatacaaagaattaggctacgctccgagctgctggagaaaaggatacataaacccactgggaacaagacagtgggtgtgggctacagaagaggttttcaggaggtcgcttaacgagggtctggtccagcctgaggggtcagggagggctctcaggagatgacctcaagccagagtggggtcttggattagaaagaacagctgggaacctgggaggtcaaagctgcagttagcctggattgcgccactgcactccagcctgggcaacagagcaagagcttgtctcaaaaaaagaaaaaaaagattaaagaaaaaaaaaaacctaactggtaaaggaagggagaagagactcctaacagaagatggagagtggccctttctcctagcctggggaaggcagactgcaggtttcttgctgtggctctagagagtcccttgtctcctgagggtggagcagggttgccctaggtcctgccctctgtctagcatcccagaccaaagtccaggttttgcttgactgctcatatagctgacctgttcccggaagcctcttggatcccactggcctccttccttcctaagctccaaagtgctttcttgtgttctaaggttttccatatgtacctcctttcattttctggaccctttggactggtctatacacactccagtccaaagtagtaaggctagttccaattttgaggttctggcactcttttaacaccaatcctgctccccagatttgaaaaataaaaccatgaaatatatgacaaaattacatgtggccaaaatgcttagaatggggtacattgaattttttggaaagttgagggttaatataaacaccctctttgtctcaggccttgttggaaattgtgaaatgcactggtccacttaaccgcctttgtaagtaaaaggaacacaatagctcttttggttatggaggatcttggaggcctccacagccttgggtccgagcttgagttcttactggctaggactgcagaagtggaaagtggataagctggttttttgagaggaaattgaagaggtcccttcctaatggcttgtttcttatttatgttccacttaaaagttgagggtagccaaaaaaaaaaaaaaaagccttagtctgccttagttaactgctctggttagagttttttaacagtgaaagtaaatgtttattacattgctttgagtgttttactagaacccttaggatgattacagatggcacagtaatagagaattattgagggtagaaattagcaagtgttgaaagtttccagtgggggtgggggatgcaaaggaggtgatgattgttgcttttaaatattttcctggggttttgccctatttatagtctggcgtttagaagaaacaaaatcccccggttttggatgctgtgcttggctggtcctgacctcgggccaaaggctttcatcttgaacttggctgtttgctggcagattgggctcagcctctgaactgtgtgtgtggttggtggtggtgggaggagggagagaagtgcaaggttttggggagcagaggagccaggcccctgagtggagcctccaagacagtctttgtccaaattggaatgctgtatttgcatggtgctgcaagaaccagttggccagaactggggtggtacagagaagtgaggtaggagaccataggaaagcacatgaaataggtttgcctccttccaatattccttgtagggagtggagaagatggaagcgaatctctttgagatttcattgagtccccagggacctctggaataacgcagaggaacccttgcctgttcagttcttcccaagtatggctgtacatagagagaggatgtgctgccctcagtagggatctttgtccagctgccactgcggggccttggtggtgttgctgaaggaatcaccaaccaagcagtatgtctgatggttgtgggagtggcctctgaagccacaccatagtttgcttagaatagtgtatggcacatcgtaaatgctcactaagtgttagctgccatttctgctacgcccagatattcctatgctgcaatggagcggtccctgcacaggtgtggtgggaatctaattggtattacaaagaatcaggaaggtcttcctagaacagagagaacgtcaactgaattttttaaacgcaaaaaacacagaaacatataatttaccattttagccacgtttaaaagcccagctcagtagtgttaagtatatttaccattatgaaacagatctccagagctttttcattttgcaaaactgaaattatacccccttcaacaacaattcttctccctctctacccagcccctgggaaccaccattctcctttctgtttctgtgaacttaactactttagatgtctcctaagtggagtcatatagtatttcttttgctttgtacagtggtacaaccactgtgaaaaatagtatggagtttcctcaattaaaaatagaactactgagtgatgcagtgctcctacttctgggtgtgtatcaaccaaacttctaaagaactagaaaagggatggggatggtggctgtctcttgcccatagcccttggggaggtgttctgcaggatggacccaacaggctgtagccacaggccagggaggtgagagtcacatgactaagctcttctgggttgccaaggaatttgaactccatcaattttttgcaattttcaagtaggggagggaacaacatttcagaaagtttcctccacagccatttacagcttaaaagaagtggaacattctactctaaaataacgacatttctgtgggctgatcccttcactctgtgggtgttctgataaggacaccccctccttcctttctcctgctgatgtgatgtagtgtgggttttcccagaaagctcatattgcctacagcccccagaaaaacccactgaccttcacactctagttcttttcctactacgagccccttaggtccaggtctgggtccctggcccagccaaagacattccgtctcccgtttggtgaccttcccagattgcatcttcgctatccctttatgtagaagtgggggtggtgtgctccagttgtagctctgttcagctgcctaaggcctctaggcttctggtgagcagttatcccaatctctgaacctcagagacctggatacagtggagttggaaacacagaacgggccctccctactggctatcctttctgtgcttgatgaaacctcagatattggagagtctttaaccctctggagatcagtgcagctgaggaaagataattgggccgcagtggtgaaatgagaggaaatacagtccaaagtgctcagtggtgggttgtagatggaagaggctggagagatgggcaaatgttgaaggggctggggggattcattttctgttttctgaggcctgtagccaaactccttggcctgtggaagacctggctccaaacaaaacacagcccctgccctcagggggcccctaacctggaggaagaatagtaaggagctgctaccagattgatgttggtaagtgcacctggggactccaggtgtgcaccagggcgagagatgaatttttacttctgcacttagaagaaggcaggcttggagggtgagtggcatgggcagtagccctgtgagcattctgtggagtgcctaccaggtgccagacattgggctgggatgttacctgtgtctccttgaaccagttttgtgggctaggtattgctattcccattggacaggaaaccagaggccaggtgacttgcctaggtctacactgttggatagaggactgagattgaatccctcttgttgacttggaagcttcggtcttgtccataagtggaggtggagtcgggggctgggagtgacaggcttgggcaaccaatagttacaagcacttacttggccacaggctgtgggggccacaggctgtgggagccactgatgtgcatcatctcactgaatcatggcagccaccctctgcagtaaattctgtgatcagctcgacctcacagtagaagcaacagaatggaccatagagattgaataacttgtctgaggctatgtagctaggaagtggaaggatgaggttttgaacccagagctcacactgtgaactattctcttctatgtgaggctaccttgaaggtggggcaaagcagggagcaaagcatagaggcgagaaagtgcagggcatatgtggtgtcctcagagtcttagggtgcatggggctaagagttcaggatactgagctgtgtgacttcattgagctagtcatctcatctgcaaaatgggataatagtacggtatgtccgtcatgcccatagggtctatgttaacatgttagtgtgtttggcacatgtaacaggtgactggctacgtattaactgctgttcctgtacccagttcctctgtgtactctgtccctgacaccaccctgcaggacccatcatgcagtgagctcctaatctggagatggggacaagggaacatgataaaacccatcaagtttctcctactggagtcagtcacccactgttttctgtgtcctgcaaattaaccacctaaaacagttgatggtcaacacctaaaaatagggacggtttccttctttctctcttctagcagggctctgctcagtcctggcttgtcccaggccttggttaaaaattttctggagaattcctgcgtccagatggtctcatgggtattctcctgggatgatggttacccagggtctgggatcagagctgggccctcactcgaggcagacaccacccacctcccctctcatctttgattggctttgaaatgtgcattctttttcctctcctccatctaaatatttgggtttcctgctgaaatatttaggcagggctgtgtacttctggctgttgtcacctcccgtgccccactgtaatctggctgcagctgcttagctgggcccctgctatgagcggggatgcttgccccctgagtctgggagagaagctgtgcagctggtagcaggaccccctttgttcaacggtgtagtctccagtcctgcagggctgccaggggccttgttggccacattgggtggggaggacacagcagagcccccttccatttgtctgagtgcttctgtgcttggggctagggatgaggaaccctcatctgaactactgtgtagcagaaaactgattctaacctgtgttctacttttacctgtactccggtttatgctgtgtgcccctggccatattttccctctctggactcgtccattcattcagaaaggcttggagtgctagttaggtccagctagaccatttgcaaccttcgtgggcagtggccatgtcttcccagccctgggcctgtgttgccaggcctagctctcaggatgctcagtgagtgtgtggatttcagtcttgctcagtttgttgtgtccgtctgcccagcactgtgctcagctcagggggatgccaaaagctgtgtggcccttttggttggaagtctagtcagtgcagccaagcctcttgcaaggtcacagcagagtgaatgaagccaggtgccccaggcccagactctggtccttggtctcacaggctctaagtcatggaaggggtaggggtgccattattttatttttattattattattttttgaaacagagtctcactctgttgcccaggctggagtggaacctggttaaggacaggtattcaagtcacacctgggatttaataccacctctctgcctttacaaattgtgaggccttgagcacattgcatcatctgaaaatggaactgattatacccccctcgcaagaggaaatgcctgtaaagctcactcagtgcagcttccagctcgaggcagccttcaagaccagcttattgttatcctctcccctttgagggagggactttacagaataaactgctctccctgcctgagtctgtttatctccaggagccccctcttcttcttcccctatcccccatcccttgttccatcaacttttcccgaattcctttcccctgtgaaataacgcccaggcagcagaggtcagcaagagtacactgagcaggtctgcccttggtgctggagggcagccgtggtttttgctttcaaggaacttgagacagagcaaaccatccagctcctcattcagcagatattttactaagcacatactgtgtgtccagacctgttcaaggactgctgcaagagaatcagccctggtccctgcctctctgtggaaaccaagagggcaagttggacgagctggggcaggagaaaaacatccccttgacccttccttgtgaagacttctttaattttcagaggcttctgagaagtgcagttggcggggaggcccacactgtttgcagtggagaagggcagttccctagctgggggcacctttggcatgactggagcctgcaccactccagggggaaggagcagaagtatttgcagggtgttgccagcagcaccaggtacaccacccagtcctctaagaggcttgcagctacacagactgtgctcgtgtgcatcccaacctgcccttaccatgggtctctgcggacccattcttctgagacctcccttctatgacttttgtgggcctgactctgggaggtctggcagccaaatggatgccatcccattcactagatggggacaccaaggcctggtgaggattagctgggggcagaacagtctctagaaccaagttcagattactctaacaacacggcctacccagatccaggcctttcttctctgggtcattctcactttatttctaatcccttttaaaatggcccataggctgggcgtggtggctcatgcttataatcccaccacttcgggaggcctaggcgggtggatcacaaggtcaggagttcaagaccagcctggccaacacagtgaaaccctctctctactaaaaatacaaaaattagctggacgtggtggtgggcacctgtactcccagctactcaggaggctgaggcaggagaatcgcttgaacctgggaggcggaggtggcagtgagccaaaatcgcgcctctacactccagcttgggtgacaaagctagactccatctcaaaaaaaaaaaaaaaaaaggcctgtaagtcaaaaaagctcttgatggtattttggggtgcagactccttctacttacactaaactgacctacctgatttcctaacctgccccaacacacccgttcctgtgatcttgagcaccagcttctcctcccactagttttccagataagaggcaaaagttgaaattgtgttgaaccccaggctgggaaaggaggatgtttttctgggccagccagggcctcaggcagaaaggatctgatgcctccctgctccccagggagtctctccagccctggactttgctcctcctgcgtctgcgcccaaggagctgttggctggtttctccagcctgtcttggaggttggcagggggtggctcacgctctgggcatttctcgtggcggcaaatcataaaatgtgaggctggagggagcttagtggttatttaactggcctccagcctcctgagtcaaggcccagacctttggaggttatgtaacttgcccaaggttactctgctcaccaggggtgggggaagtacaataaaagagcaattagagctaagtgggggcaattagggaaggcttcttggaagcagtgccccaaagaagagatgagctgaaaggggattgccacgtgtcctagtagggctcccatcagatcactgctccagcagtcaaggatcctgacagtgagatcgtgatctcaaaactcagaagacccgccagcatctcctcctttgcccttagactaagccaaagccctggctgtggccctgagtgatttggactctgctgcttgtgtgatctcgcctttctggacccctgccgttgatcccagtcagccacactacagacaggaaactccaggggccagctcctaacagaggagaggcattccacacccctgcacactaatagccagtttctttttcttttctttctttttttttttttttttttttttgatggagttttgctcttgttgcccaggctggagagcaatggcatgatctcggctcactgcaacctccgcctcccggattcaagcgattctcccacctcagcctccgagtagctgggattacaggcatgtgccaccacacccagctaagtttgtatttttagtagagacggggtttctccatgttggtcaggcggttctcgaactcttgacctcaggtgatctgcccgcctcagcctcccaaagtgctgggattaggggtgtgagccaccaccgcgcccggcagtgagtttcaacttttacaaagaactcaacgttcgtatccactgatgacagaaaggactttgggaggtggtagcaaggatagtcacaccagccccgcatgacagccgtaacgggagctgccgtggcctacatcatgtcgacttcccaacaatgataagtgacaggcactgtggggaacctaattttgcaaggcaactgaggcagagggtaagtaacttagtggaggtcacatagctagttagtggcctgaacccaggccctctgagtccagagccagagctctgcagttgcagtagaggctgccgtatcctaaattgctgccagtctttcgaatcttgctaggctacaagctgctccttgagactgggttttccacacacaccccatcactcccagcacccaagaagtgccccgtgcgcgtgttagctggcccctttgctgcccagctctgcactgttcagtcttccaggttctgacaccaaagtactgctgttttctgaccacattgaccatatatagtttttttgtttttgttttgtttagttttgttttgagatggagtctcactctgtcgcccaggctggggtgcagtggtacgatctcagctcactgcaacctccacctcccaggttcaagcgattctccagtctcagcctcctgagtagctgggattacaggcatgcaccaccacaccctgcaaatttttttgtatttttagtagagacagggtttcgccatgttagccaggccggtctccaactcctgacctcaggtgatctgcccgccttggcctcccaaggtactgggattacaggcgtgagccaccacgcccggccccatatatagttttgtttgacattttggctatataagtggctgccacagctcagaggtggggttgttaactcaatccccagcccctccccctacgactatcctgacagccctaagaggcccctgacttttgtttactgcttctaacgcctgctgcttgacaggtttgtggtcaggggaccctgagactaaaacccccaaggaggaatcacgtaagggagatagaattgcctcttagctgtgtttctgtctgacctgccagtcagctaaacccatgctgtgtcacatccactcatttggtttccctagggttaacctctagctggactgtggtctgcaccttgggagggtatcgctttagtcttgcccacatggcttggaacaggttattctgtagcatgccaaggacctcagggcggggccctttatggatgtttattttggcttgggtaccctttgtgtctaatgcaaggttcctgctcctctcatgcccccagtgcgggatggaggtaggcacctattcacagactctctggaggagaaagacgtccatcccctaccttccctatcactcctgttcaaataaaattctcacctcccgggcagtggaatgcatcctgacagtgttagctttggaagggtgcccttctcttctcagcatccctgcccccttcagagcagcgagtggaagggctgcctctcgccaaggggataagtgctgagtgggcgaagtggggtgagccgaggcagtagtgtcttgtcagcaccccccgggttagcaggaaaagggagggtgtcctgattaacagcttttcaacacctcacctcccccatcttccagactctagcctcagccctgcaatccacccaaatgcatggcccagagagttggactcacccacagttgggagactagaagacagctgagtcctgggccagctctgctgacttgctgtgtgtttaggccaggtcactgcacctctctgagctaagcacttgttcaataaggccaattaaacacttagtgcccgctgtatgcccagtgctggattaagggttgtgggaatgaagtactggacatcatttctgcctttggggttggtgggaaggtatcaccatgcaatgcatattatgaattgagtggggttggggcatattgtgagggcctgtgtgcttcaaggtagaaaagttcctgtaggcttgggctgtttaggtggctcccctgaccctggcctgggggttgcctcctttctagctgcattgctctctaggctcccctgccccgtgtcagaggacattgcacggggactattgcctggtctgcacccttctctgccctccctccctacaagccctcggtttttacctgattggatccgaaacctagcaccaagcatgagggtaattattaatgaatgtcctgaaccatgaagccgtgtttctctctctcctttgtcctgtctcccaacagcccccaagcccagaggcagcaccaacagagccctcctctgcccctcagctgggcccacctcctgggaaacaatctggaaaactgtcactagcccctgcagtgggtgtcctgccgggccagattctcccccaagccagcagatgtgctggtgctgaccatacccctctgcccgtcatccatgcagtgccctcctagctggggacactctgctctgtttggacaggtcagtaggttgcctggtgaaagcatgtgtcagcatcactctgggagcatgtctatctaaacccagggcaggctcccacagccgaggcaggtacttttgggtcctgttctagaaggttcctgtcaccaccaaccacactggaaattcagagttcacagaactcagttttggcacagcctctctttttggaatgctctgagactgagagctgctgcatatggtcaaaccctccatctccacctacccaccgttggggttattgtgtacacatctttttttttttgagacagagtctcacaccatcacccgggctggagtgcagtggtgcgatctcggctcactgcaacctccacctcctgggttcacgcaattctcctgcctcagtctcctgagtagctgggattacaggcccacaccaccacacccggctaattttttgtgtttttagtagaaacggggtttcactatgttggccaggctggtctggaaaatggggtttcactatgttgaccagactggtctggaacttctaacctcatgatccgcccacctcagcctcccaaaatgctgggattataggtgtgagccaccacacccagcctgtgtacacatcttaaaattttccctagactctaagctgcctgaggccggcttcccacccgtgtatacacattcttacacccctcttccccactgctctgcacacaatttaatctgtgcttattgaactggtgggctctggcctgtggcatgggagacccttagacaggctggaatagggacctggtgcttccatttggtgtttctcaaagtgggcctgaggcatgaaccagacttcaagttatacaaaatcaagatgaggagggtgaggaaagcaggaagatgcaagttaaagtgtgtggttctctccgttaatattgcgtcatagaaactcaatttaaaaacagaagccaggcagggccgagttggggagacaggattattgatgactttttctttctctgcctctcacattttctgtaatgtggttgtattgcttttataacaaataactcaattttttaagggataaaatacatgcatgtaccattacccacttccacactggttatttttaatgtgtgaggtatacaaacatctggttttagcagaacatactctgaaaaccagtatcacttttgtaatcactaacagtgtatagttgacccttcgtatctgtgggctccaaaggactgactgtgggacttgagcactgcagatctgggtatccacagggggtcttggaaccaatccccctccaaggataccaacctggattggttcccggggactgtattgaacacctgactgggagatgctctggtcctagttcattcatgtctttcgagcctagttcgttcttgtcttttgagtctttaaatttagctagcagactgctagcttccttggcagcagtgctgtggaatgctttgaggagaaggacaagagaaactaggtgagcctttggtctgcagaccaagttggaggtagtataccaggacagagagtcaccaagaagagagtgtggcagggccagggacacccatccggctgtttccagtgttgatccatttcccacacaaaggtggtgggggtgtggtctgggaggggagtcctgcagaggcccatggacaagtgcagccttggacccactgtgctctcagctccacccggtcccgtgggggcccaagacttgccctgtccttcagatgaacgaaaaacacaagcacaggcaagacttgaaacagcacaggactgtttgtaatccaaagtcaggaatgtgctatggacagtggcccatggcatgggtcatcctgagggtccaggggaggcaggctctgccaaaggaggctgcaggtaggatgtgcttgatacagtcttggtactagtatggtagtcactacccacatgccgctatgcaattttacctttttgacttgatattactaatcattacgcctgcttacttatttattttttgagacagaatctctctctgtcacccaggctggagtgcagtggtgccatcttggcacactgctacctctgcttcctgggttcaagccattatcctgcctcaagcctcctgagtagctgggattacaggcatgcacgaccacacctggctaatttttgtatgttttgtagagacggggtttcaccatgttggctaggctggtcttgaactcctgacttccaagtgatctgcctacctcagcctcccaaagtgctgggattacaggcctgagccgccgtgcctggcctgcctgcttaatttaattttttcttttctttttttctttttgagacagagttttgctcttgttgtccaggctggaatgcaatggtacgatctcagctcactgcaacctccgtctcctgggttcaagagattctcttgcctcaacctccagagtagctgggactataggcattcaccaccatgcccagctaatttttgtatttttagtagagacggggtttcaccatgttggtcaggctggtcttgaactcctgacctcatgtgatctacccacgttggcctcccaaagtgctgggattataggcatgagccaccgcacccagcctgcctgcttaatttaaaattaaaactaataaaattcaattttagttctccagtcactggctacatttctagtgctccgtagccagtggggactgcgcaaatacagagcatttccatcatcggagagttctcttgggcagtactagagtattgggccagaacccgaggtttctaatgccacatctggcctccctctgcgcctcgtcagctttcatttctgctctggtcctatccactggaaaacttgtaagcacagccgaggcgagcgcaccccctggaccagctgacagaaagcatgtgtttgtgcaagccgtgtgattgccttgccaggtcagtcctcgtggactcagattgttcagcagtggctcccttggaggtggaccaggctgtagaaagagaatcctttttcattgatctctgacttgttgctcatagtctccagattccttctaatggcctgctccagcccagcctccccactctgcggggaagcaccaagtatccctcagctcttatggttcataatgtacactgatcaggtgattttaccagctaagcaggtatttctcttcttagggtgaaaactatcttcccaccacaaatctagaaggaatggaagaaggggacggctaaaattttcagttttccaggtttttttagggcccatggtgggggtcccgggccaggaaaggtggagtaggggaaggggaggaggggcgggcactgtttttaggatgggtggaacacctgactgggaaattgctctggtccttgttcattcatgtcttttgagcctcagttccccatctgtgttttggcttcttgctctgcttcatgctccattgcttgggcttgaaggagcatggagtgagcccctgggactgtcctggcctcgctgttggtttgttggctgctttctctgccatcttctgctgtcatgtccctctttcccgactcctgcctgtctcttgttaaactatgagatcctcctgagcagggtctgtgtcttgcacttcctttattttgcccagtgcctgggcacatggttggtgttcagcaaacacttgatgaatcagtcgaccctggtttgagcttcattgagcaacagaagtttgtccatgactctggccccatcgttgttgggttaataggttgggtgggttgccctgtgcatgggtcggggagctggtgcctggctagatctggcatttatagcaggtgtgcccagctacatttttgtgcctccaaagaggggcatggcccaggggtccctagggggagtgaaggtgacgagaaccccctgttctaccaccttgccctcctgttcccctactcttcctgggaagtagccaggagcctaattttacacatggggagagggccaagggactgtgtcctggcagtccactgcttggtcagttgtttagctctcagcagcccgggatgaagggctctgcttcagcaggcttgaggggagacggacctccctgggcaagtctgacaagtggctgcccctgttaccactcactgaaaacagttcacagggggacaggatgcagctgtgtgaggcatagggcctgctcccctgcctgacttagaaacctgacacattactttcccttctttcattatatcctcccggccacatacaaagcactcttaccccacaaccctggacgtttgtaaacaagttcatgcatcgggagcatctctaacttgcctatgcaccagccttcctgctctctatcgagccttttgatccataaccttgagaattgatgaggaggtggcatcgttcccgttttacaggtgaagaaagcgcagtcatgactccaggctagggagtagccaatgctatacaggctcatctgtcaaatgttctttcactccaccaggaaggctgaggccttgccagagcctggttgggtgttaggggttaaacaggcttggaaacgtctgtgcttaaaatcccagcccttgtggaggagagaaaggatgtgtgtgtgtctgaggcatggccctcgttccttctgcctctcgcatttcacaatggggctatgtctcagagtgaagaatttccatttcctgttgcctggcctctcatcctgggccccaggttaggggagttggaggtttttccaacccccaccccatccctcacctcagcctagcctctctgtactaggagggcctggcagtatttttccataccttcagcacaaaatggctctgtttcttaatcccagtcacgtcccacgccccagttggctggggatggatggtgggcgggggcaatgcatacagggcagaagaggcaggacagctgtgcctggctggcctgtctgcttcctggcatacctggatggtgagggcaggggtagtgcatggtcaggggatagcagccacatgtataggctccctcttctttcctacactatttggggatcgtctttgaattgcaaccctgtggtttccaaatgggggccttggtgaccagagcccctggggtaactgatgtgtggcctgagatctgagtcagggagcctgaactttagggtaatactcctaaatactccttttgcttttttttttgagactgaatctctctctgtcacccaggctggagtacagtggtgtgatctcagctcactgcaacctccatctcccgggttccagcacttctccctgcttcagcctcctgagtagctgggaccacaggcatgcaccaccatgcccagctaatttttgcatttttagtagagatggggtttcaccatgttggtcaggctggtctcaaactcctgacctcagatgatctgccagtttcggcctcccaaagtgctgggattataggcatgagccactgtgcccagcctccttttgcatcttgcccagtgattttgaggttgttgggcatcgagatcttgctcttgtctctaattgtgactcagtcttctggtggggtttgcgttcaggatctgggggtcatcatggcagaaagccccctccccccctgcacagaatgccatccatcccaagatgtctgtgctggtttgctggtagtttcttatacaatttattccagagaggatggaggccagctgttgtctgtctcagacgcagactgaaccaaaggaaatgggcttggactgcagccggagggatttaggttagagtcagacaataaggaaggatttcgggacaggtggttggctctcaggaggatcctgcagggggctttgagaagaaagatgggggcaagatcatgctcagaggccgtgggtggatgagaaaaccagctccttgaatgagctccctgggggcccggtttgggtgggaaggggaatgttgtgtattaagcaggcagggagcttacttcataggggtagagaaacccagtggccccacccctggtacaggattaatcccatcctggttcctcataggcttttcttttttaattaatgaagaggtttacagtttaaccacttgataatcttaaacaaactgtaataaatgggtaggcttaataatctcttatcagaacctcagccctcaaggatggcagttacttattaccctaagctgccagccacaggcacagggggagagggaggagggaagagcaggtgaggaggcccctgggttggggaatttgctaggttgtcaggggcattctgagaggcaagaggtagggtagtgtcagccccaactgtgttcaaggatacaggtgtaacctagagagacaaatgtggcacaagggtcaggagccagcttcctcccagggaggtaggagtctggcggtattggcggtggtgagacttgtccttagagcccccggcaagggggcccagggcaggcagatgtgtccaggagaacaggactggcagccacaaggactaaagagcctcatggatcagagcatccttccttcccactgctggaagggcaggaaatcagcagcaatgcatggggagagctggggccatcaggccttcaaacaccctggtatccctcagctcctaccccccacccccgccacccacctgcctgcttcctctggaatcctgatggttccagagtccgcaggggaactgactcaccagggctagaacctctgggggctttgggcttgcaaacaggtagggtagggaggagaccccggggcctggaaacagtcatcaacccgcactgtgcctgcacctgtctgggctccctgccttctccagtggagctagagcccaccgtccagccttggaaggcacacgtcttggagactcagtcattcattggcaaatacttgagcacatactagagctaggttctgttctgtgattaagggatccatgagtctctccttgtagggctcatgatctatttagggtagataactaggaagccagagaaacagatgcctagtagaatgtcaggtagtgatgagtgcagtgaggtgaggagcgggagcgggacggaggcttaatattccaggtggcatggcctctttcaggaggggacattcaggtgaaacctgattgaagtaagagtgagctgcaggaaggcacctgcaaaggcacaggggggtgaactgctgagccggagggactggcccatgcccaggaggtggtaaatggaaggagggcattgctgtcaacacctagcccagctccccagctctggaggccacatgcagcagacacagaccctcagaatggaggtgtcctccccaagccccttgttctattcacagagcaataatagtcacatttattttccttcccagtgctcgtttctggaacacgccccatgtgcccagcactgagctgttcatcatttttttgtaatcgacgcgccaacacagtgaagccatgactcttgttttccagatacggagtgttaagctcagagaggtgataagacatgccccaggtaacccgctagtggatgctggagtcaggattttgaacccagatgtggcctttcccctctgccctctcccctgtgctgctcagagagggccccacacttgatatttgtgttggagagactggccagcccagcttgtgtgccagtgcagagctgggtttgggaggacaggaagcaggccagcacgcgaggggcagctgggcggcccgggaactgcacctccctcaggtcattggcccgggatgggaaggtgatgagtcagcagttcccacagccacctttctggcctgctccaaggactgtttttagaaaccttgagtggctggtggcttcctgtagctgatccttgaccccaccccaaggtcaaggtaaatctgaggcatctgcaggggaatggggtagggagcgtaggcacgcgcttaccctaactcatatagtcaggtcagatccgtgggtatgaccgcacagcacagccctttatctctgctatgtcaccagtgtctacctgcacattccctgctgtgctttggttggtgtttctcagcccagttccgggtggcaagtggagggctggttgttctgtggacagggcctcacctgctctgctgggtcaccagcttgctgtttggcttcaccatctttctgtttggcttcaccatctttctagcctctctatagattcctcatctacagaatgggaatagtgtatccattttgtctggtttcccttcagggtcttaggtctcagattagacggtggaagaggagttatgggtgtgagaggtgcttgatgaatgtggggttttggtggggaaatgctaactcaggcccttattaaccaagtcggggaggaatgagccaggcctgagagcactgctggcttccctggaaaggacaatgtgccaggggcccaatccaagtgcaggggcttgggctagagctctctaaccccaccttagaagtaaggcctcttcctagtgacccacagccttatggaggaatggaggaggctgctctgcccagctggacaggctcaagggatcccagctaaaactgtttcctgtccctactgacactgttgtcccactaattgggagacaccccttggcatcgctcagggcagagaggtgtcagacacccctgggatctgaactctgggggcagagaaggggacaaagtcacaaatccaggcctcagtgtcccagatagggcagagacaccagcacaggaccatggacctgggccatagccaccctgggcagggcagtggttgtgaattggggtagagaagctataggtaaatgaaggatgtccctcttgtcatttaagcctccctggacacatcccaccttccctgagaagatgaggcaggggtagattttgagagcatggcctcagagggtcatctggtatgtgtgtttgagagggagggggctctttcctgctccccaggcccacttctcaggcacacagcagtgctgtgggaccaggaaggggccctcgaggtcccctgtgtctgcccgcacagggatttccagtgtcagtcactgaccagctcagccctccaggtgcctgagagctcacgctgacattccatcctgagcttgggccccaccagcccttcactgcttgccttagccaaacctgcaacctcaggtcagctctgccctgggcttgttctcacaggagggatgcccagctgcccccctgccctgggggattaccgtcccagcctgagaacaatgcgggcagggtcacctgccttgttttctttgttcctcccagtgaggacagggctcccaggcctgtgaaagtcagaagcccagggtttctgctgaaaacctgctcccatctggcaggggcttgccctcctgagcgtgagacctagcagtgcctctgggctctgcagagactgctgagagatggcccaggagggcaggctgggggaagcccaaaggtggacaagaggacagttctgcctgtgtgcatgcacagcctgccccgtgctaatgtcaggggtggggctgcgctcaagtccctaatgagggagaatggattggatctagggcagtgcgtttgaaacttggctgaacataagattagaatcacctgggggagctttgcagcatcctggttcgcagttcaagccccagactatttctcttggcatctctaggggcaggacccgggcaggagtatttttccaagctctctcagatgatctcagtttgtagtccaggttaagaagtagtatggtgactgatgagctaagtcctgaggatagaaatgcattttcttgaatgtgctatggagaggaggtaggggaggtatcacctgcccaggcagggggactccagtagtcatagtccaacctcctcattgtacagagaagcaggcaggcaaagcaatcaaagattcttcgaggatctcaagacagtactggcagagctgagctgagcctgggtttttaggccctgcgccgacgtcctagcacaccaaagcctccagccattgatttggcctgcctgccttcttctcaaatgtgatccatactccagatagatatcagagcaaatctgagaaaagagataagcaaccacaagttaacaaagtccgctttgcaacagcccagctctggtcttcgaggagacgggtgtggccctgctgcctttcgtccagtatctgctccttccctgggagagacaaagctcaggcgagctgggttggctgctggtgcaggtatcagggtggcaccactgggcccttgccaataccttgctcgtaaactacagctgccctccgagccacaccctggtcacctgacccggggggagaggcagtgaggaaaataccaagaattccttctctctgccctgcatactcctttttagacaggaagatggagaaggcctgagcctccctccccctgtcagcttccactagggcagcccctgcatattagaatcacttctggagctttttaaaagttgtgccaggtcaacagaatatctgcagttggggaccaggcatagcatttatttaacctccaaggggatctactgggcagcctgtaccgagagccactgcccattgtcttgcttcatgttcacgctgggtgggggctgggagggagttggactagagttcagagaagctgccatctaacacctcctggcctcagcctcacctggggaggtactggcggctgccaggggtgatgggggggaagtggtgaagacaggatgggaccagtggtggcatttctttccctcagcagccctgcccaacttgcttggttggacgagaaactggccagggtggctgtgagcctctgaggggcagaggccaggagagatggggcctctgagggatggggtgaggcatcttgggcttgcccgtttccctctgcccctgactcccagccatcaggtggccagggaacatctctggaaccacagtcccttcctccatgtggcctgagggagctgatggatcaggctgaaaatcgacagttttctctggtaaaatggggaaatgggaagagttggcagttgtgaagaaggttagggacagtgttctcaccctttcctgtcttccaggcacagggcttgaaatccctagtccttctctactgcttgtccaggacatgccagcccatctgcttcagctttgggggtgagcagctttgctcctgggtctcagatctctgcagggtcttgttcctgacggacacacgtgtgaatcacaatattgattgcagatacatttatccagtgcttactgagtcctaggttcttttcatgtgtgcagagtaggtgttattttacagacagagaaagtaaggctgagaggctgagttatttacccagaggcttgctgccagccatcgagagacccctctgattcaaatccaggttggttccaccttttccatgagcacaggtctgcatttggaagatggccctgtggcttcctagatagagctaaacctgagctgcagaggccctgctgccaatgggattgattgagtgccctcagagaggaggggctttgggattcagtaaggaaagtggtcagctggaagtagatgtgcaatttctattgactcttctgttcctttgcctgctctcggtacatctactgccctcgtggagtttcccaaggggacaggcctccctgcaggaaggacagtcccagtcacctgagggacctctcccactccactgctgattactctcccatcttgaaccctctcctctgggctcttgtctgcctccctcaccttgccccttccccagctcctgccccctgccctctcctctcaacctggtgatccccacctctgcaacccaagaccagttggaggctggtggtttcagcagcccctgtgagccccgccgccgctggggtctgtgcctctccttcctgccctcttgctcttcaggcttccaccttgtttaactgatgaatttagtgaaaagccaactgcagaacgatgctggaagtggttggggatggaggggcactagaggacaagttagttgaggccagggaatatacccttatttatttaaatgtatttattcactcattcagtaaatatttgttgaatagctactgtgtgctaggcagtgttctaagtttggggaatacatcagtgaaaaacaaaacaaaaggccctgtccccatgaagctggcactctaggggagtctctgcatgtctgtggatattgcctggtaggccgtttcacttgcacctagaagctcacctgcatgcctttcacccccgtctctagatagtgcagaggttagaagccacctgggccctcatcccagctccacaactaactagctctgtgaccttgggcaaatgcttctgtaagatgggggtagtaatactttaaactaaaatacagtaaactttagagggtactggcattttgtgagataagtaaagtgcttggatttaggtgcttgtcttcataagtgcttaaatatcaatgtattatttatgaaataagaatgaatagccatgcccacaccccttacaaggttgctgggaagggaggtgagaggaatgataagtttctttctgtactaccaagcacacgcacataagagggtcagctctattttcccttccagggcccaattttaccatccctccgcagggccaagtgagctttgacacagtgaattaagaattgattgctgggagtggtggctcatgcctgtaatcccagcactttgggagcccgaggcaggtggatcaccggaggtcaggagtttgagaccagcctgaccgacatggagaaaccccgtctctactaaaaatacaaaattagctgggcgtggtggcacctgcctgtaatcccagctactcgggaggctaaggcaggagaattgcttaaacccgggaggctgaggttgcagtgagctgagatcacgccactgtactctagcctgggcaacagagtgagactctcatcgcaaaaaaaaaaaaaaagaagaaaaaagaattgatgcagctgggaatggtaaaggagggttggcccatgaacccattaacccattaacccattaacccatgaaccactgacaatccaggagtctagcagaggctggaatggaggaagactgttaaggctgtatcctgcagagcaagaaagagtcctgtgatcctaaagtgatggcggctgtggagctggaggcagggccgggagtagctctatgggtgccagatagctgtgatcccaacaggctaacatcttgactttggtttcccttaccccaccccgtaaaggggaagcccccaccttgccctgcctgcccatgtctgaaggtgggtggcatgtcccaaagccccaatctagatccctctctccaggaaggggatgccccaccactgccaagggaagcctcagatccttgggggatgaggggatgtctgggagtcaagattactcagtcagcacagtgagcacctgggaaggtggggttggggcagctggacatctgaagctctgggcaagggcacacatggctgtttcctcactggagcaacagcatgagagctggtcagagtggctggactggttttagggcactgttttttcagctggtgggaagtgggtgggagtatgcacaggcctctttcctgtggcctttatggggacaggagataggagaacagcaattaggacccagatgggcctgggttctagtcttggcttcactgtttttagcactttcttaacctctgtaagcctcaaatcctcagttgcaaaatggaaaaaaattatagtatcttcccagcaagaatctgtcctctctaaatgagctaaaggcacataaaatgctttacccaactcttggcacataggaagccctccgtaaatcacagctgctttatggtgacggtgatggagacagggaactctactccgttcccaaacaagagctgggcctgagctttgtgcaggctccccttttcccattactctccaggcttgtatggaaaatgaaaatattgtctcgtgtgaatttgggagccaagttaaagaatccagccagtgaacaggggccgcctcctcccgcgaaagctgtttccctaaccccgaggacgggacgccttgtctgacagggtgtttacctggctctcccatgtcccttcccctaacccagtgatggccttagtcctgggtcagcttttctgttctgggagaccaattaaagccccctcctcttcctgcataatcccagccatgatcagtgaggtatccacagatacacacagtgggaatagggagctagcaccccaaattcacatccagacctcagctccctgagcctggctttcctcctctgccaagtgatgcctggcagaatgacaggaagagccagttaggtaacgtgtgtaaaagccccggcgaggggtgtctgacatacagcagcactagcacagcttctctccaccagcacttgggtggagctgagctgattcccaggccagctgcttgggaaccacagcagaggaggcaaccgcaaggggcagtggggcagcccaggggcaggcagacccaggcagatggaggcagggaggcttgaacttgcagacttgaaaccagacagtctacaacctagcccagttctgccaggtaaccaacctctctccgcccagtgggtgtaattgccaccactgggtctttgcaaggaatgagtagtgcttgcagccccggggagttaggggctctctccagtgcctcctttgcccgccccttgttgggcaaccacagagggatactagaagtcatggggaaagcacataatgctgtggctgcctgataagccagggcctgaggctgccagctggtccccaaagggcacaccatcagtggggtgaagggtagaaagcccagctcttccacctctccccactcccaaacttaatgccttcttcagttaccctgttttgccagttcttttgtttgatgtctccttagcacttactaaatgattcccaaatcacaggttacctttggcactagcatttcccagggggagcatttttggccttgtgggtgtggttgtcctgtgaattgcagggcatttagcatctctagccccttgccttctcaatgccagagcatctcccatcacccattagaataaacataagaggagggcagggattccgtccgttcactgcagtatactcactgcctagaacagtgcctggtacatgcaacattcctccttagaaagcatttccagacacttccaaaaggcactaccaccccagtggagaacccctgttccagacataccttccacaacacccttgatggatgctggctaccctggtctaaatactttgcattatcagaaattgattactacaaggagtagccctttgtagactcattatccaaaacagccaccccatctcccccttggactttggcctgttggttagcatatcatgtgaagtctgacacccagaatgaaacaaggtgccccatatatggcctgaccctgcaagcaacagtgggcttgttacctcccagccctggatagacctggagttgacatagcctgagattgcatttacttttcttgtgacagcaggacagtaggattactgtttgttgatccatggtcagctaatatccagggacttttcccttcaatcctctaccagtcttttccaatccaaagtataagacttaaacatttaagtggatacttgtatgttgttgattttggcccctatatccagccagatgattttgaatcttgatactgccattgctatgtgttagctatcttcccatcccatccttatccccaattttgcatccactgcacattggattagtaaaccatctctgtcctcactgtgctgtggtttaaaatattgaagaaaaccaggccttaagcatgatggtggagactcagtctgggttgataatgatcaatacctcctagggttgtttgtctgcctttgaatggacccaattaatcctggctccactgacatttctgtgtcttgtccacatgaatttctttaagcccatctgttagctgccttgctgatatctagatggattacattccacagaacttcaaggctttgcaaccctttgaaaaggagatgcacttagctgagcatgacttgttctgggtgaatctgtgctagtttctagtgcccactacttcctcttctgcatgttccaaacattctcctctccccattttgaagtttgcaagagttcaggtttgttttctgaatttctagaatccactcttttcctttttgtgaaaaatgggaacagcttgtcttctgacatctttcctgttccccatgattccatggggatgaccagaggtggtgctgcagcctcacctgtgatcagtgattcaattatcatttcaagatgttcttgtatgttcttatatactcttttcttgtaggccggtcccattcaagatcgatatctgaggtagcaaaggtagatgccaaaggagagctgggtggttccgctttctctgccatctgtttaacattaacgtggccctggtacttcctcattctcttgctccaaacagatttgatgttttcagaaacccattggatggtccttagtatttgttttagctctcctgttggcctgttagtatctaaatgtcctttagccatttcacattgaaatggtctggccagctagacagagagctctctgagggcaggggctgccttggccagagtttgatgcgatggtccccactttccactttgatgctgcacagccttcgtagcctcggagatgctgtgaaatgccggaggaggcagcgcagtgagctgtgtggtttgatggtctgacagacaagcgtgccatcatggaaaattctttgcagagtgtgcagatccatttacgcaggccggctgctgcttctgcaaattacactttccttcagaacaacccacccatgccctttttttcccaccaaacctcagtcatgctctgggtaggttagaaacaaggttttttttgtctccctctgtttccatccctcactcttctgtctcttctctctcagtccttgtcttggtttttataggcaatttggctgaatgcctagcttctggtctggatggcctacccatctgcaggcgctccttggggacaggacttgagccccagatttagagtcccttcttatgtgacttctggggtccaggccctgccagctgataaagccccacagataggttggagccagtggtgatagcagagttggggcctagtcagatggaaacaggtttgcagctgtcagtattgtaggagtagataagttccccacacctctgccccaccgctcctcgcactctccagggggacatcccatccccaggtggcctctcacctgctatccacagttactggaagctctttggggattgatagcacagttatgagtcaccctgaaatgtactcaccctctgatctgtcccttcccagacagctgctcagcccagggcagagagagaaagggctacagggaagggagggaagtgagatcccataggggagagggtacattagagtcctaggctgggggaaaggaggacctgctgatttgcatgccctccgaggacaagtcaacagggcactgagctgacctgagcaggtatcctacagtaggctgaagggtatatggggggcccctccccagccaaccctgaacaaggacctggtctctgcaggtagaacaccctccatggagggctgggtgaggcacaggggacctccttgtgtgtgtctgcctcacatgtgctttttttgagaggcagaattaatctagtgcagtggttctcaaagtgtggtccctgtccacagcatcacctgggaacatgtttagaaatgttccttctagacctcctaaatcagaaactcggagtagtaggggccagcagtctgttgaacaagatttccaggtgatcctggtgcatgctagtaagttggagaagcattgactcagtgaaagaatgaactttggagccagattgcctgggttcatatctttaccttgggtaaatcaggtaacctctctgatcctctatacaatgtttcatctgtaacatggagacactgccaccttcttcttgtgatgactaaatgaaaatgcttacaaggagtttagtgcagttctgtcaatcagcatctgttaagtgtggcctcagctctgacctttactgtttctcattttaggtggtatctgatgctgcaggacagggtgtggccatcacagggaaccagaccttcaacaactggaactggcccaatgcaatgatttttgcagcgaccgtcattaccaccattggtaagtcttctgggacctgtaggacacccacatccatgccctagctcctcagaacctttctagaaacccagctctggtcactcagccctgttgggggtacaatcagatcagttgcaggctattcttttgatactttcttagggatttgttaagtccttggtagctgatcatgcctgggaaggtttccttgagtcttgacctgggctctttgagcagaaacaatgacacagcctcatggccagagccatgcaagagattaaccagactgctcattgcagaaacccagatcatgactacttaccaagctgggtgtctgtttcagttctcaggctgcatagccaaccagtccagaagtttggctcagaacgcagcttcttctctttcaccattctgtgagcttgactgggctcagctggctggttcttgcttgggctcccaatgcagtggcagtcgaacaatggctgggctggagtcttctgaaagccaaactcatctgatggcccagatggctcctcccatcacagatttgacagttgatgctggctgttggctgggagctcagctggggatgaaaacacaaggcctccgcatgtgtttgggaaccaaggcgaaaagcagcaggcttcttagacctcacctgtccagcgtctcttccgctgcctagactgcttctgttgtcaagccactaaagcccagattccaagggaagaggattagatgacaccttgatgtgagcagttgcataagaagggagggaatggaggatggctatctttggagaccatctaccacagtgcttctggggaatctacacagagagcatgtcttataacttgcacagtggtaccatatagactagtggaagacctgttgaccaggcttagtccctgccttcagggagctccttgtatgatggaggagatacagctcatgtcatcataattgctttatcaatgatcatgatcagagtatgatcaagggaaatatcattacttaagtactgacaatagatcaatatcaatttatcttagagaacgggctgtgtgtgtgttggaagcaaggcccactggtttgaccacccctcctgttcttggcctcactctctccttcctcaggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctggtatgtcccctaccctgggtgttgggcagagatgggggaaccatgacaggtgaggggaggacaggaggcctctaggaattggaccaagggtgtaaggacagatggcaagaggatagtttcagagctccttgccctcccgggtcaggctgggtacccagctagcctctcctctagctgcctccctggccctctgggtgcctttgctgggtttccaagtctccactattctctgacttggcctcctgctccccatcagcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgagtccctgcctctgcctcccacctctttttctgcttctttggtttcagtgcaacagacctatgttgggggtgccctaggtagggttccatgttctgggcacttctcttacccagtgggattctcaacccactctgccatttgcaagaggaaactaagacccagagtaatgacaaaaaactcttttctctctggttccctttctcagacatggcctttttcctcctcctttcctctctgctcagtctctgatctcctctccctcagttctcccatgactcctgagcttggcttcatgggggacttgcaagtagggccttctgcctgcacggttggtacctgctacccagggagcccctgagcccaccagcacccactccacgccctcagcagcctttcatctttcacaagagtggagggaggtgtcctgaaggcatggctcagaggcctggggctttgttcctgctgtagcagcttaaagacaagggaggccttctccccagctgccctgcccccagccctgacactccctcctactcctcccctgcttaatccagggaagtgatgaggttctttggcccctttgtctgaaggcctgttaccagctggccccagccacacatgtacttgtgtttgtggcctgcacagcatcttggttcttaatcttcttgacaccctgtttgaccctgttgacccaccaccccagtgacctcaacttctgctccagaggcctctgttctgtaccccctcccttttgcccagagggcagtgggaggccactagccttgtgcttgatgtatgtggcatctgggagcagttggctgagttgggggaggaacaggaaagagaggcacaaacactcccctgaccctgccaagtccgggcctgctgtcctgggcagtacatgtggacaaggcacaaccctgccattgtccagcccttgaggcccagagcaggctaaggaggtgcctctggtattagggaaatacagatgtacacttagccatactttctcagcaccagcaagacaccaaaccctgcctcagctttctcttctgtaaaattagtaaaaataataattactattcatgagtgttaagggtagggcctggctatatcagtgtgtgccctcattactgtcatcatgaaactctgcttgtgattgagagccttgagcaggattaacaggaccactcagggcacctgctatctgagcccggtcgtgggaggagaactgaccgggctacagcacctggaggaacctctagtctgatgagagaggtagcccccttcctccaggtcccttctgtaagttgctcttgtatctagtcgagggggcaaatggaatacaggtcaacatgcctgtacatgtagtcgtcaacgacatttcaaataatcctggagtgtagggggaaccttcagagctgtagggggtaagccaagaaggctccctgcagcaggagggggatgtggagcagacagagccctcctccaggtcaagggagagctgatctgaggaagtcagggaggcagaccagaccttcaatgaaaataaaaatggttcagcgtttcttgccacggtgggtgcttcctgggtcatctcaacctaaccaccagccttgtttgtaatccaccagtgtgagtctagccccagcttggagggtgctgggggctcccttgtgtaatatccatccattccgtttttaagtgaactgtatcatatacgcagaacagctggggatggtagaagaattaacagaaaggcaaatactcatgaactgtttcttgacctgtgtgtcggttacattgccagtcccccaaagcccctttagcttccttcaaagagtcactgtcttgactttttttttttttttttttttttttttgagacggagtctctgtctgctgcccaggctagagtggcagtggtgtgatcttggctcactgcaacctctgcctcccgggttcaagcagttctcctgcttcagcctcctgagtagctggcccgccaccatacctggctaatttttgtattgttagtggagctggggttttaccatgttggtcagactggtttcgaactcctgacctcaagtgatccacctgccttgacctcccaaagtgctgggattgcagacgtgagccaccatgcctggcctgtcttgacgtttctagttgaggaaaccgagactcagagacaggctggagactgggatggggtcatgaatgatggcaggcccaagcccttgaggaagatgggatagtccagggtctagaacaggcccctttctatcccactgcacccccgtcctgtgctctggcctgacccctgctcagatcacacagcattggccattgcacatttcccgggccctgctaactcttcctgacctctggactgcctgtccgctcaggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagctgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggccagcttggtgtgtgctgtgtgtgggtcaggttagagaggggttggcttctggcctctgagcagcaggggagcctgggcgcatccacagaagatagagaggactcaggacagactgataagaggattggatggtctggaggggagaaaagaatgaaaagagatgaagagagcggggagaggcaggcctctgtggggaggtaaggacgcgggaggaacattgcagtagaggtttgagaatcaggaaggagtgggaggagcaaggggagaggcggggtgatcatggcaaacgcatgtcactcaccactttgtcaggcactaaatgcttgcactgaataatacgtgagtggactcatttgacctggcaagaaccctgagagggcatcagtacatctccattttatagacgaggaaacaggcacagagaagttgccttgtgcaaaatctcagtaaaaatggtgagactagattcaaacccaggcagcccagctcctgtcccctctaccactgtgatgagatgaaaaagactacctgtggttttgtggcacacccaacatctctggaaagggctcctgtctccaggtaggtggaccagagaacttgagcgaagctcaagccttctcaactcaaggggtgggcaggagatgtagagcctgagcgtgggcactgtggactggaaagaatgtgaaggaagaatggagccaggctcagccgggcatctgtctccatctgtctaaagggaggctttgtcaggcttcagctgtttggggactggccccttctatgaccatttcagggctcagcaccagaaaggatgatttctgagttcattggaaaaaaaaaaaaaaagtatgatttccggagtgaaccacatttttcatgagggcatggatgtgtttacaaaggattatatgtatttaccagccaattctgcaacgacaccatccctccctctgccaacatcactccctcttgccctctttctgctccccccgacccctctcctgccatcacacacaggtccaaggttctccggttttgctttaatcacattcagcctcaaggcaataacagttccataacactgtaagccccacctttattcagcacttggcctgttcacaaaccccattgacaaacatagcccaggttatttggcccatctacagttgagacgagagcttggggagcatgacttcctaagggcacccagctggactgaggcacagttttgcagaactgtgttcacagatgataaagcacagacccaagattgggtggaggtgtggccttgggtcactgtggccagggttagtctggagctttctgagtaagagatgggaggtagggcagcagctagagcaaagggtggggcccaggaggcctcaagttccccaggggtcatgagcaggggaggggtaccatgtggaggcatggggaacattccatcacagtccggggagctatagggtggatgggagtggggccggtggaggaggctggcgagtggcggaggagtggcagatgggtgggaagtcactggagataacactagcagggaaatccttctgttgaagtcattgatgttttgttgttgttttttgagaccgagtttcactcttccccaggctggagtgcagtggcatgatctcagctcactgcaacctccacctcccggttcaagtgattctcctgccttagctcccgagtagctgggactacaagtgtgagccaccacgcccagctaaattttgtatttttcaatagagacagggtttcactatgttagccaggctagtcttgaacacctgacctcaggtgatccgcccacctcggcctcccaaagtgctgggattacaggcgtgagccaccgtgcccggccgtcattgctgtatttctaatgcaaggcagagataattggattggtgagatctggcgacttgctggggtcctcgtggaggcagcactcctcctttcataggccccagggctccattcccagcaggcttctccgctgtcctagtaaaccagcacctgctctccaccagcaccacctgggctctccattatttgttccactaatgtttactgagcacctatgtatcattatcctcattttacaatgaggaaattgaggcaaatataggattttttccaagctgaaacaactattaactggcagcaaagcagcttccctgacttgcattctcattcctcattctaccctctaagtttctgatctgacaggggagacatcttcagagaacccagagtctgatggaggtgagagacagcgtctcccttcaaggagtctaatctgacaaggaggagagcacagaaagaccctcagggtcccagctgggcttcttatctcctgcatgatcctggaggagacatttagctccctgccagaggtgatgaagagaaaccaggatgtttgggtttcacctcctgactggaaagagccaggcaaggtaatcagcagccaccattgcatctgaagctctcataagtctggggtagagtggtggggagggacaggcaagctgggctgcacagctctgggtggggcctccagaaatgaggcccctgaggtttggtctcagctctgccattcatctctccattcttgaaataacaggttcccggtttccaaattcatgcacaactggtccaggaaccaatgacaactcgtgaattgtcaggatgtatttcacagtgaaaacccctccctaagatctctgtcccgtctatccatcatggccccatcaccagggtccaggccacctggcccctcacctggatctcccacaacagcgtagggcctggcacctggtagggggtccacagatatttgttgaatgaatgaatgagccccatctgctggtctccctgcctctaatactgactccctttctacctggccattactgtagccagcagcctaaactcaaacctgacccatttcttttctgttttaaactcctcaggggctccccattgctcttccaccccctcccccccgccccacctctctcttcagcctcctctcctttcccacctctctgggctccagccactttgccgttgctgtttcctctgccctgatgcccttcctctctctctcctgggtaagtcctgagacctagtgggattagatatggatatcaccttctctgggaagacttccacaattacctgtagccctcccggattctgggccaggtgctcctcctctgtgttccagagccccttcctcagtaagctgcctctctcccaccgagctgttctgatgttgttccagctccctgcctcctggtcttatgcctcctcccctgactgggagccgctaaagggcacagggagtagcttgtccaccttcagattcctgggagcccagtgtggagaggggcccagcttttccatgtttactaaatggagggtaaatgaactagaggcctggcccctcctactggtaattcagtccctctcttcctggggcagaggccaaatcagggggcaaggcttgttccagaagggcgagtccccacaaggccaggtggatgatcttgagggcccttgtggcaggctgagttggcctggtgagtcaccttatcttgtgccaagtcacttgaatctgcagggcagtactggaataaagcacaccttatttctccccaccccagggagcactgtcattggcacccccttttccacttgccccatctccccatcttcacctcttactgttcccaggtgattccgggagctgggcctcccaacccagcagctccccagtccccacggttccctcaggattacctctgctcccagcaaccctgcacaccgggcccagcctctcagttcataaagccctttcacacccattcctgggtgggattacgcaacagcagggagccaggtgcaatattttacaggcctcaatttaagggccttttccaaatgaggtaataaatgttttggtttgattttccaggaaaacaaggcctaaggctagaactgggagatggtcagaagaagtagcagaaagggatgtagaggtaaacatggggaaagaggaaaaggtcatacatgttcattttagagctgtttcaactgtgggcaactggggcttaatcccactagacctcccctgaaaaacctgtagaatacacctcagatttgtccatctgaaggacagggaccatttatccaccaattccacccttgttggttaaggatggccccagggaaattcatccccaccctcctttcatacatgtggatgcaacaggcggtattatcaaaagatgactgcgacaatatctccccactcacattctcatctgcaaaatgaactggccactccccaacaggaagcagagtctattccctttgaatgtgggctgcccccaggactgttttagtcaatggaatatggcagtgattcctgtgatttctgaacccatgtgtgtgtgtgtgtgggtgtgtgtgtgtgttttgtttttttgtttgttttttgcccaggctggagtgcccaggctgttgtgcaatggcacgatctcggctcactgcaagctccgcctcccgggttcacaccattctgcctcagcctcccgagtagctgggactacaggcacccaccaccatgcccagctaatttttgtatttttagtagagacggggtttcaccatgttagccaggatgctcttgatctcctgacctcatgacctcatgatccacccaccttggcctcccaaagtattgggattacaggtgtgagccactgcacctggccgaacccacatgttaaggcctggcagcttccactttggtgctctggcggaagccagctgcaatgtaagaaatccaagtaccttgagacccacactgtgaagaagcccaaactcgcccatggagatggcacatggagagagaattggccccactgagattccatcttgaacactgcaggcccagctgatgccatacagagtggagcccagccagcccgcagattgcagaatcatgagcaaaataaatgattgttttcataatcctgaaagcctgggagtggtttgttacacagcaatagataattggaacactggctgggcttgccctgagctatgtgacctttgccgggctttggagaaagcttggaggtagaaaggtagagagacacctgggcaccctgaggtggcactacagcagcggtgaaatgccaagtgggctgagggattgggccacctggcacaaatagtatctcctacctggaggctaaaactctttgccctcgaacacaataattggcagagctgagaccaactgtcactgggtcttctaactcttcacccggggctcttttccttatgcaacatcaaagttcgtaccttccagatatcaaagcccattctactttagggtctctagttctccctgctatgtttaaagagcctgggttctgctactatccagctgcacgaccttaatggccatatccatcattgacaggatgcttataggcactgcccaggatactttatgcatatgatctcacgtaatcccacaacagtgttattacccaatttggaagctgaggctcacagtgattatacaacagctagaggtggagtctgggttctaacttaaggatccagggcctgtgctattaactacagtgtaagccggccagggcaaaactctcctgctcaaggacaagagtgtacagagagggtgtcctggctgcagctccagccactccccagagtctgccctcctcatctccaagaccagtgaggtggaccaaccaaccctgcagggactacccaagaatcatcaggggattcctgggctccaccttgggaagattctgattcagaagctctggggtaaagcccagaaatacccaggttctgggaacacctggctggagatctcaaacaaaggtcaggtctctccaagcttcccacatccctgccaatccatccccacctgttttcattctgcattgaaatctgtgttgacatcaataatgtaaaatttcctcctccttctttgattccttcacctgcagctctggccagctgagctgctgcgttttaggtgttgacatcacacattatttaactcagatgacctgtatttgttgagtctctcgaaggttgcctagaacacctgatgctggtgactgagggcaaatgaacagctacctggcagtcaggcctggagcagccagacacctgcctctttctatcagctcagattcccaccctcaacagttcactccaggggaaattttctgacccagtggcctggagcccttttataccagctcacgggagctggtggttaactttttggaaattttgcaagctggttgttaaaccacagccactactaaaaaaaattaaaaaattaaattatataaatatgcaattagatggtattaagaacaaaggtcataagtatgtaaaattcatcacttcctagctattttgcatcttactattattcatgcttttgaggtgatttttcatcttctacaggtatatgcaaatacctgtagatatgctattgtgtttctctttccaacttgacgttttgtgacaccatattggtagctaaaaattgcccataggacaagcatttacactgtggaaatgggcaaacactaccaattagggatctctgctctccagagaaccagatgttaaacattcatcagcacatcactgcactgacctctggaatgatttgcaggctgggaagggcaggggagagtgaggttttgtccatcctggaaaggaagaagcagtctctggatttcagggagaatgtaattcgtgaagttgtcacttgcactccctcgagcgcctcagaccattgctgattagggatgaagattcaaggcccataggagctaactgcaggggtgatgagtgagcagtctatgtgtacttgccccctaaatgtacatagaagctcttgggtcatggtccaaactggaggcttaaagggacttctgccttcagctggagttctgagactgccgagggcctagtccaggagctgtcttgccctctgctgaactgcactgcagcttcagacaagtctctatgtcctgggtctctttatagttaaaggggagaccctctcagcaaagactaggtcctggcaactggatgaaagctattgagtgtgtcagattcagactaaggctttgcaaagatcatatcactgagcagaaacacacagcctgacacataggatactgtgactgaggcaaggagggaacacagaagggaatctaaggtcttctagaaattccctgccctcgagtgaagaggaagggatgactccacacaggatgtccatggccccagtcagaagtggctactacagaggtccagggcccctcggtctcaccccacaagccagtcgtagtacagccccgtcccatcagggcaggcatcatcctgcagaccatcaggcctgctccgggcatttgagccacatgtggtgctctccctctaacaattatggctcttaattgagcacttactttttgacaggctctgtgcctggcactgtacaaggggaccccgggaaaaggttcctctttcttttgttctcttccactctcatactcatgtgtgtgtgtgtgtgtgtgtgtgtgtgtgtgtgtgtgtgtgtctgtgtctgtgtttgtggtaggaggtggaggaaggcattgtgaagggttggaatcagggatccttaatgacccacacagaactgcagtgcgttactagttcaggttctccaagaagcagatgccatgactggattaaaccagagaggactgcattgagggaaacacctatgagaggctgggaacgctgcctgaccaccatgcaagttctatcccagtgcctatgaaggttgaagcttaggtggaagcagtctagactgccacgcaggctaaggaaagttaggcaaggctgctggggagtcctagagccaaaggcgtctcagacatgtctcctgggaattgacctgccttgctattcctgctgcactccgttcctggcagggagcagcccacagtctgggcacaaacttggcgatggattggaggccacaggggagacacctttcagtgccaggactttcaaggggatgctgggccctctcctaggtttccttgagatttcctgctgtatcctgatcacacactctcttctttccttgagctcgtgaaagtggtcactgtggaaagtgtcctcactgtatcatccccaactctcagccccagagaccctgacctactgtccaggagaggcaccccaagatatgcataagaagtcttttcttcaagtgtctcctctactgggtggcctgattctacactaaccgtctagaaagattcacttggtagtcctcgccctcccagattttcttgtctgctcttctctgcctggcaggtaacttcacatttgcggctgctaacttgttctctagatgttttatgggtgtctgtcccatcttcccggtgagaggggaggggaggggttgttcttggaactgcctcaaattccaggcttggccctttcctagctgcatgactcaggcaagtcacttcacctacccgagcctctatttcttcattggaaaaatggggattctaacgtacctcaagggtgagagcgatggcacctcatttcaaataccttcccaggccctctcattggtctatcttgtttcaggtttcctctcctagttagctttgccaaggtgggtcacatagttcaaagacagccacctaggctggcccgtcttcagcagggattgtgggtagggaaagcatctcaaatatatctaccacactcaccatcttctctccctcccactccacattcattcatggatgccttcaacaaatatttaccaagtatcttcagaaacagcactgagagtttgaaggcaggggaactaggcctagacttgtgactttggggacggcattgcccctctatgggcctcagtatcctctgtaacatgatggaggccacatttcaactagatcaaaggttctcagccctgggagaacatcagaatcatctagagagttttaaaataaaatgctgaaacccaaccacacccccacccctactcctgcaaagattgtggtttcattggctggaatggggtctaaatgacacacttaaaaaaaaacccagttgattcaaatatgcaaccagggttgaggaccattggattaaaggtgaatcattagatttttgctaataattcaatggctaaagtggtgcttagcctgcaagaggtgctcaatagatgctccttgaaggaatgaattcccttcagctataacattctgttcttagtcgagggggtactggggagctccagttggaccaaaatgaagagttttctcaaaaccaaaaagacactgaaggaaggaggaacactaccagttaaggaggaatctcagagtggttcttccttagaaatggaccaagctggattctctaactcttttgatacttaccgccagtgtgggagcctggaggctggaggactgccctacagcagggatgcggcttgagggtctgaaatctggcatgagatccccctactcaatagccctgtgacctcagcaagtcaatgagcagccagattttcacctacaaaccaggaatacatatttctccttcactagattttgggaagattgacagagacaaaggattggaaagcactacaggaatgtaagaggttattcctattaagccgaatccctggtaaatcccagatatgtggctgcctgaagtttccctaagggagcaggagagagagggaactaaattgtccagatctgacttggaaagtgacagctgtccagtcatagttctccctgaacttcaaggagtcacccattcccaggagggaaggaatgacgataatgtacatactgccccacttaatcacctcccaaagtccatacctcttaatagtgttgcgctgaggattaagtttcaacatgaactttggagtggagaccatcaatcaaaccttagcacgtggcaagagaggaagagacaggagccaggccagccttggttctcctgagatttgtatcttaacattgaccttcaccttttataactagtaggttccttggcactcaaagagccttgacccatctaggcacagggaacatg

SEQ ID NO: 161 - DNA, 3912 bp, Homo sapiens
ctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagctgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggccagcttggtgtgtgctgtgtgtgggtcaggttagagaggggttggcttctggcctctgagcagcaggggagcctgggcgcatccacagaagatagagaggactcaggacagactgataagaggattggatggtctggaggggagaaaagaatgaaaagagatgaagagagcggggagaggcaggcctctgtggggaggtaaggacgcgggaggaacattgc

SEQ ID NO: 162 - protein, 495 aa, Homo sapiens
MVDRGPLLTSAIIFYLAIGAAIFEVLEEPHWKEAKKNYYTQKLHLLKEFPCLGQEGLDKIVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT
